United States Patent 11,001,841 (CCCTC-BINDING FACTOR (CTCF) RNA INTERACTOME) - sequence listing, part 50

SEQ ID NO: 118364 - DNA, 1826 bp, Homo sapiens
agtaaatatatcttcacaaattgcttgtttagaaatggatcaaccagagtcaatctattttgtctacccctgtttaaaaaaaaacagctaaaatttttctttcttttctgcggtagttaaatctgtatatattctctgtttgcctgtatgtttaagtttgggataattttatctcttcccccgtgaatgaaatgctgggatgatctcattgcaggttttttattcagaaagtgttttttggtaatagcttacaataattggacttcttatgggacaggtgcctttcttggcattcaaaggtgttaattttacatgatcacaattttgatacagtaggaattattttgagtataaacatcttgtttgttaacttccccattttattttgaaattttttaattacatgatagaatgaagtagtaagcatatttagaatttttagtcttgtagtttctttttaaaagatgctatactaaaagtttatctgatttagatgggccagaaaatgtgatagtttgtccccggatgtcaaaactatgttgtttaagattattgcctttgaatctaatattgcctcaaataagaatgtgcttgtaactttacaactggaacactcttaattgggcttaataacttaagaaaattaccaggtgctgtggctcacgcctgtaatcccagcactttgggaggctgaggcgggcagatcatgaggtcaggagtttgagaccagcctggataacatagtgaaatcccgtgctaaaaaatacaaaaattagccgggcatgatggcgcttgccagtagtcccagctactatggaggctgaggcaggagaatcgcttgaacctgggaggtggaggttgtggtgagccgagatcgcaccactgcactccagcctgggcaacagagagactctgtctcaaaaacaaaacaagaaaattatggtgggaagtatgttggaaatatatacctttgaggttcttacgtcttgaatattggggataatgatgaattcttcataatgatttcccccttttgtattcatatgattgcaatacatttgtataaaatctcaactggtctgtatgggctctgtttgtttttatgatgtttgttcatgttttaaacgacttgctgaaatgatcttgtctctgagttggtttcagctaaatgattcggtcttttcccctgtgtttgatccttcaggtttggacatatttgactcttttccccccaggttgaattgaccaaagcaatggtgatggagaagcctagtcccctgctggtcgggcgggaatttgtgagacagtattacacactgctgaaccaggccccagacatgctgcataggtaagacatttttctcctgcatcatctaatgctgtcttttagtatgtggtacttatctttgagattctcccactcatcatcttatgctttgtagggttgttgcataatacttatttacatataaatatcccccaattttttatttgagacagagtctcgccctgttgtccagactggagtgcagtggtgcgatctggactgactgcaacgtccacctccccagtttaagtgattcttctgccccagcctcctgagtagctgggaccacaggtgcccacaaccatgcccggctaatttttgtattttttttttttttttttttaagtagagacggggtttcaccatgttggccaggctggtctcaaactcctaacctcaggtgattgatccgccttggcctcccaaagtcctgggattacaggcgtgagccactgcgcctagccccaaaaaataatttttgaaagttaaactaagttat

SEQ ID NO: 118365 - DNA, 1948 bp, Homo sapiens
tagttccagctactttgggaagctgaggtgccattgcactccagcctggtcagcaagagcaaaaaaaaaaaaaaaaaaaatgtgcacatcaaagatcatagccccggcacatcgaagctgcaatgagctatgattgcatcactgcactccagcctgggtgacagaatgagaccccgttgcaaaaaaaaaaaaaaaagtttgccagtatcagacgtgaaaaataaacttaagatacttgaagatgacaagtaaatcatcttcccattttacagattttatggaaagaactcttcttatgtccatgggggattggattcaaatggaaagccagcagatgcagtctacggacagaaagtaagcatttcaagccttatttaggctgttaagcaggtagaaaataactcataaaattgaagtggatcatacttaatagatttgctgataaagatccagtttctcaactttttagtaaaagttgatgtgttttattactatttgattaatatatttgttgaaatacttatgtgatgtcagatttgttaattttgtatgatatattctaaagcttttgtgtgttggaagataattggctttagcatggggatcatcttttctaaactttgaaaagtgtgttaattcaggacagttatttaaaaaactcaagcgcggtcactgggaatagagtatacaaagaaacatcaaaattcagtctgcatatcctgtaatttaaatatacacattctctttgtgttgtgttggaaggttttttttagttggaggttatttaaattttaaggcattctcagttgattattattattattattatttttttaaggaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggtatgtgtaggaatgattattttgtagtgatccaatacatgaaaaaagaaacaatgaactgttgtgcatatctttaaaaacacttgaaatttcagacttacagaaaacttggaataatagtacactaactcctatatactccttacctagagcagctgtcaccacttgcccacatgtgtataattctttctctaaaatagtttagtgggcatttcctaagaataattctcttccattctgtagtacagttatcaaattcaggaaatgttgatgcaatataatctataatccatttttaaaatttggaaattatctcaataatgtcttaacagtaattttttttccttgtccaacatggaatctataattacacattgcatttagctatcatgtctctagtctcttctaatctgcacttgttccttaatcttttgtttttttttattgcattgacatttttgaagagcacactttttttgtaggatgctttatgggtgtcattcagtgcttcacattaggcatattatgtcatttagttgtgatatgaattttgattagttaggttttgccactgtaaagttaaatatcttttctctctctctctttttttttgagacggagtctcactgtatcgtccaggctggagtgcagtggctccatctctgcccactgcaacctccgcctcctggtttcaggctgtcctcctgactcagcctcccgagtagctgggactataggcgtgtgctaccgtactcggctgattttagtatttttagtagtgatggggtttcaccatattcgtcaggctggtctctaactcctgacctcaagtgatctgcctgcctcagcctccgaaagtgggattacaggtgtgagccaccatgcccagccttattttttctctttttgatttgtaaatgaaggatgggagattct

SEQ ID NO: 118366 - DNA, 1129 bp, Homo sapiens
ggagtatgattgtgaattacaggtttaattacagtttttttcttttaaaggaagtatctaacttcttagtataatacactattatataaactgtctcatttaatacagagagtattgaggtatatgttgatatctttcttttttgttttttgagagaagagtctccctgtgttacccaggctggagtgcagtggtaggatcatgacttactgcagccttgactgcctgggctgaaatgataatcccacctgagcctcctaagtagctgggaccacaagtgcaggccaccattcctggctgatttttgtttctgcttttgtggagactcactctacaaaaaactcactgttgcccaggctagtctcaaactcctgggcttaagcagttctcctacctcagctctccaaagtgttgggatttcaggagtgagccactgtgcctagctggtacctttctttttacagaggagtaacagccttagaaactgaataactcataatatataattggatctgcactcaggtgtgtcttatacctactgcgagcaatctttttcaggctgcactacccttgagtgtttatatcaatatttttggagacagacttggggaattttaaatatctgctgaagttaggaatatgattgcctttttttttgagacaaggtcttactctgtcgcccaggctggagtgcagaggtgcagtctgggcttactgcaccctccacctcccgggttcaagcaatcctcccgcctcagcctccctagcagctgggactacaggtgtgggccattatgcctgtctcatttttgtatttttagtagagatggggtttcaccatattggccaggctggtcttgaactcctgaccttaggtgatctgcctgcctcggcctcccaaagtgctgggattgcaggcatgagccactgtgcccatccgggatatgattgccttataatgttttgaggtgtgggctgtggcatttacatgcttagggctttgtcagtttttggatatttatcttgtggtgaggtaaagtgttctgagcaaacaaaatgtatgtgagtgtagtctttttaccggctattgtagagtgggcattttcagtcttggcactgttgacatttt

SEQ ID NO: 118367 - DNA, 1661 bp, Homo sapiens
cacgaggtcaggagatcgaggccatcctggctaacatggtgaaaccccatctctactaaaaatacaaaaaattagccaggcgtggtggcaggcgccttagtcctagctattcgggagactgaggcaggagaatggcgtgaacccaggaggtggggctttcaatgagccgagatcgcgccactgcactctctagcctgggcgagagagcgagactccgtctcaaaaaacaaaaaacaaaaaaaagtctgttcttcaaagccttagttctgtccttaaagtcagtgccatgattttaccaaattgtcctactttgtttatttatatatgtttttcttcactgttgttttgtgaacattgcgaaagttaatgtatatgtgaattcagtaagtacaaattactttaaatatctttttctcacttagagtctgaagaagaagtagaggaacctgaagaaagacagcaaacacctgaggtggtacctgatgattctggaactttctatgatcaggcagttgtcaggtaagaagattttgttcacatgtccggggctgcataagaacttgcattgtctagtctttccctttgttggagggcatttacatattctgagaattacctcaaaataataatttctcagaagaatggttttgtttctggtaattttgactaaacaaaaatatgtaacttgtttgttaatagtaaattgtactatgaaggcaatctactattgcttagtttaaatagtatcagtttctttttggtttagttttttcttggtgttaagtgaaaacttgcatattgtttatcaagagttgaatgtattgaggtattaaatgctttgagggaatatgaagtggacagagacctatttaattagagatcgggcataaattgatataaataccaatatgtgagttaagtagcaataaagaatttcattacgttagtaagtgcatcattatacctttgggttttttcccccttgtgattagaacagaaatgtgtttgatagcaatagaaatccatatttacttgttaccatgtgatactgaatgttaatattcagtgcctgaagggtgttttcaagtgtttcttaaggtgtgatgaactaatcaggttactcacttgggttgctggttgaaaatgaagattcatggtcccactgcaaacctaccgaattagactttcaggaggcaaaacatctgcagttttgtttgtttttgttctattgagacagagtcttgctctgttacccaggctggagtgcagtggcgcgatcttggctgactgcaacctccgcttcctggattcaagcaatccccctgcctcagcctcctgagtagctgggactacaggcgcacgccaccatgcccggctaagttttgtgtttttgtagagatggggtttcgccatattggccaggctggtctggaactcctaatctcaggtgatctgcccaccttggcctcgcaaagtgctgggattacaggtgtgtgcccagccccctctgcagttttaacagcatttctggttgatttatgtggaattttaagaattgtattctgaatcataactattttctcccccaaattccttatgtgcttgaaagagtttttgtgtgtttgtgttaaaagccacatatcataaaatttgccatctta

SEQ ID NO: 118368 - DNA, 1055 bp, Homo sapiens
cttttattgaagataactttatataccttataaacagactatacccattgaatggcaactttctttcccgccccccccgccccagcctattttgagagtttttctgatgttgtatgctaaatgaattgtaatagttgtgggattccagccataaagtggtttggttcattttgatgtcctgattcatttgcttatcagaatttgccaaacaaatggattccagttaagttattgagtggcattttaaaaattactttttaaaaactcagatagatatacaattcttagatttttgttttggatagaaggagctaactctgtgttctggtttctgattaataaatgatggaggaattttttgtgaaataaatggtggcagaatgatatttctcaaattttcctgtcaaagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgagggtatgaaacgtgtcttcatttttattctattcctagttattttttttaaaaaaagtttctgttcttttgtattgctgtttggttgacttgtagatacattttcatattggtggttcatttcagggaaatttcttagatattgagccatatgtttgataagagagaggtaagatgtgtattagtttatttcatcaaaagaaaccactcccttccccgaggtaacttgaatgcctgttagaccagaaattttaggtgccactgtagcaccctatcagtgattccttttctatttaatatttaatcttttacactataaattattacatacttgttactacaagtgcataacatcttttcaagaaaaataacatggcagaatatactttttctatgaaattttattgaagataactttatagtggaagtagaaatgaactgctgaag

SEQ ID NO: 118369 - DNA, 2116 bp, Homo sapiens
ctttgggaggctgaggccaggaggattgcttgagtttaggagttcaagaccagcctggtcaatatagtgagacttcatctctactaaaaagaaaaaatagctggacatggtggcacatgcctgtagtttcagctgcttgggaaacaggtgggaggatcacttgagcacaggagatgtaggctgcaatgagctgtgtgcatgccactgcattccagcctgggcaacagagcaagattctgtctcaaaaaaaaaagtgagtagtttcttgaacctaagcctctcggatttgcttggtacttgatcatcagtcccaaggaatttcagtactaaattttgaatagctgaaagagaagaatcttaatatatatatataaactccatcctgcctatgagaatgtgttaccgtttgttctgtacaggaaatcaagagttagtagcttttatattgttttgatacctggtataattatgtaatgttggtattgctcccttagacattttcttgggcatctgtgaccagtaagaatcttccacccagtggagctgttccagttactgggataccacctcatgttgttaaagtaccagcttcacaggtaaggtcctaataaaacttgtacattaggcaaatttacttctattgtggtaatttgattcaacagaggtttagagaatgtgaaaactggtcaggtgcagtgtggctcatgcctgtaatcccagcactttaggaggctgaagccagctgatcactggagcctaggagtttgaaaccagtctgggcaacatagtgagaccctgtctctacaaaaaataagaaattagctgggccttgtggcatgcatctgtagtcctagctacttaggaagctgaggtgggaggattgcttgagtcccggaggttgaggctgcagtgagtcatgattgtgccactgcactgcatcatgggcgacatactgagactctggctcaaaaaaaaaaaaccaacccaaatcaatgtagaaacagaactgacatataggacggaagagaagggtataagatggtttttaatgatttttcttgtgagggaattgtccattttgtagtttaaaacttgttagctaagaaacttcattaagaaaaaggataagcctgctttgttttaacacaaaagttaacttaaaatttttcagccccgtccagagtctaagcctgaatctcagattccaccacaaagacctcagcgggatcaaagagtgcgagaacaacgaataaatattcctccccaaaggggacccagaccaagtaagagctcagaagggcgatttctcgtttgggggattttgaggtgagagcttattttgggagggcagttgatatttatatactttaaaataaaaatattgtagggttgatggaattacctgtttttagtgtagagggaaaactattgaatgtgagcagtcattgaaagatgtcttctttctcttgtctttcattgatgtttttgtctccttttaagtccgtgaggctggtgagcaaggtgacattgaaccccgaagaatggtgagacaccctgacagtcaccaactcttcattggcaacctgcctcatgaagtggacaaatcagagcttaaagatttctttcaaagtaggttattgagttttgaacactaaattcatctagtgtctctctagcactgtccagtagcaatagaaaatgagccacatatgtaattataaattttctagtagtcatggttaaaaaaaaaaaggtaaaaagaaactggataattttaataacatttaacttaaggcattgtcatttcaacatgtaagaatattgtgagagatattttacactttttcataatctttgaaatccaaatgtgcctcccataattttacacttatgagaggcacatctcaattcagactagctatatttataattcaagtgctcagtagtcacatgcatctagtggctactgtattggactgtgtacatgtaatgtttaaagataatggtctaagtagttatctgagaatgtgtttcacttgcaggttatggaaacgtggtggagttgcgcattaacagtggtgggaaattacccaattttggttttgttgtgtttgat

SEQ ID NO: 118370 - DNA, 3860 bp, Homo sapiens
ctcctgggttcaagcaattctcctgcctcagcctccttgaatagctggaactacaggcgtgtgtcaccatgtctggctaatttttgtgtttttttagtagagacggggtttcaccatgttggtcaggctggtcttgaactcctgacctcgtaatccacccgtctcggcctcccaaagtgctgggattacaggcatgagtcaccgtgcccagcctctgctggttcattattacagctttctttatctttgatagtgatagccagctcatcagtactcttaagtctggtcaccttgattcttacagcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaatttaatctggcaatatagactaatactcgtttcacatatgtgttatttgttgagtgctgtgtgtgagatgggtgaaggttttgtttacacgtgtgaaacaaacttttgtgtgattgtcattactaattgaagggcaaccaggttgtaaaattcagcgtatttattttcttaacagtattcatctttaggactgtcgtttgaggatagcataggaatatttggtttgcattactgagaaactctaggtttgctgtgatggttaagaccacagtgaagttggtattaccagtttggttccagttcctcaaatatttgaaaattggcagcatctcctttacataaacttaatgtaactgaatcacatggcttttttgtagggttaaagtaactttggtaaccacttttggcccagatcactgataataggaagaaatacaacttatacttttgtagcttatattaagcatgtggtgggtggaaagaaaagtttagtctgagtcactttggaaaaaaaaattactttgtggtaacttcaaggtcataaattatggatagcctagaaattatccttcatgagtgaatactaaattatacatttcaaaacagaagttcttcctacttggagacttaagggcattaactagatgcagcaatcctcagcttggtgttatcacatactagaggacatttggaaatgtgtgaaatttggaagggttgttggagagacatgcatctggcatttattgggtggggtctaaggataccaaatgttgtgtaaaaatgaagcaaccccattgagaacactgatagtccctattcctgtgggtgggtggagctgtgggattaggaaaactggaatgaagactcattcttttgaaactcagcctcagataaataacaaactaggaaatggaaatctgtttcaagaattgcagtaacatctactctaaggaattagtaatttcactttttattatttgtaccaaatgtatgtgtgtgttgtgtatgttggtgtaaatgtggagaggtggtagcaatacatactgatgctgcttgtaatttgttgcagggaattactgcacaatctcagaaaatagaaagcttccccagtgctttctgtcatcagagttgggatgattgtgaggttttgaatgatagtattggacctaagaaataggattagcatcatgatcagaactgttgagaatccttgtacaattatgtacattattgcatgtagagtaaacctgagagcttagagatgtatacgtttccactgctggaaaatcattataagttagggcaacattttctataggtggcagcagtaggagctcatcacattgaacattttcagattttaaaatgaaaattttcatccgtaggaatggcccaatgtatagttattagctactgagcttagaactcttgacccatgagattttttttttaaatttttatttttatagaggcaaggtcttgctatgttgtcaggctggtctcaagctcctggcctcatcagttctcctgccttccaagtagccggaactacaggtgtgcaccattgcacctggcctcatgagtattttagttagataagatttgtttggttcagtgggtcttagttttttaagacctgttaatttgtaattagacatcttgggccttaaactgtatttttgttttagtggtgaggttgggttttactttgtgtattccagcgttctcaactttgtcagatattgctagggaccagtgagatagataatccaaaaataataatttgactttggttgagtatgtcattaccacagtgttagttgaattgcactttaggttagaaaagttaattttcacatctgtgctgcgggttaggtgatattgtcctcagcacaatagatgaggaagaaactgaatcagaacagttaaatgacaggcttccaagtcatccatgtagcaaggagcacatttgcctcccaaactgatgctttttctctagaaccataatgcccccctaattacatttcagtagcatagaccgcaatgaacttcctactgtagggagacttgagtctggaatacattcagaac

SEQ ID NO: 118371 - DNA, 1988 bp, Homo sapiens
agttttcatacccctgttttctcaattttcttagaactgtctttaatggcccagctctaccagggcttgttgtctaaggacattaacttgtgctcccctcagggatgggtttactactagctgtcagaaagctattgggtatcctaatgtgttaatagctgaaactcagctgtaatttctcctaaatacttcagcattttgcattctgtacattgtggtgctttttccaccttgtattgttgtaactgtaagctcctagggggcagcaatttggtcttaggcgtgtaccctgtttagtgcctggcaatgccatgtttatatcaaggtcttaatattacttttgagttatttctcccactcttcatggaagtgatgctccagccttgctaaaacactgagggtcctcccgataagccaggcattgtgattccttggcttcaagtgccttctgtcttccccgaaggtccactgagatctacaatcccccctttcctctgatctcttgccatgtaagtaattttttaaaagatcagtacaagagctatattttttcctaagaaaaaatttcaacaggaatggggagtagccccgttttggggctgatctgtccagaatttggagtgaggaacaaatccattctcatctactttccacattttccctcttgtttgaggtcctgttccaaccttcatttctgaaactgttctagagcactttgtctttctcgtagttcataacttaccccttcagtctagaattagaattacattatctgttttactactttactagactgtaagctcctagaagataaggactagggagttcatctctgtattccaccagaaggtacagtgactcataactagagtctttagatgaaacttactgagttgaataacttaatatatttctgttttcattcccaagggaggccatgtctggagatagaccttgaatttaataaattttaggcactataccatttcagtggagaaaattgttgggaaatttggggggatggatatataagggggaggaagtcactggccagtttgaggtgcttccattggtctgggtaactagccatttcttcctgattgtgcctagtatatcccagacagtttgtttctatgcagaagaattttatatgaaattttcatttctttgcaaaaacttgttccttctttcagttcatgacatcatccatgctaaagtctgagtcatctgcttccatttttgttattccccacatccagtcttcagctaagtcctgtcagttctacctcaagtctttcccgtctttcttcctcacctatgtaatttcagtagtctctcagcttcacttaacctcttactccagcctactttatacacaatgttagattcatcttactgaaacatagttctgaccatgtattccatgtatgtgttctctctcccctattagactgtaagctccttatgggcaggatctgtgtctgagtcatctttgtatcttgcctagcacctatcaataaatacttcttgaatgaacaaatgaattctcatttctcgacataaagccttgtctaaagtgagatgttttccaggtcatacataggtttctccctggggtaattggaagttcttgcatataaagttggttaaatagtaataattatgagttaaccacagaaaatttcagaaaactttaatttttttccattggaatcagcatggatatgtgtatatggatggttcaataaatatacttttatatacatgtttcacagaaattttacattccatcttcaaactgcagaaatagattttttttttttacaagccaaaaaataactgccataacttttgtgacttcatgcaaaaaaaggggggaagagtaaggggcaaaagggaattagttgttcaaggttgagtgtccagtaagaagtaaaaatgttacattaaggaagcgattgcttaacacgctgcttaaggtggtagcc

SEQ ID NO: 118372 - DNA, 1051 bp, Homo sapiens
tacaaacaccatgcaacaaagaattattaaaaggaaatcaccttggttatgcaaaagcctcgttttaagaaatgagaagggcctcagaatgagccagaaaaaaactaccagaaaatgcacttgtccacggacaaggccacaggcaccggatggtgttcacaggactgacggcctctcagccttgaactccagctgtctccctgaaccaactccctgtaaagcctaacacacaaaatgaaaacactatacagccagccagcaaattcattcagaaagcacattagaagggaacaatgcccagagatgctggggagaggggcttatccacacagtgcctatgctttgtaatgcaagctcttatgaggggtactgaggccccaaagcttttgaaactccttacaaaggatccctttgtgattttctaaagttggtattgtccaagtctcctgaggctaattcaatgcaattagattaccactctctgcctttgaattgggctgtttttcagtgtccgttgctctaaattagtttaccatcttaacagggagctgccgacaatcattaatcccagccatgaaatgggcagcagccctgagcagcatgctctcttgcctcatattctgggcaacccacaggcacatggagaacaagcctctgctccctttctcacaagtacattcccaactcttccacctgttcacccccagagaattgcactttccttcagagtgtcttgagtatcaacagaatcatggaatcttgcggtaggaaggactcttagctctagaattcaatggctgtcaaagttagctgtgaggggcttgtcaaaaagacagattcccaaacatttgttaagaggacagatcttatattaagtattcttactgcaaataacaacaataataataacaaatatataaaagagcaagaggaaacttttgggggtgattgatagtttatggcatagattatggtgatggtttcatgagtatatacttgtctctaaactcatcaagtcctaaatatgtacagcttttgtatgtcaatcaca

SEQ ID NO: 118373 - DNA, 1078 bp, Homo sapiens
aatgccaccttattctggctactcctgcagaaatgaaggagtggggttattttagtatataaaaattcaggcaggagagatggtttaaagaggaagattgttgccttcagtgtttgattgaagtattcaggttctcacagtattctttccagttgttgtaattcataaattatttgaaaagaaacttttgtagaaagtccaagaataataactctagataaagattagtgggacactcaggcaaaaatgttggtctttctttgacatgttgcaaaatgttatcaattttgtcatggatataatttgcagcccatggatataactggttgataagccagagaaaaataatttagtgttctaaaattcatggcatgtgtggtttattaatgccatgtactttctcctttctggaataaaatctatggctttaagaaaactgagcatatgtaaactctgtgatgattaccctttatcacatgaattcttggaaatagaaagtttcatctgcttttttaaattcttagtagatatttggcattgaggagaaacttgtagactattatagccatgtgaattaactgtagcaaagtgccctttttcttcaaattgctccccctccccaggatgacacacttcatgtcatagctgaaccctactctactggattcaaggccagtaaatgcaatttagagaagcagttttatgtttgcagatattctgagtctcttcaggatgtgtttcgtgtctaccatatatgcaggataaattctttaacagcaaactccaaaggaatgttgaagctgttttagcaatgaggatttttttgtttgagtgttgaagtgggccatagtcctttagaaatgatgttcatttatgataggatttaacttctaaggcatagtttattttttcctctttcctttttgtttgttttaatgtattctttagcatgtttttgatataacttttatcctccagatcttaagctttcttttgctctcttcagcaatttaagagactattaagctgtcgtcttcctaaaagctattttggtatccactctttttaaaaaaattct

SEQ ID NO: 118374 - DNA, 1034 bp, Homo sapiens
tgtttgtattattagtcaactgttatgattctttccagcctcatctctcagtgttctcttctgtaaacctcactactccaacctaattttctgtcacactcctcatcctctatattcttccttactggcctttattctgtttctcaggtgtaccaagctgatttccctgtgcttacaactctctttgcctaactatttgtatggccaattccttcagatttcagctgaaacataacttttcagagacccttcctgaccacccaaactcaagccaccttctacccatacccaccgttactccattttattttctttatgtatgtttttgtttgtttgcttgctaattgccttattaggagagagaagagcagactcctagtttgtattattcaccattgaatccccagcactggcacagtgttagtatatatttgcaataaatgaatgagtaaaatgccagtatcctatattttggtcttgctagatatctcactgtttgcctacacactttgcatttttctgtttccaagcctttatatagttcatgctgtttggtgttttgaatttgagaggttaatgcttaagtaatgggaaggtatagatcagagctagattgttcctgaatgtttttgtgggaggatatagggaaagaaccctacagtgaaattctgggaacacaggtctgctttagctcattcgggtagccttgggtgtagccccacttgctgatccttcaaggcctaactccagtactgtatgtgtaataaaacctgttttctcagttagaatgactctcaaagtcttctctggattcctattacctcatgacagctttgaacacattctgtgtatgtaaagttaataaactaggtggtaataaacagtttctgagaaaccaggactctttcacttgcaaatgacagaaactcaagttaagaaacttaaaaaataacagaaactaatttaaaagaggggaattcagtagctcaagaaaatagaaaatcaaggagcagaactggcttcaggcatggctc

SEQ ID NO: 118375 - DNA, 1308 bp, Homo sapiens
tacttgtcctgattggaaaacggttcttgaatacaagtttctaaagctgccttgagatattgagaaggcagtatagcatggtgaataaaaggatgggttttggaattagacttggattcaaaatcaagatctgccatttactaagccatgtgactttgagaagttacttaacattgagcttctgtttcctaacctgtaagaagagtatgctaattcctctcaagtaataaggattaaatgaaatactatatttaatatgtggcatatagtaagcactcaataaatgtagctgttattactttcattattaggagggcataaataaataggtaaaaatatgcattttaaaagtcttagcaggaaaccaagaaattaattttgattttcttaagttgctccattgttcctaatttcctaatcaagccttgacatgacagtcctcagttatttataaacttatttgtttgtagtgccattaacagtatttgttcaatttactcaacatctggctttgcatagtaatcagaaatctcagtctttaaataccattcagagaactccaagtagttttctaaacagatggatttgtgtctatgatatttttttctcctacttgttcaccagagatcagaactctgaaaagatagcactggattccccccaccactcactgtgccccagccttccccagtgattttggttgagaatgcaatagtgaccttagtatttaattatgtctctatgaagctgttttttaaaaaagtggtggtatcagaggggagagaataccatagaaactggttctggttatgatgttggttatcttcattttccatgagcatcctgggctcttgcccctctaccatatgtacctgactccttttttcagaaggagtcttccagcccctctccagagtccctccaaagcactaaaccagtctcttttccatccttacacatttttattctaatgcaataactactttttctactcaattctaaacagtagatgacagtaatcttcaaaatttttttatcacaactctaagcagtgtttcacattcagacataatatgtgggtatttggatgtttataaattatataatctgtaaattcatataaattatatgtgaatataaataatttatatgtaaattatataaattatatgtactaccataataatgtataattaacattctaaaatataccctaaaatagaatttttaatagaatgagataaatctctataaataaaaaagtccattttttttcctgccctccattgaattattttgtgaacctct

SEQ ID NO: 118376 - DNA, 1049 bp, Homo sapiens
agctgaactatgtgcttttttcgtggaataccatttttacttgaaaggataacagtcacagagactattcagaataggataattggtacacattttcctgaaaatgaatgaagtgaaccttttcttcaaggagagcaactaatttatttgtgagtcatgataaaaatttaagtgaaggttgaaactttgtaaaacatatttgctgctgtggtgagcttgacagcttcccagtgcttatagactcttcttatgaaattggtggtgatcatatttgttaaaatatcactttttgatattttaacaaggaaatgtgtcagcatttggaaagtctgcataactcagagaaccaatattttctaaatgtcaaatcaccatgggtaaaagacctaatggattttaatttagtgtacaaaattttatgatatggtttcaggtatactgcaatatggttcattgcaactaatttttaagaaacgaccacttgttgagttttaatgtggtattaaagaatattaataatgatctgaaaaggctattaaaatacttcttccctttccaactatgtatctttgtaaagttggattttcttcatatacttaaagcaacataacagactgaatataaaagtagataagagaatttagctgtcatctgttaaactagatattaaagagattcaaccctgatggcactgttctcactaaactttttcttttttgaaaaatatagttttttaaaataaaaagtaggtttatgttaataagtggtatgggtttactgttttgaatgaattaataaacactttgttttagctttatataaatatttataactttttatatgtatatgtataaaacttacactaaaaaagctctttaatgttctcagaaagttttacaagaacaaggtcctgagaccaacaagtttgagaattaccagattaaatgacctaaactgcaatgctttttagaaatgtctctgattgctttttagaattgtacatctttatttctttctgttcatttatctgttcatcttttacttcactg

SEQ ID NO: 118377 - DNA, 1054 bp, Homo sapiens
ttcttgtatccattcaggtgaaatctatccttaattctctgagtggagaagaattagagactctaaaagttgaattagagcaactcaaagaaacattttctctagcagaattttgtgaagaagaggaagaagagaaaaaaggtaatatgaaaatttagtatctgagtggagaggatgcagtgtgtttgtatgcagtgcattgcccttgaaataaattatttactcttattacactggcttgattttacttttttggtgaaaatttttatgcaaattctctgtgtaaaattctctgcagccttgcacctgactaggcattgatgggggcagttggccttatgcccatgtctccctgcctccttccaaccaaaccctttgtggcttctcaaggtctaatcttgcaactcacatctttgcctatttttgcagttagaaagctgttctcatcagattcttgcctcagtttgactggtcattcatatgagctttcatattcctaggtactttacctctgcctctctgactcttgtaacccctgattctgtcttgaattgaagcatgcaggatggcagttatctaaaatgtgggtgatagtttgtctttttttattttgaaaactcttataccatattttaatatcttcatttctcagaaaatgtaaatgtagatactatgtatatttgcaaaattatcaggaaatgagatgggtcaggaaatgagatggctgacgtaaagtataattgccaggcaactgaatattaagttctaagggttgttttattgacattttagctggaaatatttctaagatatacactaactgaccttttttttttaaaaaagtggaatctaatgaatacagttttgccttttcttcatgaaataatcagttataaacattaaaagtgaatggaaaaattctctcaggtttcattaagacatagggccaatcacccatgtagtaggttaaatcagtgatgaacaaagtgtggtctgtagacccttgaattcccagaaccctttcagggagtctatgagtcagaactctgcatca

SEQ ID NO: 118378 - DNA, 1001 bp, Homo sapiens
atgctaaaccctgtcagggttttttgtttgtttgtttgtttgttttaatgtttaaatcactttcagagaaacacctggttccttgggtgtgatttgcactgtctaggatcaaattatgtggtcaggcacggtggctcacggctgtaataccagcactttgggaggccgaggtaggtgaatcagttgaggtcaggagtacaagatcaacctgaccaacatgatgaaaccccgtctcttctaaaaataccaaaattagctggacgtggtggcgtatgcctataatcccagctacttgggaggctgaaacacgagaatagcttaaacccgagaggcagaggttgcagtgagcagagatcgtgccactgcactccagcctgggtgacagagtgaaactccgtctcaaattatgtgtgatcgtttttctttctgcagctcctgagcccaccagatttgaatagcagtgccaagaatgaaagggcaatcctctgtactctaacctgtctaagctttgcttccttcaattctcagaactcacccttgagctctcattgtttgctacagtgtaatgcctccatctctttttaggttttacgagaggcgaaggagaaagaagagatacggacctccaatgaggttaccgtggaaacagacaagaaaactcattatgggctactctttgatgaatttcaaggcctttcacatctagaagctctggagatgctttcccaagaaagtgaaataaaggtaattccaagccaaaatctcaactggaaaaagtcttcaagtaaaagaatgctgcatggtttcctttctctttgtacatttggaagatgaagtgtatgttttgttagaggcttgagatgccttcgaaatactaccacaaaataaatttaaaaactaatgtttgattgaactaattgctaaaagcagaattagtcaagtattatttctttaaatttaaacaaaaaaggttaacaaagaggtcttaataggacatgtgt

SEQ ID NO: 118379 - DNA, 1055 bp, Homo sapiens
acacatcccctccctcttgtaggagagacaaatgccaaagagaatgaaaactcctccccagtggctggggcatttggtgtattctctaccatctctactgctgttcagagcacagtaagtaaaaaagtgcaaggtggtctgttcctttccattattataatgggtttgcatatctttctctctcttttctttgaacagccatgtggactgattacttttaaaggagtccaagccactgaagatcggtcactttggtcttatgggtggagtgaatgctacttgaaaactttcattaaagcaataaggaagaaagtaggaaataaaggagtagcaataaataagggagtaggagttacagagaggcaatatacgtattattttatggattaggaattcttaatttggtggccctaaaaaatgtctactttacaaaaatatttttctcatagttgcatcttttaggcaaaggggaaatgtgatctttatgacagatatttgcaaaactatgtatgattaaaaacatttgtaagaggattatctaggaagctaaatatctttgctacatgaggatagatagctagttttttttaaattttaactttttattgaaatatacatacagaagaatgtaacaagtgttgtttgaattttcagtgtgaaacacccagagtaagaaacagtattaccgtaatcagatctccccaccatcttgtgtcctctcccagttttctgtgtcttctgctctccccctctcctgcaccaagataaccataatcctgacttccaccatcataggttaattttgcctgcatttcagctttacataagtggaatcatatatagtatctaacttctttcatgcaacattatatttgtataatttacctatgctgcagtttgtgtggtagatttgattttctttgttgtatttcattgtgaagctttgtcacgttttatttattcattccacagttggtgagcattggggtagttttcagtttgtagctattacaagcagagctgttatgaacatttttgtgcatgtcttctgatga

SEQ ID NO: 118380 - DNA, 1069 bp, Homo sapiens
tcctaaatgattttaaaaatcttcaagtttgatttttgtttcttcagttttggtgacaaatagcaaaaaaaaaagttatttttctcattaggacaaggcatttcaaatgtcatcgagaaggcagagacttcccttggaatccctggtcccagtgaaatttcaactgaagtcaagtatgtagcaggtcagtatatggaaacataaagacctagaattatgaattgaaatggaacagttgaactaatttttcagtaggtatttattggacatctgatactcagggcatcgtgggactgtagtgagaaagagtatttagaatctttagttcccaattagacatctatgtcctttaactgcttatgtgtccctttacttcactttccacatctgaaatagaatgatattttatatctcaagtgactgttataaacatttaacaaataaggccatgaatatacaatataaaaattgcttagcattttgcttggcataattgaataagagactaataagagttagctgaatctgagtctgttgtgacatgataaaaatattttaatgtattgttttgggggtgtattccttttgtgttcagatttttatgaagactacgtttaattctagaggctagccttgatcagacagaaacctactctcaaactatgaaggctagaattataaccagaaatcgagagggcctgggaccagaaaataggaatcttttcaaggcctggtttgcattcttcatctctcatgggctttattgtctctcactcttgtttctttttgctgatctgtctcagtttttttcttgaagcagactgactttcgctgcttattttcctcagctccagctttatattgaatcctggcatcagttatttccacttctgaattcctaggtaaaagaatcagtctaaacttgggtcatatgtccatggatcacttatggcctggagacaagtcacatgtataaacatggctgcaaaggactatggatgtgaactggaggcactgttcttagtgatgcctgcatcagttaaactattttagctgcaagtaacagcat

SEQ ID NO: 118381 - DNA, 1273 bp, Homo sapiens
tgggtaaattgtgatacatctatactatggaatactactcagaaataaaaaggaaggaatactaatacaacttaaatggatcttgaggggcttatgctgagtgaaaaaagtcaatgtcaataggtaatatgctgtatgatttcatttatataacatcttgaaatgacagaattacagagatggaggacacctgtccatcagagagatcagtaattgctttgggttggaaggagtgtcggaagtggttatggctaaaaaaggatagcacaagggatccttgtgattgaactgttctgtatcttgattgtggtgatagtcacacaaaggtatacatgcgataaaattttatagaactaaatacaaatgagtgcgtttaaaactgataaagtctgaatgagatcagtggattgcattgatatcagtttcctggttgtgatattatatttgtgtaagttttaccattgggggaaactggatgaaggtatatgggatctctgtattattccttatacttgtatgtgaatctatgataatctcaaactaaaaagtttaaacaaatactttataccaaagaagcctatataaattttttttgggctttcattttaccagctgatgttctaatcatgtcagataaagatgatattgagactccactgctaactgaagcagcccccatccttgaagatggaaactgtgagccagccaagaattctgagtctgttgaccaaggtgccaaaccagagagtaaatcagaacctgtagtttccactcggaaaagaccagagaccaaaccttccagtgaccttgagacttcaaaagttctccctattcaggtatcacagaccacagaaaaagtagggtatctattaaaatattaggattaaaaaatgttggggctaaaagaaatttggcataaataccaatttagaattgctcttatttctttctctttacaaccctaaaatacagtcttttcagttctataaatgcctttatgaataattgcttttgctatgtggtacttacatgctgatagcatatatctgccagtcaagcaatacatttctttagctaaataatatgtatttgttcacccatgcttttggctaataattagataccttgtctgtacattctgattttcctctaattttttcatttttctttgccttttgtttttctgcctactgggaaattaggataatgtttccaaagatgtaccccagaccagatggggttattgggggagctggggcaagtccatactctc

SEQ ID NO: 118382 - DNA, 1646 bp, Homo sapiens
attctctagagtgttctgcctactaaaactcaagataggtgtctttcttatcttcacctctctccatcaatagtttccagagcctgaagctctggaaagttaataagtttgtagcagacacctttcacactaccaagtcgatgagtgtctgaactcaaaattttgagcacttgccacaggcagtggccctgtgctaaggacagaaggtttttagactctatcattcataagcttacagtcttttgaacggataactaactgctaagaggaaaactgataagtcttataatggcgtactcttaatgtgctaggggactgacagagcaaaaaaaaaaaaaactcatctgacaagagggtgggcatgagagggtttcctgaataagatgaaattagagttgaatattatagagagggtacagtttcccccagaaagatattgacgggaaggggcagaaagatttttaagcaaaaggaacaactagtaaggtgaaaagttatttagagagaataaagtaaaacaagcgtagtttaggctttcagccatggcaggaaagctgggtagattataggatttaagcaaagaaacgaatgataatgataatcagcctctaggtgaggaaactaaaaccactggagcacatcatagctaatttgtgatagaggtaaaactaaagaccagacttaatgtttaaatccattcattcctcctgcaagcaattatcgtacatagaggcacctctgggcttctcatgactttctgttctgctgcctgaatctattcttggagaattacaatgccaaattggaattttaagcttatctcatgggcagtgagaaatcaccagtagattgtaaaattaccctgaattgctcagatttgtgtttaggaccaattctgagtgtcacagtgtttggatacatcatagaggtaaaaggagttaaggagatccattctgaaattaaggggatagtgtggtatacccaggtgagataaaaggatatgagttaggacagagacaacaggacttaattgaaaaatgtgtaggaggtggaataataacaatagcatatatttataatttacccacattagttcatcttatcctcaaaactaccctatgatgcagttactgttaatattattttatttaataaatgtgaaaactaaggccttgcaagcctatggcttcacccaggggtaggatcaggcaccttaactctagagcccattctcctaaccactgagccatgattgtcttacaattttgatactgcaaaactggaagaattgtctggctattatctaagctgttcataagctgaacaagtagatctgagggtaagaggagttctgttttaactagactgagtttcaaatagagatgtttcagactatagagggggaaaaatggcctgggaagatcataaatctaagcctgtttcattgatgtttttgtcatttgcatccagtagctattcagcaaatatacctatggcaaaaaggatataagttatgggtataactgaaataatcctgggtttaaagcaaagctctgataaatacagacgatgtttctccaggtgccagaagatatgttgaagtttgagctcagactgaccaaatgctagttatggggtatgtgata

SEQ ID NO: 118383 - DNA, 1732 bp, Homo sapiens
tggaaatgaaagtaaaataactatagtataaaggatcatatgttcaaagcatgcaggcctaatattataggaagtcccaaacatataagtgaattgcattcctagaactgacacatttgtcttttctctgttgcattcacaatataattacatttcagtcacattgtcttagatacagttggctgtttctgggctgtctttcaagctggtttgtaaattcctgagggtctaggacagtgtcctaattctccttagcaactcttgcaccacctactgtacttcatcttccacgatggatccttgacctagctgagctgtagttttaaagtcattagtctagaatgagcagaatggtcatagtcaatgcagtttgtgctgcaagtagcagaaacccattcaagctgacttagcaaaaaggagacttagtgtgaggaaataatagtaccctgataccaaggatgatttgttcttccctcactatttttttctgctttgtcaccttcttggacacgtatctttgccagtgttttctctcacagctgctgaacagcctgttacctgcaaatgggttatatccgttagtctttcaaatcagaagtcctctgtgttcaggatgtacatggtatgagtgaagtgcccagtattaactggatgtgtaaggctattgtgcagcctctttctcttgtggctcaaaatcagtgtgccaggtttcttctgccatgtttggcctaagagcagtttaagggagtttatagtgttttcctaaatcctgtctggtaggtagaggcaaatggctatgtctgtacaacacaagaaccacaaatcttggccacatgggcagtttgcttgccacactccactgtgtaaggaagagactagagatctatgatgaagattgcctggcagccacagacacagttcaataactttttgtgaacttaatcttttttctcctgcctaaccatttccgcatttattacgtgtttgcacattcatcttcacttttgtggttttaattttgagtaaaatttaataaagttgtttctttttttaaaaaaaaaaaagggtcacaggagtgccaggaagtagaattctatcaggcaccaaagcaccatgtatgagtctctctttgtctttctcctgctcctcttcctgtcttcccactctctcccttccccatccctcttgtcctttcttacagcttctccttgtatgtggcccaaacctgactgcctcagcccccacatgcctccttttcctcaaatgaccctgacccacaagggtctcaattccaagttccaagaacaaagattctattagcttactttgccaataggttgtcttcctcctagacccaagaagatagggatagggctcaaagaggggagccgttgggtaagtagatcacgacaaatcttctctaccacaaactgaggacacatacaatgtcatatcatggttgggatccaagctcagtttacaatgcctatatgctccataatattgcaaaatatttgcaatgagaaaaagaaaaatgtgaaattttaaatttaagattaaaactgcataatggtgtccccttccccccaacccccaagatttttaaatggttgcatggtattctgagtgttttataatgatgtaactatcaaatgtaaattttagttcaatatctgaaagaaccatgaacaataataatagagcttattcagtgattaccattgccagactc

SEQ ID NO: 118384 - DNA, 2333 bp, Homo sapiens
aggccgagacaatgtctatggggcagtaggtaggcacatggtaggtgctcaatagatactgttcagtatatgaaaatgtatccctccgatctcaaactcagtggtggggaagagtagaaaggaaggagatggcaggttaagaaatgaggtggcattaaaataaactggagttgtggggggctttttgttttggttttggttttactacagagagagcaagcctccagctcaaagcctttcagcaggcagtagtatctctggaagctaataacacttctttgttttcattatgtttatgtgtacggttacatttgtccacagaactgatgtagagtttcctttttaaataaatgtgaaagtaaaaataaaatgagttgatttaaaagaaaagcagaaatgacgataatttggttcatggatatagtaaaaacaacaacaacaaaaaagacaggagaaggaatgaatgaagtttgggaagtgctgccctggatgaagctataggaactcctaatcaaagttctggagaaagcctggagcattttttcagcacactcatagcctgtcaccgttgagaaccactaatctagaataaagtacaaaattatgtcctccaattgctgtatatcttgcagtgaaaaagagcttggaaacttacatgtcaagcccctagcacagtgcttggctgatggcagtcattcaataaatgttatttccattgtttctacccatcaccccctcttaaaaaagagactgtattccaaactagattctcctactaacttgtagcatgtcgtaagaagcaaatcactgtgcactgaatcaattagattatattacttccaaaatcccctctctgcctaagtctttgtttcctttagtgtcctttttgtgcggttttaggaggaaatggaaataaacacgtttagtgtgtcatgtattgccaaagtctgaaggttttttattttactctgtataccccatccttaaattgtaaagatttagaaaagtatttgtcaccattcaaccatcctttcaagggttaattaatgaaaattaaatgacatttgcaccgtattgtaatttagactttgagatatttaatggcaaaatacagtgattcattgttttttatgttctgtgatcaagcagccttcatataaatataaaggagagtaaatgtcatttccaaaactaattatcttggtgctttataagacataaagctaggcatttcatcccatattttatagaaataaaagttgaattttttctttgagagttggtggcttaaagggggagtcaaattaccaggaaggtgatcataaatacatagacttttggactaggatgttattttgccttttattcaagatattttgctcttcttttaaatgtgtctaacaatctgtccctgtagttttatatttgcatttctactaactagacacttaagatgtcagttcctcccttagctagtttacagagtttgagctagaaatttggtatgcttacaaactattaaatacactgtactttgtctcttcgtattggagaaactattaaaagaaaattctgttgtctaatgttcttgcccatgaaggaggttccatagctttagaagtcaataactctatttatgtgtatgcagtaagtgcagctttctttccagtgttaaaacaacccacctcaggtgtccctgcattatttatatgtaacatatcttcatacttgaattactcaaattttgagctccatggttatgattatgatatgccagttgatttacattataacaacagatggtaatggtgcaggttgaaataaaagatcattaagataaatattttagccttcattggctccctgttgcataaaatttgtcagaatgaaatagaatcatggcatttcagaattggaagagtccttagagattatctcatccagtcccttatttgacagaggagaaaacagaaacccagagagaatgctgcttgccaaggtcgtacagctagttagtggcaaagctaggaccaaaatctaggtctgctatttaccaattcattgctttttctgctgtctctgtgtgagatttttaggtactgttccatctaattactccccaatgtcagcaccaattattctaattaacatctattcattctggaacatacgcactttcaccccattatgaatctcagttggttaaactttgtatctggctttcttttaggttctctactcacatcttttaatcttgaagactagaaaatataactggatctaccacttgtttggaaaatttctctaccaagcaataaattacccgctgtgct

SEQ ID NO: 118385 - DNA, 2490 bp, Homo sapiens
gatgacctgggtgaaagaattaaagagagacctgccttgaatgctcaaggtggcatctatgtcattaacccagagatgggacggagtaattcaccaggaggagattcagatgatggctctctgaatgaacaaggccaggaaatagcagttcaggtttctgtccaccttcagtcagaaaccaaaagtattgatacagagtctcaaggcagcagtcatttcagtccacctgatgatataggatctgcagaatctaactgtaactacaaagatggggcatatgaaaactgtcagctgtaacctacaatgctgtaacccagtacctacaaaatcagctcgctctcagaaaaggaacctgtttcttagaagaagtaacatttttgccaaaagatgactggggttttccgtttgttaatattaagcacatcagaacgtgaattgccaaagtcttcattagaaggcagcatttttcctctctgatacttttcagtcattttccttagagctttattaaattatgcatgctaagatttaaaggagccccagataaacatgatggggaaaagcactgaactaagagtcccatggtttctcttctggtcacagttcttccattggttggatctgatacttatcttgggacttcagtttttccgtcaataagatgagggattaggtgagatctgaagttgtttctagctctatagcttcttaacccatcacctttaaattaccagaatcttcactcatctctaagtaaacctttcccgggacttttactcgcttcttttggaaaggattaagctgagatctaaatttccacaccaatgtcataatgcacagaggtttttgaaaaacatctgagtgtttttcagatgttttgccatgtggagcatataatgatatgtgcaagattgaatcttttcaatgtagcacatgtctgtagggttatacagatgtcagagagctaactgctctgtaaactactttccatgagtaaattggtccttggtgggggtgtatcatatttttaacttactgagatatcattttagttcattgaggttggcagggattgcctaactgatcttccaaagtgagcagtttatttctaaggtataacgtctttgatgcttttagaataagaacagtgtcaaatcatctgtcttctggaaaatcatggattttcatatttctgttaacagaatttctcaggctttccctttttaaaagtattggactctacaaataggttctatatttgggatctcatcctaggagaaaacccaaaactggattcctcttaagacctctgtcaaccctcctgccctttgtggtcttaggtatggtgctataggttgcatgcgtctttatcttgtttgtttggttaatattttgttgttgaggtttttatttttgtttacttcagatacataattctgagctatggctgcttttgtagcctttccaagaagcactaacctgaaataagattagataattgtgagggtgtgttactatattaaaatacacacacaactgatctagacatcaagaggaagaaaaatgatggatgatgccacctgcttcaactgtatataataaacacttatgatgacatttcttgcctggctgagatctgatataatggaattgtaaatactcttcagaacaatttcttcagctacaggaagcgtggtgccatataattttaagaacttggcagtggagctccatttggggcttcacgtttcttcatatgacttctgattattgaagcattacttcagctagaggctcctgagggaaatgttcagaggaggttttatcaggattttaatttaaggtttcaaacaggggaagacaggaaattcaaagcgtgacgggataaaactcatgcctccctttgtccaggcttatcagaagtaatacatctgctctgaatagcatgaatgaatcaatgtgcagttttatcagatggcatcatggataaagatgataatgctgccttttctgtctctcaggctgtttccatggaaacctctagagccaaataaaagctaaccaatcatttagccaaagcttgccttggctcatagactggtatttctttaaggaaaattgtttttatatatttgactataagagcaaaggctcttgaacatatcctagattatggaacactttttcccttcccttttctctggaaaaattaaattttttttctgtccactgagactggagtgcagtggcaagatcatagctcactgcagcctccaactcctggggtcaagcgatcgtcctgcttcagcctcccaagcagctaggactacaggtgtgcaccacctttcctggctaatttttttttattttttgtagagatgggggtctcactttgttgcccaggctgaccttgtacttgtggcttcaaatgatcctcctgccttacctcccaaagtgttgagattacaggcatgagccactgtgcctggc

SEQ ID NO: 118386 - DNA, 1700 bp, Homo sapiens
attatttagaaccctaaggtagacatgtttaaaatcaaagtcctaagaaacagaactttggaaaaatggaggaaatgtttttaaagtctgtaagtttgcacgatactgtatagtaactaaatgcatgctactccgttgtatcctagttattttagaaacagaggtggcctaatttggtggccaaagtaactggtttactttgagtgtaccagcttatggtgccattgatgaggaattaaagtaggtcaaaatttaattggagttggtattacttcgtaaagctagttttcaagaggaagaaaaccacacttactaatgttttctgtatctaatcaaatactcttcatatataattaagcctcatgttatcttttttttaaatcaaccttttgaacttcaactacagtctaaaagtcttgatggtaactatagtgtaattatctttttgtctcactggattttatagttagtggaaaatgcctttacaaaatgtatttaaaatagctgtcatctcatttgtaaattttgtcgtgtattgtgatatagtgaaccttattgtccttatgaaatggtagctttgtgaaatacattcaccaaaaatcaaaatttgaacatctttatgattccttaccagctgaagccagatagacaggtattaattgagctgatgccccacttgagtttatagactgtttgataactgcctgtcctccaaattgtgtatgtatatgttacgatggtttaattcttgagtcagggccagcacgcatttatattttctaccaattaccttgatagaaatatcttagaaattgctgacctggaacggttgtgagaagactcctggcttctttcttgcctcacttaacaaatattttaaggtcaaagcaatatctgtgcacggctttccttttgctcctccagacaagtgaggctgttggtatagtcctcttcaccctctgcatgtagcttcaccctagatcagacttttgtctcttgggtcccagatggcacaggagcactgcatgcttgttttctagagcccagccagtcatgggtgctagcctagtctccacacaccagcaagtagaacccaagtgtattgtataaatatttcctgagtaccagtaagagaatgcattcttttctcatctaggccaggaatgttgaaaatgctcagccttacatagaaactcctagattttcactaacgcatttcacaaaagtaaataagtatttcatataattcagaggatgtttaaattgtcagcattttaataaatacttgcattataattttgtctcttttttaaagaaagtcatacttgaatataatttattaaacgttcaatggagtatatagtctatttgaaattttctatagtgtatgtttcatttgtatgtttgacgaaatttgtatgtttgatggaacttgacgttaatgattttaaatgggtaattttttggggagagggtagtctcactctgtcgcccaggccagagtatgatggcatgatcatggctcactgcagtctcaacctgggctcagcagttctgcctcagcctcctgagtagctaggattataggtgcacgctaacgcacgtggctaattttatgtgtgtgtgtgtgtgtagagatgggtctcgttatgttgcccagactggtttctatctcctgatctcaagtaatcctcctgcct

SEQ ID NO: 118387 - DNA, 1352 bp, Homo sapiens
gatttggcgggcaggaggtttagctctggtagaagcaaaagtctgcagtcccatcagggtgaagagtggtgatggttaacaggcatggaaaagcacaaggtgttaggagaacgcaaaggcaacagatgggaggtgtgactcattacttaaatgccacagactccttagaatgaaaatctagcctttatatccctatggcaaaagattgctggactttaaatcctgatttcacccctagccttgtaaccatggacaagggcttcagcctttctcggcttcagtaaaatagaattgataatgcctacctcacagaattaacacaaggattaaatatagcaaccgataagcaaacactgatagctctgatctaccacactgtaaggggctagtcatgagccggcgtcagctttgttagtagccttgtccaactgatgactatatttgcatttgtggtcaactaaaaattcctccacacctctgagaattgcatttggctgcatgccatagaaacctgatcgtggtggcttatcataatagctaagagatttatttttctcaaatccagagataggcagtccaaggctggtgcaggggcttaagaactggcatcagggactcggctctttctagactgctctctatccttagcatgtggctttcatcctcaaggtcacaagatgtcttagtttgggttcccccagaaggagctcctgagaaacggattcacatgcaaatagtttatttgggaagtgatcccaggaaggtagggaaatggggaagtgagacaggcaaagtaagaaagcctacacaggatgtgttaatgagtgggttactgctgtgggcaaccagtgttcagtcccgctggggacctcagggagctctctctgccccaggtgtatgtagctcatgcctcagttgtcccacctcaaggccaaagagctgggatatttatccaccaactaccatctgtcattagttaaaggctgctcccagggtcactaacccccactttcagactgcattctacaggctcagcatgattctgtagctagcaaaaggcctcgggtagagaaaaggagttttcaacaggaagcctgtggtaaatagaatggtgactgtcaacgaataatgggcagagcactgacagcacctgctacataggacgactgttttacctccagtatcgtgtctgcattccagacagggagaagggtagaaggtcaaaggacaaaggacacagcagctgagtttgtacctttttatcgagaaagtgatagctttcccgaagcctcaaccaacttctgctatgcagcggccagaactaggagacatggctacctgctgtaactaag

SEQ ID NO: 118388 - DNA, 1024 bp, Homo sapiens
tctattaaagtatctactcattttttcctgtgctggaggatctcttccaacaaaaatataaacatgctaattctctcatattaaaacacacaaaaaaacctttcttgattctgttctccaacaccctccctttacagtgaaattttgcaaaagaatttttattctctctgtccccaaatcttctcctcccattctacaaagaggcccttgcccctctcccaaaccctcccatgatgttgtggtcttctgtgacctccaggctgctaattccagtggtcagttctcagtactcatcttacttggccggtcagcagctcgtgactattgacaactccttcattcttaaaacactttttcacttgggttcctggagcatcactcactcctgactctctacctatttccttcctatactggagtgccctgggggattccctggacttctctcttttatctttgcttcctccctaactgatcccatccagccataaggctttaaataccatctctgatggcacataaacttagatatccagcctgaacatttctcctgaacacaccctttcagcatctctatttggatctcaaatagacatctctaacttaacatgtatgaaatcgaactcctgattcccctctctggtgaaacctggtccttctgcagtcttccccaccttagcaaatggaaactgcctccttctagttgcttggagtaaaactctggaagtcatcctgacttttcacttttctctttcaccctgcatccaatccatcagcaaaccttgagagttcgacctttaagataaatctagaatctaaccacttctcttcaccttcactgtttccactgaggtctgagccagccgcatgtctcacctctattatagcaatagcctcccaactatacttcctgcttcttcccttggcccctttagtccattctctatccagaaaccagagtgatcccacccttggctgcacattagaaacacctggagagttttagaaattctaatctccaggc

SEQ ID NO: 118389 - DNA, 1027 bp, Homo sapiens
tccaggtcctctctgcttccctcctcccacccccccccccccacaacccctacctgctgatcccagtgttctttgctcaggtcagcccttttcctgatttctcatctgcccaacgagacacccgggccttcctcctctccccatttattcaacacccccgccccaactctagccttttcctttctcagatcctgtggattccttgcagaatgtaaagatcatgctccctttaaagcttcaagcccctgggggtggagaagggggtaagctcctggtccttgagggacctgctgcctttgaccttatgggagtccagaggtggggctctggtggggggacccccaaaatgtcccagaggctattggtgcccagtgtcctgaggatggaacaccagaagccttccctatctcttctgaacttgtctagtctggttagttgtagtgtttattgcagccaaaactgggatcggaatggtttctgcctcctttgaacttacccacgtatgtttgtgtgtatgtgtgcgtgcacgcatttagactagcagctccctcatagcagaagctctgtcacatcactcccaccctcccaggaggtgctagtgagtgtattgcttagactgtttcatatagtggaacatttcaggctttcttacgggatttctctggtcccatgagaagtggataatttgtgtatcagggtcagacttgactgactgttggctggcctcgacgaaagaggctggcttttctgagattgatggttttccttattcttcccagtatcaggctgctgtctaggcagtctggcatctggagcacagagggctctttgctacagagctgaccaatttgagctccgcctgtaactctgttaattgctgcaaagcatcccagagggtctcattgatctttctggtagagcttactgtttagaaactaaggtttccatctctttcctaaacccctggttcaaaccctgacagctagcttagacctctctccctgaaattctgtatctgtatggattt

SEQ ID NO: 118390 - DNA, 1028 bp, Homo sapiens
caactcccaccctgggacaacccagaccctctgtatccttctagattcagctcatagcctgctgcctccaggaagtgttctttggttactccagcccccaggggtcactcaagggtcttagctcctctgagccttgattttctcatctgcctacttagatcagaggccctctagaagatttctaacatccttcttccctgcagccttgcccctagacctgactaactcctgccagggcagcctaggttagcattcttcccaaccagggcccggagacctgtatataaatctgtcacgcaatgctgtaattgtttttaatctgtccagactgtctgcttcctaaaggcaggaactaacctctctcttggtcactcttgtttgcctaaaatatttgctgaatggctgagggggtgagtgagtaagtgaatcatatggttggtactcagtaactgctggctgcatgctggaagcttagccttaggaatggttcttcttgaacttcagggtgcttcacaatccctagggagcctgttaaggatggtgacaccaggatccatgcccaaagagcatgaaggggctggtttgggcttggccaaggatcacatatttaacaaatcctactgagggtccaacagggaactcctctccacccacctgacaggagacagacctctctttccccagggacccactccattctccccaggagtgcttcaggacccgcccttgaacttctgttcctgggaagtgtgtttatctgcagcttcccaagttgtcaatcagcacccacaggggagctctgtggtacttttagcagtggcactgtatctgatgcaagcagatcaggctccagttcaggacagggatgggaggtgcactttggaatccctctcctgtgggctgcgaggattggctggggcggtagagctttattttcctttgatgcccacagtctgctgctcttccaggatgcgtgctctgccttcctgccatgggcaaggatgaggtaggtgcctctacgtgggtgt

SEQ ID NO: 118391 - DNA, 1119 bp, Homo sapiens
tatccttttgttctgagctcaacaatttatttttgtactgggtccccactaaattgatttgggggattactatgtgatagatacaaaaaacagccgctgccttgagagagctcctagtctaaaaagggacgcagacaagttcacggggatgcagtgcatcaggcagagcatgacgagtgttgcaagaggagatcagccagtgctgcgggaagccaagaggaagggagcagcaccctagttgtaatcaggaaggacttctgaaaggtgctgatttttaagatggtcctgaagaaggttaaaactttagcaaagtgtacatggtgggattggggtctctcagatggcaggaagcggggagcctctttcaagaacagcaaaaggcagagtcactgaaacttcacgtgtctgttagagagtagctggaaaagtgggtgagggccaggtcacagggtccctgattgctaggccagggaggctggcctgcaggaggcaaggaagccatggatagtttttgagcagaggatgacttgatcagggctaggcctcagaaaggtaactacggcaacgcaggagccacaggaggcagggagagcagtttggaggctattggggtggagagattcattcatccactgtgcctttctgtggtccagatgctatgctaggttctgaggccaccaagatgtgtaacgtgcagcctttgagcttaaggaatccattgctactgttgcagactgtttttgccaggcacagtgttaagcactttgcatacattatcatctttgatcctcacagcaacccaataacatactcactctaattatccccattttatggatgaaggcagaaccagcctgggacatgcgcaatatgcgttcaaaaactgctggataaatgacatattgaaggaagaagaactgcagacctaaatgccagctacacagcaggctgagccttccaggtcaggtcctgtgcctggagtgccctggcccctcgagagctgtcctgggagcacctctgccttatctggtctggttgcagggaggttgcaggttcatcagggagatgaaatgtttcactcaaggtcacacagctggtcactggtagggctgtgactgg

SEQ ID NO: 118392 - DNA, 1008 bp, Homo sapiens
gtcctgacctggaaggctcagcctgctgtgtagctggcatttaggtctgcagttcttcattcaatatgtcatttatccagcagtttttgactgaacactgcacatgccccaggctggttctctgctaagcacttgacattctaagagaaaaggacatggtctcggcccttgaggaccaggtggcccattagacagataattccagggcagtgggatgcatgccataggtggagtgagcacaggcctgagagcacagtgaaggattcacgttagccttcacgctggcttcctggccgccacctctacctgcccctcccactcacctcaggcttataaagccatggatttgcctaggattgaatcccagctctgccctttactagctgtgtgacttcgagaaatttccttaatcttttattttctctctctcatttcttacattttaaaatgagcctgataatagtacctacttcacaagttagttatcaggattaaaggaattcacatacacaaaacacttggaatagtgcccggcatttaaaaagtggtacatagatacccttaggattacaggtctggaatctcttagcccaaaccctgtgtattaggcatattttagcatttagaattattagtcaaggttcagtcaggacagagaaaccacacagtgatttgaacacaggaagtttaatataaagaattatttactgtaacaggagattagagcgatgaaaattggctattaagaagtgaaaagcactctaaagaatataggaatggcagatagaggaacagctcctacccccagtgttgagttaacagcacccaaggaagaggcccccgtaagctgagatcctgactttgttggagagggcacagctatgcttactgagtggtagagagtcactagagtgccaccccagcaaagttcacaggaaatctgcctgctagggtgctggaggaagaaacacatggtgaggtatctcatggaagacattctgctacaaa

SEQ ID NO: 118393 - DNA, 1706 bp, Homo sapiens
gactttggaattgaggctaagggatggttgacctgcatcattttcatttcctctctccatgcagcagtcagagttatcttttggaaatgtaaattatgccactgggaaagcctaagtggcttcctgttccaggataaagactaaactccacccctggccccctacccacactgtgccctcacccacctctgccctccaacgactctgatctccaacaagccatgtgtccttctgcaacagagccttggcacatgtcactctcattacatggagcactcttccagttacctaccgtgcacacaagtgcatgcacacaggcacacatgcacttgcatgcacacacacatgcatacacacacacacacacacacacacacacagttttgcttggctaattctgcctcacccttctaatggcagctcaggtgtccctattccaagagaactttctgacccccttctaccccaaccctcagcccactcaggcattaaagcatatgtgttagtttgtgattatacagacttacaataagtgtgattatttgattaacatgtctctctattaaactgtaagtgttataggacagtggctgtatccgttttccccccaactattttattcccagtgctctacgcagtgcctggcatgtgacatatttgatgagtgaaaaaaggaataaaccatcttggattagatcctgaaccagaaaaaaataaattagacataaaggacattattggaacaactggcaaaatttgaatatgaactgtagattagataatagtattttatcagtgtgaagtttcttgattttgttgtctgtattcttagaaaatgcacactgaagaatttaggaataaagggttatcatgtcttcaactttctcacaaatggcttagaaaaaaattgtagatacaggtagatgggggagagggagagagagtgataaaacagatgtggagaatgataacagccaatgtggataaaggatatacaggatcctctgtaccagccttgcatctttcctattagtttgaaattattttacaataaaaagttttttaaaaaatgaataaaaatgaataaatgaggaaagggatgccaggaggaggaggacccctcaggtataaaggcaggagggcaggaaagggcttggtccctttggggaacttgcaggtaggctgtgtggttggagggtggccctggggctggggagggaagagcaggggatggagctggagcccccactatggactctctggagggagtgcagtattgaactgttcagtcaacgttcatctacactttcccctctctttttcccttggtgatttttgaccaaaagtctgattgcatgaagccagtgtgtctcaggtcttccatctgatttctcttttgtcttaacaatagagaaaatctcatccgtgtatgcaggttactccttctgctgtgaaactgtgactttcctgttgtctgcttgctgttaaactcaccatgcatttcccgttttggttatatagtgctgcataacaaaatgtggtagcgtaacacaacaaacatttgttatcttaaagtttctgtgggtcagaaatttgggcttagctgggtggtggtggtacagtgtctctcgtgaggtcgctatcaagatgttggccagtcctgcaggcatctaaagtctcaaccggagccggttaatctacttcca

SEQ ID NO: 118394 - DNA, 1071 bp, Homo sapiens
gatgtcctgagctatggtggtggccaatgtcagattcaccatgaagcttcagagtcccttccttccaaggctctgggaggggccctagcaatgtgtttcatggtcatcagttctcttaacatttgcaaaagagcatttaactatgatcagttacaaccactgtctctcttctctctaacttcccctcctctctggtggtggagtggccacaggcatttttaagattctgtggtgggaaagttgagttgggatacatctaacggcacttataaaatgcattatgtgcatgctttaatttcatattcttcttaaagagcctctcctcatccccacctgccaaagcatcaacatcagatcccacaaaaccagacctgcccatggtggtggctttgatttttcctacccagggtcttagtggcaggcagtggtgacagaaaccagcaactttgctccaggtgaagaacaggctcataggctaaaagagctgtctgcagacaccaaaagggctggcatggagactactaagcatatttatctattcctggtacataaattgggtacaaaattgatagcatttcctctgtgccaggcactgttctaagcacatcattacatagtaactctaatcctcagaaacaagtttatgaaatagatatgattaccttcatttaacacgtgaaggaagtaaggtaccatgaggtcaagtaacttgatagtgggattcaaacccattgagtctggtgtcaggatcaggtcctgtgggcatgtgaccagtgcatatgcacagggccctgcactgagagaggccctgcatatacgggattggtcctgatcagggcctgtgcttcttatctctcactacattattctgacagtaggcagaatatggcacaagctgccccaataagtattgagttccccagcctgggagatgttcaagatgagactggacaacacttgagcaggaatactttcgaggaggcctaagtaccagataggaggagagtggactagacaccctttagcatctgagatctgctgagccttgagagtctaggattctgggacttt

SEQ ID NO: 118395 - DNA, 1108 bp, Homo sapiens
agtaactcttaatgttgtgaccctgagccagttatttaatcactttgatcctcaatttctacctctgcaaaggaggcatgagaggattaatgttagtactcaacttgaaaaatttttgtctagctattcccgttaataacacaagttggatagtgctttggggttttcaaagagctgttcacatatgtaatctcaccggttgtcttaatggcaagaagtcatattgccctcattttactgataaaggaactgaggctaaagacttaggaggaagcaaagccagacctggaaatccataattttagaatagggatcctttgtattttctaaaagtttgcccttttgttcattgtgccaagttcccacaatttgatgtttacatagttcccagaccactcttgtgcacaatgatgttttgcttaggtctggggagcccttgatgtgccccatcttaggtctgcttggactgggagggagactagcagagggagtcaaaacctgagctctaaagttagatcccttgtgttcacagttccaatctgtcactccccagctgtgtcaccagaacaaatggcttaacctcctggaacctgaattttctcatgtgcaaaataaggacaacagtggtacctaccacatggaactattgcaggaattccgtgagataatccatgtaaaatgcccagctcagtgcctgacccaatgcatcttagctgtcattgttactgttaatgtaactattagcacattcacactaaatgtatccatctttaaatgagctactttccatattttggtcattgcacattaaacacatttttaatcaacttgttttaggcttaaattgtaggctcctctggtcttctttttagcatctgttagaagtatttttaaaagctctgcctgaattcatggggagcccctgtaaacccacttgaaagcagatttcatcactaaaaacccacaaaacacctcagtgtgagtggaggaatcaggatgtaatttatggcgtccacttcttgctgccatttggcattttgcaaactgccattgccattagctgtcacttttgagtatttatgatcttgcggttggagcactttgattc

SEQ ID NO: 118396 - DNA, 1207 bp, Homo sapiens
gatacttaaggacatggatcatttctgatagttttctgtgtcctgggttaagagggtgaactttcctagcagacaagatggatgtgtactcaacacctaataaatgctattaattgattgaaaacaaccattatattttgtggctggggaagttgggaaaaatcatgcaagtgtagctgaaagtattttattgagtaatcttgagcgttgataagagtccagttccttggataaggaaagagaaattcaaggccaggtacacaaaaccaatgagaaggtgctatttcactgtggtatggagcagagttagacctggggttgaggccctctcagacgcttcctggctgtgtgacctgggcaaaatatagcagagcctcaagtgtcctcatttgtaatttgaaggaaaaaatacctgccttgcaaaattgtggagatcaaataaggtaatgttcagaatgcatttagtacagctttccagtgaggagtagagcttaaatgctcagtaaatggctggaggtgttgctttgagggggcctcttgctcagatttggagccccacggtgttctgcctgatagatggtctatttcagattcctgtcattctcgcttttgactgaggtttttctggaaatgtccatggaaagaatgtgctattgccagttagacgaggccttctggagaggccctaccccagcccattcctaaggagtatgggtttggtgtttggcagttccttagaattctgggccccagctgaggggcagagctgtgggattagccagttcagagtcactgaaatgtggaaaggggcagagaggggtggggtatagaggacaacagcaacataatctcattatagaaagttcacgaaatgcagataagtgcaaacaaaagaaatttcccagtaattgtgaccatccagagataaccatagttgcattgcatatatctgttcacatttttagcatgcaatttatatatttttaaggagataatagagaggtttgtgttaacaaggtttttttttttacatgtatcaaaacatcacattgtactccataaatacatataattattgtgtcaactaaaaattaaaaccaagctttttttcacttaatatattgtgaataggaattattttgttaatagagttgtgcctcatcatttaaaaataccagatattattcctctttgggagatgaattct

SEQ ID NO: 118397 - DNA, 1107 bp, Homo sapiens
ttggagttaattggatcccatgcctttgtatggtctttcatacagtgagttcatgctggataatcacaacattccttccaaaagcatgaagatgacccaaactatttagagaagacaggaagagaaacacgtttttatattaaaataaagttaaaataaaacatccaaatcatggcgtggtaagtacgatttgcaatatgggatgaatatttaaggtgaagcaaagtagctgtggctacttggggccaaaagcttcccagatgctcctgctctaagcacatgatgttttttggggaaagtggtagcaggtagagggtggcagaaagtgtgagaagcacttgttgtaggtgacccagacatgcctcttgaattgaattcggtgatctgcttcttcagctgctttcttgtccctgcccagcaggatgccaggaaacacatagccctgtagaaaatcactggagaagaggatgattggagttcttcatttcttaaaaaacagtttaggttttccctgtctgccctagggcccatgtcttgctggaaaatatgctacttagaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactctaagacactaggtttagtcagccaaaagcatgtgattttcccagatttcccaaactccttgtacctaattgaaagtacacaatgaacttgcaagaatttaagcatccttagatgccagtcttcactttgggtattttcctgcctcctcagtgaaacttgacacctctagtttgtcattaaaaaaagaaaaagtctcaagaaaaagaaggttgtagaaactgattaacaggatatcccctttttcctttcccctgaagattatcttgggaatgtcaaaagcaaattttataggcagcttggtcttttacaagagatatgtttacaaagcatgaaattaacatttttgcacagagccaaataattgcttataacatagtgactttagaagcaggtttgcagcttgagca

SEQ ID NO: 118398 - DNA, 1050 bp, Homo sapiens
tctcccactccccatctccctaaaaaaaagaatgtaaaataccttaatcagtgtattacattgattgcatgttgaagtggtaatagtttaggtagagtacattattaaaacaacttcacctacttttttaaatgtggatactggaaaatttcaggttacacatgtggctcacgttatatttctgttgggtagcaccacactgcacactttctcccttgggtgaaaagagtgtgttcatcttttttctccaccaccgatttgtgagttcctgaaaggtagacgctgcattcttgacatcttgctgacctttgcaaacctagctggcacatggcaaggcaccaacaaaggtatgctgagggagtggataaaggaacccaggatgacaggcatttggtcaatacaaagctcccttaggcagtgtaactcctgggcctgtgttactgatttgcccttttctatttttcatagtttttgtctttttttaagggctcacacagtcgacaaaagaaaacgtttttcttgggagatgggcagaagctgaaggactggcatgacaaggaggccatccggagggacgctcagcgcgtaggtacggagggcaggattggccatgggtgggctctgtgaagggcatatgcacatatgcttgtgtgtgtgtgtgtgtgtgtgtgtgtgtgtgttcatgtgtgtgtttagcaggggtgtctggacctcctgttggctccctccctgtcagccaccatcccttcccctgattcccagatgcccctcttcaccagttagctgacccctttctccactgccatcaccagatctgctgcctgcaagaatttgcctgccacctttattgggtgatagaaaatgtctccctcataaaggatattttgtattttatttttataggatagaaatgtctctcccttatgagattacaactaaaacaaggagcagtaataagagccagcatttattgaacacctatggtgaggaagatcgatgctctgtacttggaaatttcctctgtgaaacctcagatcaacctttatggcc

SEQ ID NO: 118399 - DNA, 1036 bp, Homo sapiens
caagggaggctgggcagcatccggcttgtgagctcaggaggaaaaccaacaggtgtatgaacagctagtcagtcagtcacttcctcactttctcattgctggtattgttgctgtggtttgactggccacatgtctccagtgctgtctggcttattacctccatgttttgtaggacaagaccctgtaccaccctgtcagtggcagctgcatggactgcagtgaaagtgaccataggatcttcatgaacacctgcaacccatcctctctcacccagcagtggctgtttgaacacaccaactcaacagtcttggaaaaattcaataggaactgagccctcatgtccccttggcaggccccccagggtctggcactcactgcagacttcctctttcaagggaggcagggcccctgtgggcactaggtgtaaaaggtgctggccaaatggttcagggtgaagagggctcttgattcaggggctggggtctgcctggtccttgagcccctgagttgtgggggtagggtgaagagcatatcccacaagaggccccacagggagcagagactgctttaatccctgctgacatcacggaaaagcaacagagccttttcaactttgtcactatgtccccttgaacattatgtgggagaacaccaaggtagcctaggccacccaaaagtgagtcctgcgaggttgcccagccctcagatggctctcctacatgatggtgctttagaaacaaaggtaaaatttgcctgtttggggcagcttttagtatcgatgccactcatctgcagcagaagagaaagaagtcctcttggggctttttagtttctgccgtcctggggggaacattgcagttactgcacagcttctgttctctgtcacaaccccaggtgatttggtccggtcaaaggccatacttggggccctaagagtgttcagtattgaatgctgatcagctgccaggtgaggagtcagaagagggagcccccctagacatttctttgcagctatggacatgcgggatatctcccc

SEQ ID NO: 118400 - DNA, 1056 bp, Homo sapiens
catgctacgacacctggctaattttttggtagagatgagttctccactgtgttgcctaggctggtctcgaactcctggcctcaactaatcctcccaccttaacctcccaaagcattgggattataggtgtgagccaccacgcctgccccacaattttttaaagacacatttcttcccactttcaaggcctgagaggtttggtagcagctggccaaccagagcagtcccagtctctcctccatgagtatgactgtgaaatcatgccatgacaggtggttggctgccactgaaatagaactgcaccttggaagagttgtaggttaaaaagccacttttggatcctggaaattaaaccacctacatccctggggaggaagggcaaagggcactctgagttccgcacatggcaggaagttcttcagcatttgtcattcccgccacagcatgcaaacaactccattcgcttctttgtacaatgtagaatttgcggtgtgatttgtgcatggtttaaggaactttggtattttccccccacatagactgtgagtcgacacttcaggaacatacctgtgaatgaaaaagagacccttgcctacttcatctacatggtgaagagtaacaagagtagactggaccagaaatcggagggtggcaagcagcttgagtgaggatgaagcacatcttaaaggaatgaagtgtaatgcttgatgcacaggtgatatctactacatttaagcccataaagactgttaaatattattgtaaataaaaaagtttgaatgatgaatactgtaaatctttttggtcaggaggattatattctcatgattcagcatgtgtatagaaagactttcttttacgataactctggactaaaaaaatcaggatcattaaaagaattaaaaactatgtatttcagcattcaacaaagcattaaatcaattctactggaaatgtgggataagaaatattttggtaatcaccttatccaccaggctgccacgtgtgagctgtagcttggaatagcagcaaggtgcaattggccatggaagtgca

SEQ ID NO: 118401 - DNA, 1454 bp, Homo sapiens
actcaaaagggtataatcatccccgggagagagcactccttttaaatggggctactcatcctggcttggctaatggtgaacctaccttgtgggttttaaatcaaccgtgacatcaggtggtattgggtgcctgagctggcattttgtgtaagtccaggagcccttgatagtgtgcgtcactggggttattgatcgtgggaagaagacagcttggctggcatctcaccttttcctctgagtggagaagctgacttgctttaagtgcccaaagcaaaattctgagtaagggtagatttgctctgttattgttttttggaatcttaaggcaagagagtgtctacttgttggtttagaacctttggaataggttttgacagcctaactcaagttaatccagtagcttctctctctaagcctgttgttagggtttgtgtgcattttgagagagaattctatgattgggttgtcagtctggtaaggctagatgatgaccctttctctggagcctacgtggatctctgaagtgcttttccagccctggttttatttacagcttcgacaaatttaaacgtgacactagtggagtggctgtgtggtcttgggaatttttgtgttctgtgatgcacatgtttttgggagtctacagaaatgagtacctcataagcaaactaaaagctttccaaagcttgctgtaaatgcctatttttagccttacttttggctcaaatgttggtgttttagttctttaagggacacatgcagtaactagtaataaaatatgtttcgtgatatctctactttcttgtggggttctgtattctggtttaagcgtccaagtcttacatttgtagttttaagtcttgggatttgcattttggttttttagatctccctccctccccagagtatttttaaatgtttaaaatttttgtcttatcctagccataccccttttaagtataagatccaagacgtctaagttaagagatgatacatagcgaatattctggggtcaaactgagtgggttcaaatgccactgtaccacttgttagctgtgcttccttgggcaagttatttaaccattctatgcctcaccttcttaatttgtgtaataggtatttatgattcacctgcctcatgggggtattaccagcattcattgttatgataagtgtatttagcccagtgcctggcaggtagacattgttacttactctgggtcttggtgggacttttccctgggtctctggttttctctacctgtaatatgatggggttggtgaatgcagatctttccttttcttgtgttatataagtactccgtgaaatgtatgggatctgtctccttaaaacttgacttttgcttatccacagacatgaagggcatggatggataatttaaaggttgctgactcttaagaattagctattttttgctttggaatgtggtgag

SEQ ID NO: 118402 - DNA, 1189 bp, Homo sapiens
aatcccagcactttgggaggccgaggcgggagggtcagttgaagtcaggagtttgagaccagcctagccaacatggtgaaacccagtctctaccaaaaatacaaaaagtagctgggcgtcatcgtgcacacctgtaatcccagctacttgggaagctgaggcacaagaatcgcttgaacctgggaggcagaggttgcagtgagccgagatcatgccactgctctccagcctgggcaacagagcaagactccatcacaaaaaaaaaaaaaaagaaacaacaaaaaaaacctatgtccagatctaaatgcttgtaccgcctcgtctcttgctggcctggaccatacatcatcatttctcatgtagatttttgcagcagcctcttaactggtctcctatcactcctacttaaagccctctggtaacttcttagcagagtaaaattcagagtccttagagtgttctctaagaccgcacttgatctggtctctgtccacctaacctctgacctcatctttcatcacttgccccttcttcactcattcccttccagcatcagtcctcacttcctgaaacatgtcatgtactctttgctttgggtcttatgttctgtagtgctcttcccgcagatcactgtggtggaaatgccttcccagaccaccctatatagactagcaagtcctgaccttggattccctctctccatccctcttaccctgcttcatttttcttcttagttctccccactgccccccgccgccccaaggcagggtctgagtctgtcatccagcctgcagtgcagcagtgcaatcacggctcactgcagactcaacctcccaggctcaagtgatccttccacctcagcctccagagtagtagctgagactacaggcacacgtcaccacgcctggccagttttttaattttttgtaggaatggggtctcactatgttgcccaggctggtcttaaactcctaggctcaagcagtcctcccacctcggtttcccaaagtgccaggattacaagcatgagccacggcacctggctatttttcttcttagctcttatcaccactgggtcagggacttcgatacctgattacgtttgtattcccagtacctgcagcagtgcctggcacaatgtaataggcagcttggtgaacatttagtgaaagaatgaattgcgtatttt

SEQ ID NO: 118403 - DNA, 1268 bp, Homo sapiens
caagttcaggagatcgagaccatcctggctaacacggtgaaaccccgtctctattaaaaatacaaaaattagctgggcgtggtggtgggcgcctgtagtcccagctactcgggaggctgaggcaggagaatggcgtgaacccaggagttagagcttgcagtgagccgagatcgcgctgctgcactctagcctgggccacagagcgagactccgtctaaaaaaaaaaaaaaaaaaagtgcagctctgatttaaaaatattaaatatggtattgtggttttgggtacccctgtcagtttaacagttgaaactcattaggttacatcaaaataactgttaagtatgtacagagaaaacctaccttagaattacctagcagattcctgactccaccattgctgagcaaaaaatctctgaaggatgggacccaggaatctacgttttgacaagctcctcacatgataattcgaatgcatgccaaaaatcttaatagcttatcctggaaagccggctgcatttatggagatcaatgggtataaggacaaaatcacaagatgttagaactggaaggactgtggatgataggattctgcccacccctaccacaggcctctgaatagagagactgaagacactggagggtagttcttgccaagcatccatagcaagagctctggtgtctgcgccaggactgtcaaccagtctcttgacttctagcccagggctctggtcactcttccactttcagtttggaacatggggcaatagtctttcctaactatggtgtccagttctaacaaactaaaaatacaggggacacccagttaaatttgaattttagataaatcaaatatttagtataagtatgtcccagtattgcatgggacatatttagtctataaaattactgtttatctgaaatttagatttaacagagtgtcctgaattgctatttgctaaatctggcaaccatattctctccccgcttaccccacctttttttgggcaccagtcaggttcaagaattgccccaaagaaatgaaaaataattaccatgcatttatggtactattacttcatttaatctgttaatcctgtgagctagctgtcatggaccccattaatagttcaggaaagtgagaggttaagtctgactcctgggatcatctcggtaagctgtcattttgcctcctcatgaacctagttgcttggctctcattgatgtgtggcccagttaatgcctatcaagttacaagctacatgagagatt

SEQ ID NO: 118404 - DNA, 1083 bp, Homo sapiens
gatcttaaattgtagactgagttagaacttgatccagagttgctggttttgtggcactttacattgggcagtcaggaagcctcctgaggagaatttatattgagatctatgactagatctgaggagtcagtcatcttgctcttcaacattgtgaccttgggcgagtcccttccttcagtttcattttctggacaactggaataattgtgtctttttgagataattaagtaaaatcatacacagcaacttaggtcagtttttggtacctagtctttatgcagtaaaaggtgattattattactgttctaactagaaccaaatgtgctctttagaaaaggctgggttagggagctggcacttggaggccaggagctttagtggccgctgatatatttcagctgtgttgattattgatcagctttgaagcaagatttcagggactggtaccagcagtgggagtggccacagccacccgagggtggctgggtccacatctgggcggggagagtgggagcactgggccacctgggtcaccacaggctaaagatagtcagctggggctgggcctgggctgggccaggctggccagcatcatgtgactggagcctggcccacccttgctcctcctcccgggccaaggggatgcagactctgcattcctgagctgactggtggtctgcagcttcctttcagtgggaactcaagatgatctgacctgaacatttctctccttccctttctctgcccactcctctccctaagaatgcccttccagcccctcctgcatttcatccgcaggtctagggaaatttgggtgggaggactgggcagagaggcctctgagagatggtaccgacagcagcagctggtgaccaaggtgaggagggctaacatggcattctctttactccatagaagaatgttcctgcttagggggtcctggggtcagtcagtatgggaggaaaggcctgtgggtctccaggctcccctctatgactccaccccatccccaggatgaatgacagctgaaagtagccaggcttttcagttaatctgtccccaggctggcctgggagggacagg

SEQ ID NO: 118405 - DNA, 1024 bp, Homo sapiens
ctcacacaggactaatttaagaatattcatgtgtatgctcagactgtttgtattctcatcagcttgggattggtggcagactagggaatcagtgaggtcttttcatggcactttgattggagactgagctttcaatactttaccatctccttttgtgatcaaacaatgatctgactttgcctcacctttttaaggaaaagtcttcaggaataccttgccctctacctgatttctctttataacatcctgttagtgaagttggcgttggtggtacacaggccctttggcctgctctcctggtagcttgcacacagtgttgctgggtactgggagaagtgattaccagccatagtgtaggtatatatgaacctggtcctggtttgacacagaagaagattttgtcaggggactagatggtattaggctcatccaggctaacccaggagtcccaggagtatgggtgcagaatggccccttgggcctaagaactctatcctcttgggattgagattttctggttcaccattgccctgcactgggggtgtgggatgctgttggctgggttccacagctccagctctcaaaggcatgtggggtatcttgagggggtagtggctccggtagggggtggaagccaggagagcagtggcctcacagtgaggagtcaggcaaggacactctctactcattaagggaacatgggtctgatcaaggagttagaacattcctttccaagccagccgggcaaatttctctgctgctcggggtttgggggcagctctcgccctggcatggctggccaacagtacaggcaaagtgataggggagaagtcggtgagcagagccacaggatgtatcttttcctgtgggtttctgggggaggaaggggcacagaaattcttgtttttcagaatggtgttgggaaaagaagtgtggatgtagaagggactggacctactagaacaacttccttaaaaaaaaaaaaaattaagacatttgtttttgataaaagcccatgtctgtc

SEQ ID NO: 118406 - DNA, 1634 bp, Homo sapiens
gcgccactgcactccagcctgggtgacagagcgagactctgtctcaaaacaaacttttttttttttttttttttgagacagtcttgctccgtcgcccaggctggagtgcaatgacgttatctcggctcactgcaacccccgcctcccgggttcaagtgattctcctgcctcagcctcccaagtagctgggattacgggcgcccaccaccacgcccagctaatttgttgtatttttaatagagacagggtttcgccatgttggccaggctggtctcaaactcctgacctcgggtgatccacctgccttggccccccaaagtgctgggattacaggcgtgagccactgcgcctggccacaaacaaagttttcatttattgtgtccgtcattttatattagtagagatcattatctttttcataacttttctaaaaatggatgaactttagtcagtcccctattttggggtatatagtttgttttccattttttgaagttataaataatattttagtaggacatctctgtacataactcttgtctaatttgtatcattaggataaattcttagaggtaggactgttgagtcaagtgggagcccactttttctttggaagctgagaaggcagacaaaaatgtttcctgagcagctggccctggtgtggtccctagattttttgatggctcacttagagtttttactttgccttcccaatgatcactagtcctggtctgctcacatcaaacttctagaatgttagggccagaaatgatctatcagacatctgccatgattcaggagccctgagctatagtcctgactctggtggcatggacttctttctccaggcctcagtctctgttacggaactgtactctctgagggcctcccacctgagtctggacttcttgggttttggctgctggctgctggctcctggctctttgcatgatcgcgctttctgtgacttcttcaggagtgggctggtaaaattgttattggtgtttgagcacgtgtctttcccctctctactgtgtctttctcctttgggaacttgcaggttgctaggtggagtggggacggtgatgagggtgaggagctggcagtagccccctcacatgggctttgcattactaactctcccttcttgttcccacagaacactctgctccagccaaggtggtgagggcagctgttcctaaacagcgcaaaggcagcaaggtaaagaataacagtgggcaacccaaggggactttctggagttggtggcctctttcctgttttagtgaatgctcctggactgccaactagttctggattgtctgtgaattgcaggggagccccttctaggtatccagtgtgaatggtcctggtgaacagactgatttggcctctgatctcttggtgaagcttgggtcgggggctgaatagcaaagacagggtcactcctggggccctcatagtgtatgttccctgcaggttggtgactttggagatgcaatcaattggcccacacctggagagatagcccacaagagtgttcaggtgagtctgtgtggaagaataggcaggtttgaagtctcttgacatacacacatttagctcctcaagcttccagagagcctcagctctta

SEQ ID NO: 118407 - DNA, 9360 bp, Homo sapiens
tctgggacctctgtgcataccagaatctttgcatactcaagtcctgtagttggccctgcaggacctacatatatgaaaagttggccttccgtgtatgcaggtttcacatcctgctaatactgtatttttgttctgcattcggttttttaaagtcctgtgtataagtggacccacacagttcaaagccattttattcaagggtcagctgaattgcctgttcatcatctcatctaaccctcacagtgactctgagataggtccttttataatccccattttacagatgaagctgctgagacttgcagaggttaattactagcccttgatggccaagtggggattggaagtcaggtgtgttgtattattccccagcctgtgttctccatcactacgcttgggttttctgagtgaagtaggagagtggtcattaggccaagcaccgacctccagaccacatgtcttggggaagcttataaaattctcttggggcctagcaaagagaggactcctagtcagttctcttcttcccagcacttttgttctggccagtggcttagagtctttactcactggctgtggccgcttttacttcacagacagagttgttgttgataggccagggggcatctcttccttcccacagactacctagacaacatggccctgttgcagggaataattttgcccctgtgagcctcagcaccgctgtcctgaaggttgtctctgtcacttagacttggaagctggagagataagttgccttcccaccttctggcctatttgaccatgcttcccactgaaaccatctcaggtgtgaaaatgaccttagaatacatcccatccagcctgccattgcatgctgtggctcctgcctgcccttctagtgacagggagtgccttccctcctataccatgaggcactcacactcacctcactgttactttacttcctgctatagccacagtcccacaagcctcagcctacccgtaaactgccacccaagaaggacatgaaggaacaggagaaaggagaagggagtgatagtaaggagagtccaaaaaccaaatcagatgaatcaggggaggaaaagaatggagatgaggattgccagcgaggcgggcagaagaagaaaggtgagtgactgggagcaggacttgggagaaggtggcagggtagaactgtgaaatgtcaggactccaggggactgctggaggagctttaggtgccacctctgaaaagtcaatggggaaactgatggatgtaggctggtgagatagcagtcttcaaccatctgtcattaatcagtccctcctttcaaaaaacctgctgaaattttggcttctctaatgctgatctagagtaaccatggtttaaacaagataaaactttctttctttgatgtaacagcttggtgtaaatacaccaggcctggtatggcaactcctgaatcccttcagcttgctgtggtacaccggttcttcatatcatcactgatggcttcctatttccttcttcttctagctaggaggaaaggaagagggaagggtggcccctttccttttagggactcaacctggagttggttacttcagcttagctctcgtaggcagtgttttggcacctgtctatagggactctggaaagcatggtcttcatcctgggctgccatgtgtctgactccagaaggggattctgtggccatggagacactgatcttgggagttaacgaggagtctctaacacactgacggccactgaccagcttattttagagatgaaaaagagggctaatgtgtgggaaagggatctgcccaaggtaaccagattgtgatttgggcccaagtccagggcagaagaagaggagttgggtagagctggctaggagtggcctctccctcaagcctttctcatgtacccatgctgtctcccaggaaacaaacacaagtgggttccattacaaatagacatgaagcctgaagtgcccagagagaaactggcttcacgccccactcgcccaccggagcctagacacatacctgccaatcgcggagagatcaaaggtatgcactacccactatggagggcctggacttgggagacaccctcaggcctgacctggtacccctctccccatagggtctgagtctgccacctacgtgcccgtggccccccccaccccagcctggcaaccagagatcaaaccggagcctgcctggcacgaccaggatgagacatcgagtgtgaagagtgatggggctggtggggcgcgggcttccttccgtggccgtggacgggggcgtggtcgcggccggggacgcggccggggtggcactcgaagtacgtgaggcccctttgggctccgggatgtccaagggtgtgcagcaggggtggtgggcaggaatctcctctccctcatggcacccgtttcccccatagcccattttgactaccagtttggctaccgaaagtttgatggtgtggaggggcctcgtacgcccaagtacatgaacaacatcacctactactttgacaatgtcagcagcaccgagctttacagtgtggatcaggaactgctcaaagactacatcaagcgccagatgtgagtgtgcggaagccttcttaccctggagaaatgagtgagaggttaggggttgctagagtgtcatagctgggcaggcccttctggtgcttagcagcagtttcagcctcaggctgaaaagatagcttttctcattgtttattaaagaagtgataccacattctcattgtttattacagaagtggtacaacatttaccttaagaaagttagaaactataccattacaaaaaggaaggaaaatatttagaatctacccccttctgttcttccatttgtaatgacaacattgacagaatactaacatttattgaatccttagtatcggccaggctcagtgtttattgttgtagaggcattatcttagtcctgcagttcttatctgttgaattcctatgagctgagtcttttagccccagtttatagacaagcaaaccggcccagtaatttgcacagaatctcacagctagtaagtaacaaagcacagatttaaatccttttctgtcctattatagaacctttgttcttaaccactctgatatattgtctctcagtccagtaaggaagtcatacaagaaaataaatggttgcaatagagtgtttataagtgttttaggagcagaagagaaagtgaccaacaatatttggactggaatttaaaggaggatgaggagtttgacaggcatgtcgaggggcttagggcagagggagtgatttgacccaagcaaggtagggtgtcatgaagggatcacatcatttcttttcagccctcaacactgttggtatataggataaggatggggtaggtcagaggctgtgtgagattgctggggtgtgtagcagaacaaggaaggcatactcataaaactgatgcaccaatccctcggtgataactacttcttccctccacttagtgaatactacttcagcgtggacaatttagagcgagacttcttcctgcgaaggaaaatggatgctgatggtttcctacccatcacccttattgcttccttccaccgagtgcaggcccttaccactgacatttcactcatctttgcggtatgtcttcctccctggagctgggatgcaggggaaagaaaggtccttagggagctggagtttgggccaaggcagaaagccctggaagagtcatcatctgatgacttctgctgaagtctcaaggcttggctagtctcctcctctccctccttccttcctttctctccctctcttgctcattatggaaaatgtcagacacttaacaaaagtagagtagtataatgagcccatcatcagcttcggcaggtatcagtttatggctaatcttattccatctgtaccctcatctgtttattctcacatactacattgaagaaaatcctagaaaacctagcattttgttcacaaatatttcagtatagatttctaaaagatagacttgttaaaagaaaatagccacagtatcattatcatacctaaattaacagtttaacatattaacagttccttaatatcatcaaatatttagttcagattcatcccaattggcgccatatatatatttatatatatattttatatatatttatatatattttatatacatttatatataaaatatacatttatatatatttatatattatatatttattatatatttatatttatatattatatatttatatattatatatatttttatacatattatatatttatatattatatatttttatatatattatatatttatatattatatatatttttatatatattatatatttatatattatatatttatatatagtatatatattatatatatattttatatatttatatatagtatatatattatatatattttatatatttatatattatatatatattttatgtatttatatattatatatatattttatatatatatatagtttgtgagaatcagaatccaaataatacctataggctgggtgcagtggctcacacctataatccctgcactttgggaggccaaggggagggtcatgtgagcccaggagttcaagattagcctgggtaacatagcaggaccctgtctctacaaaaaactaacaagacctgtgtattgtcttattaagtctcctcttgcctctatttttctttttctttgccgtttattatttgaatagactaagttgtacatcctgtaggattttccacagggcacagggatgtcattttaacatgttcatctgtactccaagttttttgtaaattgtgatctagaggcctgatcagattcaggttttgaagttttttcccctccttgtcaagaatactttatcataatgatgtattttctctcaggtggcacataacatttcatttgattgtctctcttgtgctataagctgccagcagtgttcgttaggattgcaaaatgacaatatactaattctgtcagtcggtcttcatttattaggtggaatacctcttcaagaagtaactttgcctcatcaactgttcagttaccaagaggtatagtttgttcaggaagggcagattaatgtttgatcttcctccctttgttagccagtttgcataattatgagttgatctctaataggtttcataggtgaccagtgagatttggtggtttgttttcgtatcatttgttattataagcttatgggctcaaacgtatttattttggtccattgcagttaatggattggatcaaattgtcccacctttggtcagtgggaccctatacatttcctgccccagatctggaattggccacttttaaaaggaattctagttcctttcttttgggaaatggtatttagataccagtctgagttataggggtgctttattgctacttggttggtcattctttctagatgatttttttgttttttggtgagataaaatacatcatggagttattctgttttgttgttgttgtttttttttttttttttttttttttttttgagacagagtttcactcttgttgcccaggctggagtgcagtggcatggtctcagctcactgcaacctccacctcccaggtttaagcaattctcctgcctcagccttccaagtagctggtattacaggcatgcaccaccacacccagctaattttgtatttctagtagagatggggtttcaccatgttggccaggttggtctcgaactcctgacctcaggtgatccacccacctcggcctcccaaagtggtgggattacaggcatgagctaccgcgcccggcctgttctggtattttctattaaagggtctttacgtagacttgtggatcttttattttacctactgctttcttccatgcccataatcttaattcctaatgataccaacataattactcattttgttttatttcacagtatgtctaccgtcttttttttttttttttaaacattttttaaagagagagggtcttgctctcacaggctagattgcagtggtgtgatcatggcttactgcagcctcaaccgcctgaaatcaggcaatcctcttgcctcagcctcctgagtagcaggattacaggtgcacaccacgtgtggctaatttttaaattttttgtagagatgaggtcttgcagtgttgcccaggctggtctgaaattcctgggcttgagccatcctctcacttcggcttccaaagtgttgggattacaggcgtgagccattgtgccaagctctacattcttacaatacctccactaccactgaaaacagtttttccacttatacagtatcttcaagtcatttgaaagaatctttgtgtggtttcacatttaaattgatatatatattagttttattttgcttccaagttttagagattgctttctccctacccctataattttctaagttgttttacatttgtgtaaaacatttacgtggttctagagtctcagcatggtatagtcatagaagtctgacttaaattctgtcacttacaccctttcttctcttacaggcaaactttttagaacctttccatttaagaaaaaagcaaatgcctctacatgtatttgtatccttggtaaatggaaatatacaacacatggcatttcttcaattcttttttgttttaacttaatatatctgggagctaactgcaaagtagcagtatataatagaaagatattcctcattcctgtgtacagttgcatagttcaccattgtgtggaatgctccatgttttttcaactgctgctcctatagatggatgttttggttgtttttttgagactaggtcttgctcttttgcccaggctggagttagtacagtggtgttatcaaagctcactgcaacctcaaccatctaggctcccaagtagctgggaccacagatgtatgccagcgccacctttttacgatttgtagtgatagagtctcgctattttgctcaggctggtcttgaactcctttgctcaagcgatctacccaccttgacctcccaaaatgttgggattacaggtgtgagccactgtacccagcctgcttttttgattaatattttgtgggtttatccacctcagcacatgtaaagttggttgtttttttgtttgtttgtttgtttgtttgtttgagacggagtctcgccctgtcgcccaggctggagtgcagtggcaccatctcggctcaccacaacctccacctcctgggttcaagcgattctcctgcttaacctctcgaatagctgggactataggcgtgtgccaccacaaccagctaatttttgtatttttagtagagatggggtttcaccatgttggccaggatggtctcaatctcttgaccttgtgatctgcctgcctggggctcccaaagtgctaggattatagacgtgagccaccaggcccgacctgtaaagttttttaatgtctgagtagtgttccatcatgcatatgctgtaaatatttaaattgcctatgcgatggcaagttaggtattttatagttctttttctactctagttttactgtgaatggctttttgtccagatattatacatactgctccctgtttgtgcaagtgttctctagagcagattactggaagtaggattgcaggctcaaagagtaaaagggtaggtgtatttattatgctggtacctcctacaagtttgaacatctcacattatctaccagtcgtggaagatggtgtcaattttcttatattactggtagcattggactcataccaagctcaggggaacccagttgtctaccatttccaagatctttctgtccaagattttcttcttaatcccctcttccttctcctccccttcaggccctaaaggacagcaaggtggtggagatcgttgatgagaaagttcgtaggagggaggaaccagaaaagtggcctcttcccccaatagtggattattcacagactgatttctcccagcttctcaactgccctgaatttgttccccgtcagcactaccaaaaggagacaggtaggtacctgctggcatgaagattgcccttgtcctctgggcaacagtcctcctcagggctggcatcaggaggaggactggagggatgaggacttcccctttccaccctttagagtcggcacctggctctcctcgtgcagtcaccccagtgccaaccaaaacagaggaggtcagcaacctaaagacactacccaagggcctgtctgccagcctgcctgacctggattctgagaactggattgaagtgaagaagaggcctcggccatccccagcacggcccaaggtgggtgaggccttgtcccttgccttggttctagcactctgagctagggtgcttgaaggggataacacatgggcacagcactctagctctgaggggccagcaggaaatctgggtagttcaggatcatagtgtgagttgaagttaccagtagtggctacagaaaggttgatttggcttgtttccatttcctgtggggaaccaccctttagggcgccctactgtgtgagttcctcggtgacatttttcttaagggatcatgcagcatctggcagcgatgtttctggcttcttgattcttggctcttctttttgctccatctaaatttctggggctgcgtttttggtgtcttttccctgagtatgtccccactatcatgtatgtaagccccttaggtcctcagaagaaggaagggagagggagcagatgcatggcccaaatatggagttagtctacacaagtctgctgcactaatggcaaggtgaccttgggaagcctgttcatacctcaaggcttcagtttctccatctgcagatgaaaggaaggagacattagaatattctagaaatagtttatatatataaacagatgaagttcactgttaaagaagtattgcaatctctaactaaaattactacttcctttttaagtgctgaatttttctccacatacctgctcactgtcacccactttggagacctctggcctggggcttgtgaggagactgcagaattgaccttgaactttgggtctatggaattctatactcccttatctattttcccacagtgattacctctcatctcctttctcttgcctgcctgttcatacacagaattccccacagttgtggcttcagccctcaaaaagtgttggagatccagccagagacatgaggagaaaggtagtaagtagatgagggttttacaaagtccaggcctacaaagttttgtttgaaacaggggtcagacttagctcccatt

SEQ ID NO: 118408 - DNA, 3614 bp, Homo sapiens
tttctttgctgaaggcaccgtgttttctcttgcctttggaacaatggtattctttctgcctagtctgtccctatcttcatctggcttacttatgttcatcctgtggtagtcacttcttgaaggaggccttccgtaaccattcttagtcacagttgactaagctcctttaactgtgtgcatccacaaacctgcttatagcctttaccataccacaatgcagttggctgtttggttgactttctcccattgagctccctaagtaacagggaccttgtcttattctgcttttaggtttttcatacagagcttaggactaatgggtactccctcatttattatataattgaacatctggtattaccagatccccgtctaggtactgagtatataatggaaagcaaggcagctgtggatcatggagcttccagtttattgggagatgttgaatagatggataagtggatgaatcaacctgctgaacttctgtgtgtccactcctaagctaggtgctatgtaggatataaaggtaaatgagagcacagttcctgcctatagagaagtcatcatcagttgtttgtgcatgactgtgatatgagctgtgagtggaggaacctggacttctatgaaacatcctttctcatagtcataaagctgactcccaggatgacgcttgtgacctgctggtgttaccagggtcatagttgaacagtcttatgttgagaggctggagcttccctctcatggtatagctacagaatctgggccaaggatctctggtgattccttttccccttcgtctgtcctattttagaagtcagaggagtccagattttcccacctgacctctctgcctcagcagctgccttcccagcagctgatgtccaaggatcaggatgagcaagaggaactggattttctgtttgacgaggagatggagcagatggatgggcggaagaacaccttcactgcctggtctgatgaggaatctgactatgagattgatgacagggatgtcaacaagatcctcattgtcacccagacaccacattacatgcgccggcacccagggggggaccgcacaggcaaccacacctcgcgtgccaagatgagcgccgaactggccaaggtcattaatgatggcctcttctactatgagcaggacctgtgggctgaaaagtttgaacctgagtattcccagatcaaggtgaggcttggacatagcagtgagtgtggagcctggtgtgcctgtattgtacggagaagaggaagcctgattagctgtgcaattttaggcaggtccttataattcagagtctcaggatttttatatatgggaaggggatgatgactgacatctagcttgggcattaggagtgaggggtgatgtgtaaacactgcaaactcttcaggtgaggcggtggtgattattatcctatctgcggatccatagttaatattctgacagttggctagacacttttgtggggaacagaaaaagggttagattgttatttctagtcttaaatatttaggcatctaaaaatttagaagccttttaagaagcttgtgttgagtatggaaaatggagaaaagataagtcttttgaaaaattgctgctgcctggaaatagtcaaaacatctctgttgtgggattttagagtgggtatgtttggtggtaggttgtcctagggtgagcctttgtaataagtagcagtgtgtttcctggaagtaaggaggaaggagagttgcccagccactgtgtgataaggcagtagcagaaagagagatggggaaacactggagctttcaggggggagtgtgtagtgagttcctgaggagctactgtcagcctgatctcagtcttactacagggagggcagggcaagcactgtcttcttctgggctagcacacttgtgccaaggtaactggggtgaggaatggtgactgggcagctgagagcctggggaccagaattccacgtatgtcgacgtgggagctgccctctccaacttcctgccagtcttgattccttaaacaggctagagcagcctgcttacttacatctttccccactcatctcatgacctctgcagcaagaagtcgagaacttcaaaaaggtcaatatgatcagccgggagcagtttgacacactgacccctgagccccctgtggatcccaaccaggaagttcctcctgggccacctcggttccagcaaggtgagaagcagacacctgagatcctgacatgggtgagaggatctagggcccttggactgggggctatcctggggtggatgccacaggcctttccctgcttcctgactcctctctctgcctctgcagttcctacggatgccctggccaacaagttgtttggtgctcctgagccctccaccatcgcccgctctctaccaaccactgtcccagagtcaccaaactaccgcaacaccaggacccctcgcactccccggacaccacagctcaaagactcaagccagacatcacggttttacccagtggtgaaagaaggacggacactggatgccaaggtgaggcattcctgtcgggctgctcagagtcttgggtctacttcattgcattccagtgctttgcttctctcccttgccttgtctgagctaaggaagtgctaaatccttcacctgctctgtgttctgaggctggtgggcttacctaggattaggtagccacatctgcaaaatatactgggtgtgggagtggtaaccccatgttgaaaggcctaaggaggattgaccaggtatgagtccttgggcaaatcactgcattcccaaaccttgatttcttcacctgtttgaaataggcataccagttcctagctcaccactgtgaactttatacgagaatgaatatgaaaatgctgttgtaaaatgtgagagatcatgcccatcttagtcctacaagtgcttgatgctcctcagagttgtaggagtacaaacagtaacaaaccctgggctaacctttgcagatgcctcgaaaaagaaagacaagacacagttcaaacccacccttggagagccatgtgggctgggtgatggattcccgtgagcacaggccccgtactgcttccatcaggtacctggggcagtgggggaagagtgatcaggctgcctatgggatgggtgggcgagccatgaaattgactggaccaagaagattggtctgaaaattaaagggaccctcatctaagaggttttcaaaaaaccagtggtgtggaaagctcagcccaggacctgggaatgacgggtaggcttttttcctaaagaagtggtgtggcagtcacgtgagaccagattttcatacatgcagagagaaaatctctgaattggtttccaagcctggctatctactttctgtctgaggaagaatagccaggtagttgaataaacagatttctggcagtctctctgagcctactatgtcttgggaggctacttgaaaagttttaaaaattaaaaaaatacatatttattggccccaacctgtatctgctgaccctgcttcttggggtagggcccacactcttttttatttatttcagtaagatggccccagtgtgtgtttcctgtttcccaaa

SEQ ID NO: 118409 - DNA, 1045 bp, Homo sapiens
gtaagcctcagtatcctctgtaaaactctctgagagttgatgcagagttaatcagacccatggatataagttaaaggtccgtaactgggcctccttgtttgataccctgtgagaggatggatcttggctgacagaacggatcagagggacccctcctgacatggtggggctgctgtggggaacctggtgacagtattttttgtggtttctgtagctccagcccctcagaagggacgcctacagttggcagctatggctgtacccctcagtcattgcccaagttccagcatccttcccatgaactgctcaaggaaaatggcttcacacaacacgtctaccataagtatcgtaggcgctgccttaatggtaagaagtgtggggggcaggagatgagcctctgggcccgttatttagacccagagtataagagttgggggatacggggataggtgactcttttctctgacttcagagcaaaaaaaagacatgacattatagcaagaaagactgaagttagactcgggccaggtagttttaaactgtaggaagctagggggatatggcactcacaacgttcgtgttctttgatcttcctctattgattattaaagctgtcaattaagtatttccatatctctggcaagattactgactcagccattgtcaggtctagtccactgtccatcacaaaagggtatgtaagaggtgacatatgctctctagaacaaaggttgccaaactggcctgtgagtcaaatccagccagtattctgttttcgtatggctttggagctaaggacagtttttacatttttaaggggttgtaagaaaaaaagatttgtgacagagactatatgtcttctgtaaagcctgaaatatttgttctctgtccctttacaaaagtagtttgctgatcccctctctagatgatagtgtaaggaacgagcctgtctagatgctcttgtctgtccctgctcttttagtattctgataggttggctgtaaagacgcgcaaaaccaatctagtcacctgtagttattaactc

SEQ ID NO: 118410 - DNA, 1019 bp, Homo sapiens
ctcttgaggtaaatattggtaatgagctaaatacagtttgttagaatttacaaacaatttgttcatgccttgtcttgtctcgacggcacttgaaagtagtaccagttgaggtgaagagctagactgccagcctggttcagaagctgctgccacctgctcctggaaaagtacaggcccagctcccagcatcagggcctggggcagagtggttagtgctcaatagatatctgctgaatgactgagtggcagatgatgagtgaggggatttggaagtacatgagaaaggaccaagtcttaagttccaggatcctttctccctgaagcaagggcagcctgaacctgagacatgcctttcctcctttctttcccatcagagcggaaacgcttgggcattggccagtctcaggagatgaacacactcttccgcttctggtccttcttcctccgagatcacttcaacaaaaagatgtatgaggagttcaagcagctggctctggaggacgccaaagaaggctacaggtgagcaggtttgggtgggggactttggctggtgcttagggatgatgtgggatccctagttggtctgcttccagaactgtagttggaaattccttgcatgtgtatgttcattcatatacttgatgaaaaatttgtttttaaatgagcagtatattcacatggttcaaatttcaaacattttaaaaggttgtataatgaagagttgtcttatccctgtcccccacccatctggtgtctttccccacaggcaaccagtattagaatcttgtgggtcctttataaaggaccctatgtaagtaagtagacatctgtgtagtcttccatgccactaccactccttttgtttacgcaaaagctggcctacgttataatattttttgcaccttgcatttgtttttgtttaatactatattttggagatcattctatatctgtacataattaactttgttgttctttttttatgggctgtaacatggtcttatatggatgtaccatga

SEQ ID NO: 118411 - DNA, 1691 bp, Homo sapiens
ttgaacccaggaggcagaggttgcagtgagccaagatcgtgccactgcactccagcctgggtgactgagcgagactctgtctcaaaaaaaagaaaaaaaaaagatctaaatctattggcatgtgtttgtttttgttttgttttattttattttggagacgagtctcactgtgtcacctaggctggagtgcagtggcgcaatctcggctcactgcaacctccacctcccaggttcaagcgattcttctgcctcagcctcccgagtagctgagattacaggcacccaccaccacacctggctaatttttgtattttggtagagatggggtttcaccatgttggccaggctggtcttgaactccggacctcaagtgatctgcgtgccttggcctcccaaagtgcttgcattatagacatgagccacagcgcctggccgcatgtgttccttgaagtgaaatttctgagtcagataaatgaacaaacctactaattggcatggtcaaatggctttgcagagttataccagggattggccaactttttctagaaagagtcagtaaatactttaggctttgttggccataaggtgtttgtcgtaattactcaactccgttcactctgttattgtagcagaaagcaaccatagatacttcataaaagaataggagtaaacaaatgtctgtggcagggggacagagttccttgactgcaggaaatctctgaacattttatgctggacccacttagactagcattctaaaagcgtgtatgctgttttttcaatacagaaataacatgtagtttaaactgtttcatagttcctctgttatgcaggcacatttcccgttttacagatgaagaaactgccctgatttcactgacttgtgttctacagatatggtttggagtgcctttttcgatactacagttatggcctggaaaagaagttccggctggacatattcaaggattttcaggaggaaacggtgaaggactatgaagctggtaagagccagagttggatctgagtgaggcctggtcatgtaggcctcctcttccccagttggacctgggtctttctgtgtattacacaacacctccctctctcctctgagcttctttatcctcaccagctcagcttttctgtacctctccctacaggccaactgtatgggctggagaagttctgggccttcttgaaatattccaaagccaaaaatttggacattgaccccaaactgcaagaatacctcggcaaattccgacgtcttgaagacttccgagtagatgtaagtgaaactctttctctaactctgcttgtcctggaaagaaaactggaccaggaatcaggatacttggattctggtccagctgtgcccctagcccaggaacccctctccctgctccccacaatttgggctttgctttttcacctttaaaatggagagtgagtggccaatgaaggctagttggagatagttgtatggttgctcctgcttaccctttctgtggtaccatcataatgctctttctctcctatctcaccatcctccttgctactgtgcccaagttagccactactagttgatcaggatgggtatccaagatacacacatttgttctttctggaaaaagccaattccaaccccagtttataaattaatgcccaggtctcttatgttcttggagcag

SEQ ID NO: 118412 - DNA, 5104 bp, Homo sapiens
tatcacgagaacaagatgggggaaactgcccccatgatgcaattatctccacctggtccctcccgcgacatgtggggattatgggaactacaattcaagatcgagatttgggtggagacacagccaaatcatcacatttattattttaaaactgccatttattaagtgtttattatgtgccaggtactttacattgaccttatttaacccttatgtggtgacgcagacaggacttattaggttaactgaggttcgtggccatccagtgacataatggcagagccactcaggtctctcaatataaacacaaatctgttttcttttattcttaagcatttccacccttgaggaggagaagggaggggagcagggtacaagtcacagagaacctttgtgataagtagacctattagggtggaacaaggactcagttttggttcccaaaatgggaaggaaacgtctgtcttcggggttataagacctttgttagtggtaaggccagtctggagcatggtctgagtcttagttcaggatcctctggaccttgaagagaatgaggtgatccccagaaggatctgggccttctgagctgagacgtcgcagcatactgcatgccacattccacatttctgagcaagagatcccttcttggaagggaagcagaaatgaggttggataaaagcctggccttttggggcaggtagacctaaattttgtctttatcggttaccagctatgagaccctggggaagttacttttttgtgcttcagtttcctcatctataaaatcagatgtccatgggtccacatcaaagggtgatgctgaccccatgagagagtgtgcataaaacagcacaaggcttggcatgaagaaacgcttaataacttataatttatttttaaggttaaacccattcattttctatatttggaggtagaaagtaggaagtgtctagacgggcctggcaaggaagagggcgtagatagtgcttctgatcacctgtgactccttcctctgttgcagccccccatgggtgaggagggcaaccacaagcgacactcagtggtagcaggaggtggcggcggtgagggcaggaagcggtgcccctcccagtcttccagcaggcctgctgccatgatcagccaaccccctacaccacccaccggccagcctgtccgggaagatgccaaatggacaagccagcactcgaacacacagactttgggaaagtgaaaagctccttagccctggggcttgaggggggaaaggggtagggtgggtaagagtccatgggggtgcccagtcccaggaaaggggacaatgaagggacaggcctggagttactaggacaggcctttgtgctgagtagcaatgtatacaccatttgggctatcagaggtacccctgggcaggagcctctacatccccttccccctcctctctccatgactcttgacatcctagcttcttctaaggggggagggaaaggggggagatttttatatatatatacatatatatatatcaagttttaaattattgatagttcatctggattaccaaaatcactctgcagccctgcccgaggctagtaggctgcaaccctggtccccacccctaacctcctgctccccctcaagccaactatgcagcccacaagaaggccctgcgggcccccccattgcccagcactgtctcatagaaggctctggtggtacctctgggccccaggagcatcagccccttgatcatctggggtttgtcatcaccatattttctccctgctgttcccaccatgcccttctgccatcttctgggagaaggaaaccaaaggatctaaaactggggtttgggggaaggtttcagcctctccccactccccttgccccacaccctttactccccagcccagagagacgctgcttttaccaggaaagactattgaaagatgttttattttatttttctctgacctttccatccttgaaaaaatggggaaaaaagaagaaaaaagacaaaatcgaccataaaagaccaaaaaaaaaaaaaaaatcagaaaacccccacctaatccacagaaagtaatgtctttcccctccccttggaatttttgttttgtttttggaaataatatttttttaaaagttgccttattgtggagcgggaatctgaaatacccaaatgcctgttttcctcggtggagtcaacccgaagagctcccaccttctctggatgtgcctgggcttggactggctagaatctttctctggactgttgcatgtacagtgcctccatcctggaggcaagagagttgggagtggctcgaatcagagccgtgcccaagatatccctgctgttgcatcgtttgaagctgacgtcctgtgtctgtacactgctgccactgttgtgtcctcgctctgcttgctgttgcctcacgccaggccccgtcctgccgtgacacccttcatcctacccttggaaccccaaggccaagttggttcaaactgttggagaacagagttggcctgcatctggaacacacttgtcctcagcttaccatctcctcacaccccagagtggaaaggtgaacacctgcagctgaggcttggaaacgtttcttgtgttgccctgaaaaatctttgagacctcagggaggctctgtctctcttaaaaggtggagaaagatgccattctctccctaaggtctggtggagtctccccatcttgcatacccttctgcaagccatctatctctgctcactctccaattgacccgcctgggaacaagggatgaggaggagttgggggctggggggaatcctgccagttggtgaagccctgtggcaggaaggtatatgtggacatagagtatacctgattctctttcttcagccactgactgcttgggttgggctgtgaatgataatggaatggctggagtctgctgttgtcagaaggcagggagggtgatgaaggactgacccacatggactgggatgtgtgtcggttatgggcatgactgcacgttcactctcagtgggatctgggcaacatggagttcattgtcctgttgcttacttactgcaatgtctttggccctccttttcaactggttcctctgttgggcccaaaggttgggagtaggagacagtatcccaggctgacaagggcttgccctttaccttgggcaccttgttaatttttagcctgtgcccttccccacctttgccctcccagtggttggtatgtgggaagcccatctcagttcctgtgacttcatgtctcaaaccaaggatgagcgtctggtctctgctatgatggtggtatccgaggcctttccctgcccagtctggtgcctgccccacattgtaccggacactggattcctggacccccttctcctttcctttctttccttcaggtcacgcagccctgtactgtatccagcaccacagaaacctcagtgtttttcctctgctggtttggggcacaaggaagccttagggtatggggaaaggctgttattacctagagtttactcccaggccagggggctgccatcttcttcacagacatccctgaaaggaagcccctttggggcagggaggtgaggacttcatctcaacatcggctggtggttggtaggggagctttttcttttctttcctttttttttgtttttgtttttgtttttgtttttggtaacatgttaggagttaatgttgcaaagagtagtttacatcttcactttctgaagacacttgaatttaggaccgatgtatctgtgacaagcatgccagaagtggcaggggccatcagggctaaccacttcacacctaccatcgtcccatggggatccaagacctgagataaagcaacagcctgcccagatccctctgttcatcctatcccttccaaggttggtccatgccaacataacctctgggcatcagacatcagcaggtctgtgtgcctcagccctgttaaggggcaggtttctctttagccctcttcctgcacttgggagcaaaggcactaccagtagagaagggccatccagccgtgccccagcctggacccctggggctcagatagaggtgctgagcccctgtgtcaaagttgttaaatgtttttgttttgttccattgtagctctttttttttttttttcccctttcctggtgattgattttacaaaagaaagtaagctgcttagaaggccctggaagggaagtgaggaggagggacaaggaagatgactagttacggagggtgagggttgttttttgccaaaaagcctgggtagagtgatctgaattatctggcaccctcctgaatggaaccccagagtacctcctgtgtggaagggtccctggattttccctaacacccaccctctcccccttcagccatgctgatggcagagaagataagaacttggagcccatttctcactggagaggaaaacttgtcatctggctttgcggagaaggttccaccttacgctcgtagtacattatctttactatgtgctaggatatcatatttaaaaggacaaaaaaatgtaaaatacttgaatgagcttgtattataacattaatattattgagagtatctgctttccaggctgaagtgattcattcattattctagtcctgctttagtcctttgtaatttgtggtaattatgcttttctttttaatacaaaaaaatgtataaaaataaacacttgaaaaggcaaaatactggctggtcttccatctaggttactgctattgggtgtgaaggatgggtttctggtagagttcccccagatccggaggaaccctgcactcaatgtgcacatgaaacctcggcaggggttctgccattgggcttcgaggagtctgcctaaggcaggggcttctacaagccttgagttcatgtccaccctgtgtcttaagtgagacgtgacagtcatagccagtgccacaaaacagcagtccagcataatgccaggatttcagcgcacttgtcagcttccaggttttccatcccctggctgtggcctgcattgtgttatgagacagccaagaagaaaaacgatgaggcttcttatggaggg

SEQ ID NO: 118413 - DNA, 1513 bp, Homo sapiens
accatctgcatcagaataagctggggagttgctaccaatgcatctcccgggggccactccaaacctgcaatttgccgtatctggagtcctcctttgaaaagcttgctgtgtgattgatgcccacagtctgagaatctctagcagaactaggcttcttcaggtatgagatcaccagcatcagaatcccctggaacacttaactaaaatgcaggtttccaggccctgctcccccagataccttagttcagcatatttggagtggaattcaagagcctatattttaaacaagcatctcaggtgattctggtataggaggtttgtagactacacttgaaaaagtctggggctttcagagatacatgacttccttgtgattgcctgcaggagttttatgcatatatgtacttttctaaagagaatgtccagagcttattcaaagggcccagagtccaaataaaggtttaaaacccccagttggaggaggacccaatttcagaaggaaaagagtaaggtcatcccagtgtggttattttcccagccatcagacctcttccccaactagcactcacatgtaaactgagataccagtgcctgctatcagaagcttaaggagggagggtgatggttgttgcctagggacccattgtggggagaaggtccttacttgagatggtggtagtcgtggaattcaggcgaaggcaggaagggaaggtggtagccacagtgggagatggtggtgatgatgagggccaaggaaaaccacatggtgatggaggacaagtgggagcccattactaatgggcccactatcaccggtagcatgttggagacctgcaagaggagggatgattgaaggcagggtccagggagatgaagggacttagttgggtatacacttagtcccaaggtggtaccagaggcaaacttccttgacccagatctggagaaggtgagagtttcgggactttgatttgttgaaggcattcacctttgtaacttgggacaaattacgcagtttgagcctcaactttcttgttagcaaaattaagattaaaaaggttgttggaggagccaggtgtggtgattcatgcctgtaatcccagcaatttgggagacagaggtgggaggattgcttgaggccaggggttccagccagtctgggcaaaatagcaggatcccgactctacaaaaaaatttaaaaattagccagatgtggccaggtgcgatggctcactcctataatcccaacactttgggaggccaaggcgggtagatcacgaggtcaggagtttgagaccagcctgaccaacatggtgaaaacctgtcctactaaaaatacaaaaatcagccaggcgtggtggcacacgcctgtaatcccagctactcaggaggctgagacaggagaatggcttgaacccgggaggcgggagattgcagtgagccgagatcatgccattgcactccagccaagatgacacagtgagactccagatttggtggtgcacacgtgtgg

SEQ ID NO: 118414 - DNA, 1576 bp, Homo sapiens
tctggggagcatagagctctactcactgcatgctctatagggtgggcatagagagagatcacgccaatgggagctgtccactcatggtgtttcttgtggattttcttgtagaatgttgggtggtgaaggagcctggggaaatagttaatagttaataacctgctgattcctctttctccctccccgaccagaccatgagaaaccaaaaataggaactaggggttacatccatggagcaaagttaacaacaccaagacctgccttcaaatttcaaccccagcccttatactgcatagtttgggagtgggttgctttgcttctctatgccagttgtattcgctgtaaaatgggatgctgcccagaaaggactgaataaggaaatgaatgggaaactgccctggctcccacacaatcagagaggccttttctcttttggacattcattcctcagttgtcccaagttgtcagttatgagacaactagtggtctccctgttaactatttaatgggacacttgaggccagggagtattttactggcctacactcaattcagaagcctgttcccttttattttttttctttgagacaaggtcttgctctttcgcccaggctggagtgcagtggtgtgatcacagctcactatagccttgacctcccgggctcatgtgatcctcccacctcaatctcccaagtagctgggactacaagtacacaccaccatgcctggctaattttttaaatttttttgtagagacggggtctcctgacattccccaggctagtctcaaactcctgggctcaagtgatccgcccacctcagcctcccaaattgccaggattacaagcgtgagtcactgcacctggcctcagtttccttgttgatcagtgagccctagacaggatgaggagccagctgtgcctcaggcagggcctgctcaccggtgtgaatagtagaacaagacttcctcgatcagcgtgaagatggccagctccaggaggaaccagtggaaggtgggtagctcacggcggcaggggtctctccaccatttgaggaagggatagaggaagaccaccatggggaaagatatcatgcactggttgaaaagaactgtgcggatagactggcgcagtttcacaggatccacctgcccaagggaagggaggagggagatggataagagtgtgagaagtaggctccaccgtgacctgcttacaggaggccctcactctggttggattctgggagagatgtcgggggacagccagtagctcctgactgccacccagctctgggcctggaaacgttgcagaataaggccctggctgctaggcaggtgagtaatacccctgtccttggaaacttcagcagccttcagtctgtgtcggaacctgccttcttcctggttctgcacattatcaccactgccctccccatttctctggccaggccccatgtatttacaggtaacttgggtagcctccatggtgcttggagaaggctgtgactttctgagtgataccccatttcagccatttagcccctcttcatcagagaaccttgttcatgattggat

SEQ ID NO: 118415 - DNA, 1281 bp, Homo sapiens
tctcactatgttgcccaggctggtcttgaactcctagcatcaagcgatcctcctgtctctgcctcccaaagtgctgagattacaagcctgagccactgtgccccagcctgcgtaaattttctttttttctttttttttttttttgaggcagagtcttgctctgtcgcccaggctggagtgcagtggtgcaatctcggctcactgtaacctctgcctcccaggttcaagcaattctcctccaggcatgcgccaccatgcccagctaatttttgtatttttagtagaggcagggttttgccatgttgcccaggctggtcttgaactccggagctcaagtgatttgcccatctcggcctcccaaagtgctgggattacaggcatgaaccaccacgcccaggcttaaattttcttagtgaaatgggaagcaaggcccctccctctgccagcagttaggggaggaggtgtgaactagccattcaggcagtgggagagtaaacagagcaggaatggatcataggaacaccaggtagcattcagctccccacttgaggatctgtttctgatgtgttagttcaggggccagtccttccttgaaacagccaaagattaaatggcctcgtgaggttctttcctgcttgtgtgcccacttgagggtgcatgtggtacaggaacactggacttggtgtcagatgggatgagccctggctctgtttcctagcagcaatctgatcttgagctagtcactggacatttctgaacctcagcttctgcagaatgcaatgacatcttccaatgtagctctgtagtcattgtgtagaccacaaggttgtacagacggcaggtaatattctggagagccaattaagaatgtgagccctgaagtcacaaagcctgcatttgaatcatagtttacccgtgtaacacctctgtttcctcatctgaacagtgaaggttcttggcctcagttgaagatgtgagcatttagtcagtggtgctacaacagccgtggttgacagatgaagtgttctcaaggaccaagcacagggtttgacactttaggctctgattcatgtcctgccaagctgggcctggaggaagcccccaagcctggctggcagctgttgtcccaagtgagggggacagtaagccaggccagcagtccagttcaggaaggggcccacttcaaaggagtgggtcaagagcactgtttgcctttctggagtgctgggctggggcaaaaggacctgagagctgaggtggttcacccagacacctgggcag

SEQ ID NO: 118416 - DNA, 1011 bp, Homo sapiens
atcccttcgtgccaacgattttaacggtccttcaaagccaggaggagggggcgtggtaattcgaggggtttgttcgaagggccacgccctttcctcggcctttggatttttccaggccgcgcccacggcgggggggtgggggggggcgctagttctagaccacgccccttccttgttcgctcggaaagaggaccaaaatggaggagtaagaatcatgattaaattgagcgagcgcaactaatcacgcgaagagggccgcaggcgggccgtcttccgcaagcgtgcttccaggcctccactccccacctattcggcggcaccctgttacttctgctcctgcgcgctgcttcccgcgacctcacaggcagagcgaacacgcacggagtcgcaggggcgcgcaaagggggaggagcgggcgtgaccaggcgcgcgcgcgcgtctggagtgactctagagagcaggcgagtcgggcggatcgggtgggtagagtggtgccgtccggttgtttggtgggaggcacgtaagaccgctctgggcacgggggcgctcacctcactggctcgttcggttctaggagcagatccggggtagagggaaaagagctccgggccaggggctgccgtcgccgccgtcggggagtcagcccgccagcccgccagctcgtcagcccgccagccagcgcttcgcgggccctgtcggtcccggtaagcgggcctgcgcttaccggaaagaggagcgtaagatgaaagagtgtgagagaccattgggggtctgtagggggaaggggagtgggggcgtgtgtaaggggcagggtgtgtgaggaggagaggaaccccagcaaagagtagtaataataatggccaccgtcacacgataatattcgagtaatatgtgcggggactttacaaagcatctcatatgcttcattttaacttctactccaatcctccgaggtgcgtactgttatcaaacccattttacaagataggaaaaccgaggcacgaaatagat

SEQ ID NO: 118417 - DNA, 1286 bp, Homo sapiens
ttaaaatgttttacaatctagatcagaccaaacattgtctggcttgcactgtaaaactagttagctgaagacgacttctcaggtttcttcaggatgcctgcagcacttgtggagaatagccaggttatctgtgaagtgtgggccagtaatctagaagaagagatgaggaagatccgagaaatcgtgctcagttacagttatattgccatggtaaggagctctactctgactcaccttctttgtcacttttaaagttggggtcttgctctgttgcccaggctggagtgcggtggctattcacagatgcaatcatagctcactgcagccttgaactcctgggctcaagcagtcctcccacctcacctttccaggttgctgggactgcaggctcataccactatgcccagcttgactcaccttcttatatggatgggtttagggaatgtttaatttgagattttgaaaagaatgggtatgttccactaaagccattgtaaattaaaccggatggaaggttgtgttgcttcatgaaatatcaaggtagccagtgtctctgagaaggatgtaacctctagtatcttagattttttataacattattctgtttgaaagtctttaaagcagaagttacgtcatcccctagggcccagctgttccacagatatgttggatttgactatacgatgttaagaattttaaaaatttattgccagcatttaaaagtcaatagaactcacttgaattccagatttctggcatctctgaaaaaaaaaaataggaagatctggcaatatctgttatccactcctgcctgacactggctggagagagagatgagtattgtggtaatattaagggcctcctgtagacgggcatgtgctctctgttttactccagtcccgattacttgtactattttcatacctagctgactttactcctttacattagctgcttggagtttgtgactcctgctttagaaattatagagttggccgggcgcggtggctcacgcctgtaatcccagcactttgggaggccgagacgggcggatcacgaggtcaggagattgagaccatcctggctaacacggtgaaaccctgcctctactaaaaatacaaaaaattagccgggcatggtggtgggcgcctgtagtcccagctactcgggaggctgaggcagagaatgcgtgaacccgggaggcagagcttgcagtgagccgagatcgtgccactgcactccagcttgggggacagagcgagactccgtcccaaaaaaaaaaaaga

SEQ ID NO: 118418 - DNA, 1055 bp, Homo sapiens
ccaccatgcctggctaatctttgtttgtgtgtgtgtgtgtgtgttgttttttttttgtttgttttgttttttttgagacggagtctcactctgtcacccaggctggtctggaactcctggtctgaagtgatcttcctgccttggccttccagagtgctgggattacaggcgtgcaccactgtgcctggtgttattggtttttttttttttttaaataatgagcaaatgtatacctattataattaggaaatttagtttatggaggaaaatctcatttttctatctgtcacagaaatatgatctactttgcatgcttgtttgaatgttggaaagagtgaattgatctattaagttaggaaaagcatttcaaaaatacttgtactataattataaggtggtggtaatagtgtggccactacttctgtttcattattcaccagttaataaataaacaccttgttttttagagaggacatgtactcccaggattccatagatctccttgctaactcaggactacagtttcagaagcatgaagaggaagggattgacacactgcactttgcagagctgcttatgacatcaggagtggttctctgtgacaatgtcaaatggctttcatttcataggtcagtcctagggaatgtgtatttctctctcactttgggctacactgaagcagggaattgaattcttagtcatttttgcagtcctagtgactgttctgttcagcagcagcagccagaagttgaattggtgcttgttgcccatgtttcagtttttcacaaaacactggggctcatatactggtttgtttcacacagtatttggctctatcatgtggctatcagtgggtttaattccaagtgggaatatggtgggtgtagagggtcacagtacttggttatcttttaaatggctgtctcggagtttcttaggtacttgaaagccagattctccttattttaacttctcagtacttttggatttttggtgaatcgaatctacaattaaaccccttgggtacttttttatatctcccatattagtctgtt

SEQ ID NO: 118419 - DNA, 1716 bp, Homo sapiens
cctggccaccatggcaaaaccctgtctttactaaaaatacaaaaattagccaggcatggtgacgggtgcctgtaatcccagctacttgggaggctgaggcagggataattgcttgaacctgggaggtgaaggttgcagtgagccgagatcgtgccattgcactccagcctgggcaacagagtaagactctgtctcaaaaaaaaaaaaaaaaaaaaaagattcagattatagtacgataaactactcagaaaaagtgaaagttcctaacatgaagtagcatttacaagctttgagaaataaaatggttgaacactggggcctgataaccactgcttttttaacctctgtggtttattctcttgtagtggctatgattttggctatatggtaaagttgcttacagattctcgtttgccagaagaggaacatgaattctttcatattctgaaccttttcttcccatccatttatgatgtgaaatacctgatgaagagctgcaaaaatcttaaggtatatgatgtttttcttaataccagtaacaaaaagaaggacagaaaaaaagctgactttgctttattgttacgtgttcagcatgcatttttgagtactagatgctagtgtggtggtagacagggtataatataaagctgatttggtcagatatttgtgtggtaacgatctttaacctggccatgaagggaaccctctgcttctgtcatcttaaggcaggcattcttcactcgagggccatgaacctaatgaaaaggtataaatgctgtttgttagggatggggtctgtggtataacagattcttagaggagttcttaactctagaaagttttagaacttggtaccgtaataaattgttgacatagagctttgctgtctagaattagagtgggatttactatttcctcagccttgcaattctgattttaatggcagagttctggaaaaattaacaacatggaaaggagcaaaatgtaggatgtagcacaatatagcgtctggaaaaagggaataaaagagctaaaaagaggttactaaggcctgttaaataaatggcctgtccccacttcttgctagaattcagtgaactcataactgcacttagttggctccagtaggggcatgttgggtttgtaatattatctttgttctccatacatctccagggaggtcttcaggaagttgctgatcagttggatttgcagaggattggaaggcagcaccaggcaggctcagactcactgctgacaggaatggctttctttaggatgaaagaggtaagcttccttgaatgtgatcacaggcctctcggcagtaacttgctgaaggctaaggaggtagtggatggtctgttatgtgggctgaggtttgttgaacatttattttttatttatttattatttattttttttgagatgaagccttgctctgtcacccaggctggagtgcagtggtgcgatctcagctcactgcaacctccgcctcccgggttcaagcttttcttctgcctcagcctcctgagtagctgggattataggtgcccgccaccatgccctactaatttttgtatttttagtagagacagggtttcgccatgttggccaggctggtttcaaactcttgacctcaggtgatctgcctgccttggtctcccaaagtgctgggattacaggcatgagccactctgcctggccgaattttttgta

SEQ ID NO: 118420 - DNA, 1030 bp, Homo sapiens
caggtaagagttatatacattttactactttgtttcagacttgtcctgatatttaaaaaggtgtcaaatgagccatggatgctggtggcaggaggcaaccagagaggagaggctcgagtatgaggaatggggaagacttatttacaaattcagagcaaactcctctcttctgggtctaaaataaaaacatcttttgtcttcagtaaaacaaaagtctttctgctcaatgcagatggtaggtacagtgtgctcaaaagaagcattttctcttggggaagataagtacacagtcagcacagtaagcaccactctgggatcaggcccaccctgcagagcctggcgccatcactgctgcatgttgttgataatcgccaggatgctcatcttctcctgggcagagtccacatcctcattctgcttctgggccactcctgtgcctaagccatagagccgcccacagtacttggcatcatcaatgctgtcctcaaaaaacaactgcagaatgggacagagaaccatggtgagagttatgctagaagtcatgacaagtataaatattatcacatctggccgggtgcaatggctcacgtctggaatccaagcactttgtgaggctgaggcgggcagatcacttggggtcaggaggtcgagaccagcctggccaacatggcaaaaccccatctctactaaaagtacaaaaatgagccgggcatggtggcacatacctgtaatcccagctacttgggaggctgaggcggaagaatcacttgcgcccaggaggcagagggtgcagtgggccaaggccgtaccactgcactccagcctgggcaacatagcgaagactccatctcaaaaaagaaaaaaaccactaccacatcaccacctcccagccttcctaaagccctgaaaatataccaaactagaaaaaaaaactaatagtatagaaaggctcggccaggcacagtggctcacgcctgtaatcccagcactttggggcgccaaggcaggtggattacgaggtcaggagttc

SEQ ID NO: 118421 - DNA, 1472 bp, Homo sapiens
caaacaattttactgaatctgtctacccttcattcatgagaactccagaatgagtgttgaccactgaagcatcttttaagtctgtgttccattgtgccattcaggtttgctgtcacatatgcatcatctgaaatcatttgaaatttttgtacaataaaatatcctggatttgatcctgaaggaaactagtaagatcagatttttgggtcatgtctgttgtattttcagtaatgtgatttcagatggtcatctggattctcccacttctctactccattatttctctacttttccttccagcaaacctgaaacgtgagggagatggattaatgtgagtaacaggaatgtgtctttaaaaagctagagtggttacatttaatcaggcagtaagataatttgggttcttgagttgttttggagtaatatcccacaactggggtaggaagctcaggacttttttctttaaagctagtcatttcaaaagcatattgtatttttttgaatgactacagtatggacaatttcaaaaaccaaaacccactttggattggtggaagtaaaaactggtaactcactcaagtgaatgaatggtcttgcattttaaaagcttatgggaaactcaatttgaaatgattagaaaatgtcaagtattataagctggtatttaagatgcttgtaaatactatttatgtttttaattttgtaaaataaagatttctttttaaccactggcattaaggtttggtctttcatagctatggattgctggctctggaagatggtcatttgccatcagtgaaataagagcatcttgcctccattgtccccaagttggcttacatacaaaatatcacttggggggtgggttcgggaataaaaaaaatacatatcacttggtaggaagcttttcacgagcacctgtgtaaatggaattgtctcttcatactcaagattgttgggtcttaatattatagaattaaaccagtctaatatttcctggggtcactccactatatatggtggattagcttgttaattagtgggattcttttaaacaacctgaacttcagatatcctagagttggctcaagactttgtttccagccatttctgttgacacaaaatatgtggggttttaagaagtctggtacaggggcagatatggaattgtgactgggaagttgacaaaacaagagatttatcactgtaatttctggtgaaacagcagtcagtggttctcaaccagggtgccctggcatgctggtgactgtgagcgctatgcagatacccttccaaatttgaattaaagcaggacatttaatattttctacaattaaggacttacttacatgtcaggagaaatgctcaaagggttgaggaactcagtgttgagtgtggggtttggtcatcattgcatgtgagagttaagagcttagagtagtgctttagcaagaaagagcacaagtcttgga

SEQ ID NO: 118422 - DNA, 1736 bp, Homo sapiens
aaatttaaattggtgccatgtattagatagcttacagatggacaggtctttttggctgtgggcccaaatattaatagaagcaccatttttaagggtggatttgcatagggctgtagaaagagattgtgccattgagaaggacatcgcagtagccatcctagttttgagtgtcatttctccttggagtaactgttgaagagaaagacaggacattgccttaggagacagctggctcagctgtgtccaagaagtgtctatagatgaacctgagtgactggtgccttctgtgcaggtgtttgtggctcttctgcaaatgcttccttattcatcctcatgtcatcgtctttcaggcctggcccttcccagatgtgctggagtgctgcctcgtcctgcttctcatcaggtcccactttcctggctgtctggcccaggaaatgcagcagcaggcccaagagctccttcagaaatacggcaacacgaaaacttacagaagacactgccagaccttctgtatgtgaattttcacacaccttgaagaaactgccaaattgaaaatgtttgacatctttcacctctgcagttatgcctcaccagacattcactctggtccctagatgtttttgcagtaatccaaaagaatacaaacaaggattaagtttgaatcaaccctgcctacccatagacaacggtggatctgactttagactcaattgtggtctcctactggagggaagatcatgaaaagcccacagtagttattcagaactaacacctgcagagtgttggtcatctctacagccttaggcaggtttcacccaaagaggagaaacttctgtcgtcacccaaagtgttacatgcttaaaacacaagctacctttgtaaatacttcatctgatcagaagtgtgtcatgcttgtttgagatggagttgctgcattttaggactattgatacctttttttaattgtttttataatatttaatttgaaagaggagacccttctctctctactctttcatagactgaagtttgaatatgaaataggccttaaccatcatgttgactctcctgtcagaattttaggttggaaatttggttttattctttcatgtaattgcttatttgaacagatcacttactaaagctttagaagaagtgattcaaatgtgtgttttcccttcagttttataacaaatggattgatggcagtcaaatagctcaggaataaattactgtttcaatggttcttaaactttcttggatcataggatccttttgagaatcagattaaagccaaagatactctttggagaaaaatgcatattcctaattttgcatagatgacctttggattattggactctgactattgggaccctaaatactatttaattataaatcttttttttctcctccttggttatttaaacagttgaacagtgtcaggaacagatgtttctgtaatgtcacagttgctagcatgggaaaatcagagtctggcatgggtgtaggaaggaacactcctttcagataattgaactgttttctctaggattcattgtgaaggcttttctgctcacgtttgtagtttatttttcaattaattcctaggattggagctgttgggacagtgagaatgaaattcatttacaggaagtcccaggaaggagaaagtttgaggcagttttcaaagacgtgtatgtgcctagcattagagtttaataaactcacaaagg

SEQ ID NO: 118423 - DNA, 1066 bp, Homo sapiens
tgttgtcgtggccccagagccttcagtagtacaaatggaatactctatcatgctttgaatgactcctaggatgtagtaatgagaacactgtcgcaagccaggaaatgtttagcctccagttggctcttggtggaaaggcatgtggcccggtggatcacactgttgtcctttttcctggggtctgcttcttggttgataagaaatagaacataagggcaggaagccacatttctggcaactagagaaatgcatgacccagtatctttttcctcttttcctaggctgtgaccacctaagagacaagttgggggaccatcaatcccctgccacaccagctttcaaaagtttggaggccttttttctttatgggcgtctgtatgaattctggtggtctctctccagaccttgcccaaattccagtgtctgggtaagggctggtcacagaacactctctgttgagccaagccagcagttagacactgccagcactgaagaaacggaccctgaaacttctcagccagagccaaacaggccttcagaactagacttgagactcacagaagaaggtgagcgaatgctgagtacttttaaggagctcttttcagaaaagcatgccagtctccaaaactcacagagaactgttgctgaagtccaagagaccttggcagaaatgatccgacaacaccaaaagagtcaactctgtaaatccacagcaaatggtcctgataagaatgaaccggaagtagaagcagagcagcccctctgcagttctcagagccagtggtaagtactgaggcaagtacaagacggaatgaaaaatgaccctgctggctaggaacagtggttcatgcctataatcccagcactttgggaggctgaagcaggaggatcacttggcccaggagttcaccaccagcccgggcaaaaaagcgagaccctgtctctacaaaaaaaaaaaaaaaaaaaaagcccgggcacagtggatcacgcttgtaatcccagcactttgggaggccgaggtgggcagatcacttgaagtaaggagtttgagaccagcctggccaac

SEQ ID NO: 118424 - DNA, 1009 bp, Homo sapiens
tgtgatccaccgggccacatgcctttccaccaagagccaactggaggctaaacatttcctggcttgcgacagtgttctcattactacatcctaggagtcattcaaagcatgatagagtattccatttgtactactgaaggctctggggccacgacaacagatcacactgtctctctgaaaaatcacaatgatttagttcagtgactgactatgcagcccaaggaatgtctatcttttttgctgttcttttctgttcttactaacatgtaactacattcctatttctctctcccttaaactttgtggaaagtggacaggaggctgtaagagggtagggccaggtaaaggaaacagtatagttgttcttaaaagcttcggtaagagaatccaaactttctactaaaatgacacagctggccaatctccatcttttaagaatctaggtactcccagtgccacaccactaatggtggtgatgttgtccattaaagggtgtgcctcaggcagcaggaagtcacttaccgtcagggagaaaggctgagtacacttcctgcatgatggtgaagctccctgagtcatagctccggaccaccgcccgaaggagcgcctgcacagcctcgtcccaggaggccatctgttggctcagcactgccagggtcaagtcatggcaaatgtgaagcaggagctggagagagaagccagagtctgagttaaacatcctcccacggtaggcgcagaggatgccaccaaactgttcctgtgaaccgcatttggaaacaagtacacacaattcacactttgaaagttcctcttgtctccgccacccatttttgcttcccacatcggaaactctcatgtctagttgcacagcagcacacacacgtcccggtgttaaagtctgttcacactgagaaaacacctttacatttgcatttaattaaaacaaaaagtgggccaggcgcggtggctcatgcctgtaatcccagcactttgggaggccaaggtgggc

SEQ ID NO: 118425 - DNA, 1335 bp, Homo sapiens
ctaggaatgggaataaaaatctgtttgtgacattttcttcacatttttattcatattatagctatttaggggccacttgtgcttatgatgcagccaaagttttggccaaaaagggggatgcggcatcacttagaacggctgcagagttggctgccatcgtaggagaggatgagttgtctgcttccctggctctcagatgtgcccaagagctgcttctggccaacaactgggtgggagcccaggaagccctgcagctgcatgaaagtctacaggtcagtctgttatttcatctcctagtatacaagagggaagtgtcccaaatccttttctagtcaaatccaagttaataacccagttgcacaagctgtgccaatttggcaggcccagcaagccctggccatgctatcccactgaagtactatgacttgttagttgccgtattcagagtaagagataatatggtcattcacagtaattcccattgcttatctgtttgtacaaaacacctgtgagccgggcacagtggctcatgcctgtaatcccagcactttgggaggccgaggcaggcagatcacttgaggtcaggagtttgagacaagcctggacaacatggtgaaaccccgtttcaactaaaaatacaaaaattagccgagcgtggtggcacgcttctgtaatcctagcttacttgggaggctgaggcaggagaatcacttgaacccggaaggcggaggttgcagcgagccaagatccagcctgggcaacatagtgggactctgtctcaaaaaaaaaaaaaaaaacacaaaaaaaaacaccttagtcagcccaggccttgggttggcagtctagggtttcttcattgatgttatcagcactgtcttccttgaagagagaatggttggcctctaacagaaatcatggaactctacctgtaaatgcccctcttaactgtaagctatggaaaaaaaactgggccagatgcagcagatcgcttgagattaggagttcaagaccagcctggccaacatggcgaaatcttgtctctactaaaaataaaaaaattagccaggcatggtggcacacatctgtaatttggctacttgagaggctaaggcaggagaattgcttgaacccaggaggcagaggttgcaatgaaccaagattgtgtcactgcactgcagcctacgtgacagagtgagactcttcagaaaaaaaagagaaaagtgtgggaaaatggaaatctctttatttcttaaatttttttgttcccatctgattaaaaatcagtaacataccactgcctttttgacacatcaaaacagattaaagcattggcac

SEQ ID NO: 118426 - DNA, 1834 bp, Homo sapiens
tggcagaacttaaatagagagtatggagtaggtggcagtagtgaatcgtgttaatttcctgatttccatggttgtactatggtgacgtcggagcatgtcctgttcataagacacacactaaaatatttgggtgttattgggcatcatgtttatgatttaatgaaatttcaaaagggtttggttaatattgtgataatataattctaaaagttcattgagaagaaagggaatgggtaaaaatgctattaaagaggaatgagatattggagtttaccacctagagtgcttttaaccaagaatgtatactttagtcagtcctttattgtgattcttgtaggcaaaaaaagtattgaattggagaaaaaacggctctctcaacctaaggcaaagcccaaaaagaagaaaaagcccaccttgagaactcctgtaaagctggaatcgattgatggaaatgaagaagaaagcatgaaggagaactcaggacctgttgagaatggtgtgtcagaccaagaaggggaggagcaagcacgggagccggaattaccctgtggccttgctccagcgggtatgtggcagaatcctgtgtatcactaggatttcatggtcgtgtctgggaaactaagctaggtccttactcagtttgaaacttcgctgttcccatttttccaactcttggaaacagcattagttttttttgttaagctttattcaagtctctaaaataaacatctttgaagttttaaaggggttctagtggatgtttgtggtggaaatagtaaagttctacagagaaaacttcttattcaacttgggcaaggtaaaaccgtgggacgaagcgaagctgggtcagttgtgtacataggaacttacatgggaaaagttttaacagtatgacatcagtagccacatttggtgaaagaaactactgtcccttacaaatgtctgacctagaagctaccaccactgtgggaacttgcaagctctcacccccttacgtggagtttgtacgcggctttctgtcttctcacagaaaaaaaatgtgtgaatggttattaggtttttctagtgagttaagctgtagtgatggctctcagatgtctcacaaaacagtgttctatcactaacaaaaaaactgttaggtaaaaattttagcactctttttattttgtacatttactcgggacctgttgagaatggtttgtcagaccaagtgataaatatctggtccctggtaaaataaacgattaaatagcaaacagtgtaagtagaagcagtaactcatacttaattctaaaacagaatccattgatgtgacagtattgaaatggctagaatataggatacaaggcattcctgatgctctccatcccaagggatagctgttagacacatagttggggtaaataaagagcaaaaagcctaatggatttattattttggctcatcagaatgcttttctagtcgggtacagagacacatacctctagtcccagatcctcaggaggctgaggcaggagaaccgcttgaggccagcctgggcaacacagcaagaccccccatctctttatttttcttttttttaaaaagtctttctttcacaaaatggctatacaaaacatggatcaacaagttgtttttaaaaagttcctgtgctcaggattgtgacaccatattgcatacacctagtattctctattattaaagttactcctgttagtgtaattaaatatgcaattagtactttatgacctagaaatgtaaaaagtgctttgtcacctgagcaaagtataggaactccttggcttatggtataaagttgtggagggctggaagc

SEQ ID NO: 118427 - DNA, 1077 bp, Homo sapiens
ctcctgaactcaagcaatttgcccaccttggcctcccaaagtgctgggattataggcgtgagccgacacgcctggccaagccagactttttaaaatcttatgtgacacttttgaggaagatagggcactcgttttgtagatgctttctcattttgcatttgtctggtattttctcatgactatattcaaattatacattttagctagaatatcctataagttataatgagacctaacacttcttgtggtaatctatatgctaagcactgtggatgtgtccacactcttaataactaacaatgttgcctgctaaaaatcacctagacttgggaggctgaggcaggagaatcgcttgaacccaggaggcggaggttgcagtgagccgagattgcgccattgcattgcgccattgcactccagcctgagcaacaagagcgaaactccatctcaaaaaaaaaataacctagaaagtgtatggcaaaatcttgattcttgtcatgtgaatgccttcctggatgtactttgttttgttttttgttattagtagtagcagcagtgatgtctttcctttgccttttagagagcagccctgagtctccagtgaccattacagagccctaccggaccctctcagggcatacggccaagattaccagtgtggcgtggagcccacatcatgatggaaggctggtatctgcttcctatgatggtacagcccaggtactattgtgtccttgtccctgtgggtccttcactgtgtactctaacaaattctttcttcttttcccccagttgtgaacaggttccccctcccccattatcatcatctactgaaggagattttctgggctctaggaggcattttagtttcattccacatagggcctaggctaagactgggtttttttttttgttacttagatgaaggggaaagtattgataggagctagctaactctaacatttttacagatttcattctgactcactatcagtatggtggactaatatgatatgcaaagtactctcttctgttcagacactgaaatgttggctaaaaatcacaaaacaatttttt

SEQ ID NO: 118428 - DNA, 1164 bp, Homo sapiens
acatatcattaccacaacaaccttcaaaaatgctcttaggagtacgccttctttaaaagacaatcacaaactgaaaatctctctaccctgaaatcttgtctcaatttaggaaatgtgatgttaatggcacagagtaagtctaaaatgacttctcatcttttacatgaccgtaaagtgaatacatttgggtggtgataatatatgttctggctagatgggtaagagtaacattttttggggggtaaaatatgtttgggacttaatcgttttggtagtaaatgtcattatttgatatttaaatataatttaaatgtaaatattatatgataattaactgctttacagtcaactatttggagcaagatattgttgaattatttttctccaattattagtagttatgtttataatggggaccttttagaaaaagatggtctgtttttcattatgcctttttgtttaaatctccatttgttctctctccctgctcttctaaaggcctccacagatttctagcacatatcataagaagactgtatatactttagcctgggggccaccagtaccccccatgtcacttggtaagtatctgaacaattccataacaaatatgagagtattcttccttcagtttaatcctaaaatattaaagatggaaagagtcataaatggtctagtgcactgactgcttatgtgggctacttatgtccccaggggttcatgaagacagtagtggcagatgataaatcacagttcctgggagaaaccatttacccataataagcttccccaaactcactaaagcattgttcttctatttgatctgaaatttttcattgtatgtatagttatcatgctgggtcctgatacccagtctaatattcttcactaaaacttgctgtctctttttaattttatcagaattagaatgatacttcagtatattaatggaataatatctattttcacccacaggaaaagcaaacttagagtttctgaaatgatctcttgcctttgattcagcattctgctcctttccctcttctagcccctcagccttgtctttctttttcttattcctaaagtaatgagtcttttctattagctttttacataagtgtattcatcaaaagtctctgataaacttttcttaaccatctatga

SEQ ID NO: 118429 - DNA, 1050 bp, Homo sapiens
tcttcttccttagagtttgccaaatgagggggttaccagtgctataataggacagaaagaccaccgaacttggagacaggaggcgtgggttctggtttattaattgtgtaaccctgaattcacgtgacatctttgggaataaatatattttaagatccctttaagcaacataatttattactattttttttttcttagcagtgctttcttcaattcctgctggaagacatgcattatccttacccagtctttgagcctatcccatttgacatatcaggttttttttcctatttctctgttcttttttatgtttaggcccttaccgttaatctttgcaggtaaaatgttgggacatagccaccttggagtgcagctggacccttccttcccttggtgggtttgcatacagcctggctttctcttctgtggacataggctctttggccataggtgttggggatggcatgatccgtgtatggaatacactctccataaagaacaactatgatgtgaaaaatttttggcaaggcgtgaagtccaaggttacagcggtaaggattctttttttgagcttgttttgaacttttttttttccaaataattctcttttatgcctgttcatttaaatgcgctctgttgagaatcaaaagttttaaagtattttcaatgaagtttgaaactaggaaagcagaatgatcctgtaaccaaacccattatcctccagagtttaaatttattaaggctctgttcatctcagcattttttctaatagtaagaagttagaaatagcctgactgtatattcatagaaaatgcgttaagttataagataaccaaatgttggaatggcatcaaattattgaaaatgataatgtagattccttcttccttgatgtggaaaggtatataaatgatttatgaaaaatgtcaattataaaacatggaaagcaggttataaaacagtatgtgtaatttttttggttttctctaaaatgatacctttcttttggctattgaatctaaaggtaataaatttttatggtttaaaaag

SEQ ID NO: 118430 - DNA, 1050 bp, Homo sapiens
accattttgttaatatcgtgttgctatagaagtactactaataagtattaattacttttttttttttttttgagacggagtctggctctgtcgcccaggctggagtgcaatggcgggatcttggctcactgcaagctccgcctcctgggttgacgccattctcctgcctcagcctctcgagtagctggaactacaggagcccaccaccacgcccggctaatttttttatgtttttagcagagatggggtttcaccatgttagccaggatggtctcgatctccttacctggtgatccacccgcctcggcctcccaaagtgctgggattacaggcgtgagccaccgcgcccggccgtattaattacttttaatgtgtatatgtagcattatgctggtttgtgatacaagttaaaaattaagtagaacttcagcattgacaataacaaatttttgttttgttttaaagcatacgatatcaacattacattggtctcctcgagtaaaggacttaatagtatctggggatgaaaaaggagtagttttctgttactggtttaacagaaatgacagccagcacctctttatagaacccaggacaattttctgtcttacttgttcacctcatcatgaagatttagtagccattgggtaagtactatgccatctgtattgatgatttttgtttgtttatgatcgtgttttgcattttctttaccttctctgtccttttattcctcaaaggaaaccatctacagatgttaaccactccccctgagcccctggcatcatttattcctccaggtctttactgtctctgccactccgtttttgtttccttggtttccatggtactgtactttcttcgtttttcggatctaactcctccaatcaacctttacgtgtaggaaatgtcctctttcacctttttcgctttctctactgcccgttgatacaacatgaactcccaggtgtcagatgactttgctgggtctctctagttctgagcgctccctttagattgggaaagtgatgcggcattgggatctgtttc

SEQ ID NO: 118431 - DNA, 1101 bp, Homo sapiens
tgcaggccctaagcaagatcctgcaacgtgtggcattccttactgtaagatgaatgggttgaaccagatgctttcaggctccaaactaggctttgattgtgccttaggatatgacatgccaggtgatttattctggccacatctaaataagagtcactttcacattatttgagctgctttccagtctgtgaactaagcagagcaaggtatatcaacattcatttcacagttgagaagctgaggctcagagacttgttcgaagtcacgtggcacagccaatatcagcacttgggaattctgagtgtaagtccgtcggtgtttcagttataccatgggttaagtaactccaaagcatctgctcacttgtcatccaacaacagtatgattctgccaggaaccttggatagcacttcgattaacctagcgtctggttttgcttaaagtcataggagagttggtgggacacaccgaaagggtctctggcttcacattttctcatcaccctggtcagtacaacctctgtgccaccagctccgacgatgggactgtgaaaatatgggatgtagagacaaaaacagttgtgacagaacatgcactccatcaggtaccatggcttactggtttctcaaaccgtttttatctatctgtgctgagggttcttctgttgcaagctagttttgctagctcatctgtgcaaagtaacttgtaattgtgttcattaattagataagaaactatattgtaagatgtctcaactttttttgaaaggagatatatacaaaccagaggttggcaaactgctctgtgcctgtttttgcaaataggttttattagaatacaaccacactaattcatttaagtattgtctatgactgctttcatgctacaagagttgagtagttgcaacaggcatggtatggcccacaaggtctaaaacaattaccctctggttattgatacaaatggactcctgatatagactgtaaatgcgtgaatgaaactcatttctaagctagatagttacttgatgtacctgccttttgagagaacaaaggaaaagacctacttaataagaactttgcattaagctatttaaaaaat

SEQ ID NO: 118432 - DNA, 1121 bp, Homo sapiens
tcccctctcccttcccctctcctcccctccctcccttctttccttccttccttccttccttccttccttccttccttccttccttccttccttccttccttccttccatctttcttcatggagtttagctctgttgcccaggctggagtgcagtggtgcaaacttgagtcactgcaacctccacctcccgggttcaagcaattctcctgcctcagcctcccgagtagctgagattacaggcaccagccaccatgcctggctaattttttgtatttttagtagagacagggtttcaccatgttggccgggctggccttgaactcctgacctcaggtgatccacctgcctcggcctcccaaagtgctgggattacaggtgtaagccactgcgcccagccaagcatgtggttttcacagaagcaccacctatatcatgtttgctacaccaactaaactgacctccaattccactgcatgtgaatctgctgggaaaaacaaagttccagaactgcagaagtttttccagaaatctgacagtgtgaccatccacctgaaacaaggcctgcctgaccaaatgcattatgggacagccatggtgctgaactgtgggagggaccatctactacctgatcgccctcttcatggcttcacagccctcaaactaaggagttagttaggttgcagaggactggtttgctttttggtgtaaaccctttgaattttcctttttcctttttcttttttttgagatggagtctcactctgttgcccaggcaggagtgcagtggcgccatcttggctcactgcaacctccgcctcctgggttcaagcgactctcctgcctcagtcacccaagtagctgggagtacaggagcccgctaccacacccagctaatttttgtattttttagtaaacacaggatttcgccatgttgggcaggctggtctcaaactcctcatctcaggtgatcctcctgcttcgacctcccagactgctgggattacaggcatgagccaccttgcccagcctgatttttcatttttgattgtttctgttaattttttttttttacttggatggcttacttaacattattgcaagaagaatagaaagatatgaag

SEQ ID NO: 118433 - DNA, 1096 bp, Homo sapiens
attctcagcccaaaagtttgaaaaactaataggctttcaggagtgagaaccaaggttagagataatctagtccaatcagtttgaagaagagatgaggaaactgaggctcagagggggaaagggacttgcctgaggtcatccagcaagttagtgccacagccagtgtgaatgccagtggtttctggctgctggcccaggactcttaatgcctgctgagagtgattaacacatgcttggtgagctacttgtttgctttgaaggcaggcttgcaagcataggtagatacacagcctgcaacagcacaattcccagatgaagctcttgctgaaaacgagagaagcagacctgaaattatttactgatcgggcaaactcctatagtcaagggtgtttgttggagagcatcttggcaggtcctagcccataaggttttatgggctttttggattcacagtctagttttcaaacaagaaaatgtgtctggagtaggatcctcctttgatgttcttgtatgtgatatttcaagaattagagatgtatggatgttcattgccaatcccctggcacagggtcattggcaaagtcatgatcagatgatgctcctctttcttcttaacccttttttagatgggaagcagtcaccttgggatccttctttctacccctgggatgctttggagtatgaccaaatggatcagcctaactacatcctcagacacagaaacatgtgcagtgtactttgacattgttaacacacagatctttatcacatggtgtcaatattatggagacagtaagacacagatcatcggtgtaatatatcgcacatgctcctttgaaaacattataatcagagctgacaaggcagaagaaatatctcaacctcgcatcttccctgcatcccaaaaagcttaccaaactaacccaaactaacaagactctgattattcaaggaaagaaggcccagattatgattcactttgcccttctaccataatcaggctgagattattggtgttattttctgatttggtatctaagggtcaagtgcaaggcagaggtacctctctttattcccctaacaccataacaaattg

SEQ ID NO: 118434 - DNA, 1061 bp, Homo sapiens
ttgatggaagtagaataattgaaattatagcatggggaattactactagacaattctgcctccctgccctaccttaaagaagcttctgctgtgatttccccattattaacctccactagctcaaacagaaataaaaggaaactgcatccaaatgtttgaaatgcattcatatatttttattgaatgacatatgtttttatttgtttattttagagacagggccttgctctgtcactcagggtggagtgcactggcacaatcatggctcactgcaacctcgacctcctgagcttaagtgatcctcctgcctcagcctcctgagtagctgggactacagacagaagccagcatgccctgcctatttttaggaacaaaagtatctctcaactcttagcaagatttttatttttatacattatagtgaaaagtgttgtagaaacatatctaggaccacttgatgttgagaaaatatttatattgaatgttttccttgcatttatttctgttaggaaaaaaatagcaatgaaaagcattattagtctgggtggttctttttcagatgcaaaaatcactcaaactgaaatcctttttatactcaaattgggcctgccagctttaaaagagggcagtcaggataatatgataaactggcccatgcgctcaatcttagctcatcaaggctgtgccagaactgacattttcgtacagtatggcttgatgctctgattacaaattggtcttgagcagctatactctttgtaattttattcactgagggattgtgtttgtatcattaggtctgttttggttttgaaacctgaagtaaaaaatacatcactggttgctgtctcttgttttggagtgtgatagagaaaaatattcatccagaaacaagtgtaatttattatatgcaaaattaagagttttgttttccttcaaggtgtcaacaaaagagtcaaatctgtgaaatatttcaagacatttattctgagccaaatgtgaggaccacgactcatgacacagccccagaaggtcctgagaacatgtgcccaaagtggttg

SEQ ID NO: 118435 - DNA, 1054 bp, Homo sapiens
aatacatccattttttttccatttaaagattctaaaatgatttcaacttttaaactaacttttagtttaaaagtttagtctgtctggggaggtgaagagtcttaggagcctaacaagcaagttatgaaacaaaccttcactgttacctttagaatctgggcacttgtaacaattttgtgtaatcaaatgccttcaaaatgaatgtacagatgtgctgcaaatagaaaagatatttttacaccatttacataaataatagttttgttgtgggtggattgttctacgaatgtacagaaagttaatgcattactcattcctttgcatcttgtcattccataggggagagagtttgtttaaacagagaccagagcctgcatattccgtatataattttcccttatctcatagatagttaaaaggagccaccctggagatgcatgaaaggatgcatttaatttgggaagaaaaaaataacctctatttgtcccttttaattagtatatgaagaaccagatttctctaagggtcctctttctagtctgtatttatagaacagcatcttaaaatggcagtttcccagaagaatgagaatttctaaaacatgccatgctttatatcataaaatagatatttaaaaagtacattacatttaataatgtttgagcagttagggatctttctttgtagagtagcaaacactgagggctctgtgggctaattttggcccttggccaaagttacttgggagtcctcaagtctgtgtgtgtgtgtaggtttgttttaattcatcccagttgtcatttgctagttcataacagcccttacccccacagcctgttgtattcatttactttctccaaatggcctctgcaagcatttggattggtgactcctggggcaaaagaaagatggtggtcttaggggatggggtaagaaatttagatgagatgatgcttcctctctggaattgctacagaactccttaggtacttaggattgaccgtttttgtttttgttttaaacaaaaagtgattctttgactgttttatattcg

SEQ ID NO: 118436 - DNA, 1022 bp, Homo sapiens
ggtgtgtgtatctacatgtgtttagggctagagttttgcatatatgaccttatttcttcatgtcgaatagataattattcaaataccattgagctgggtgtgttggcatgcacctatatcccagctacttgggaggctaaggtgagtggatcactttagcccatgagtttgaatccaaccaaggcaacatagcaagattccatttctaaaatcaaataataataataataaaataaaaaccaccattggctggaaagtcctgactctaaacacatctattatactaaatgtgtctcaagtccctgaaatttgaagcacaggagacaactctgccacacttcaaataaagaaggatgttgtgagagatttcctggcactgtccatatcaatccaagtaagaaattctgtagcattcaatttaataaccaactaagggaaaaactattctttcacatggaggaccatggtccacacagagccatttttaagagtgctagagtaaagggcaaagagtgaggatgttgaagtcaggctaaatacaaatcccagtccaactactcgctcactaagttaccaaccactctatgcctcagattccttctctacacagcagggactataacagtgcctatttcataagactattgggataattaagtgaattaataaaggcagagtacctagcatggtgtctctcaatccaagtgctcggtaaattattattactaaatgaaaggaaaacacattatttttatttcctatgtgaacataacaatcatcgatacagcatatttgcaaggccaagtttttacttggacttgctccaagaactcctagacttcttatctaggtctgcacctgcccttactggaaaagatctttttttaatgtctcctttgtttcttctagacatacatagtgtcctaagaaagatagaaagaataaacacagttcagaggcagaaaagaacagatagatggctcaacattagaaatatctaactgaattttaaagttcgcact

SEQ ID NO: 118437 - DNA, 1031 bp, Homo sapiens
ctcaattctatcagaatgtcaaacctatactgacacccactccactctacagtcttctatgatacaaccagcttagcatgcttggtgcagaacactaggtgcatggcaattaagatgtgtccctgttcagagggaggctccatagctgctgggtttctctactaaagtctaaaagacatgagagtatcatcacgagataatggacagcttgctgagagacaggtcaaaattatgaaagaagactatattatttattcatttttataaaaaactttgaatttcaaaacctcgaccaaggttttcagcttttcatcagggtagatgagttaacttggcaaggatacttggtagtagtttgacactcagcatcagtattccactttctccagtagcccttcagtgcttcaggaataaggaaacatttaaaaactgcattcctcagattcccatgtacgacatgtgcctgtatgtttttaaacaaatacatatataagtatatatagatttactatattttcttaatggtgacatagttttaatttattcttcatgcattcaacacatatttattatacaccctttatgtaccccatactgttctggaaacatggtctctgcattcatggcacttacaagctctctgttatgaaaacagacaataagtacattttaaagtgtgtaataaaatatgtataaataataaaaatgtatacattagctagcaaaattaataacaatattgatatagtaataatccaaagcataaatgtaccaatatttacataacatccctctagtgataaacatttaggtttttttcagatttttgcttttaaaccacaaaatgatgagcatccttgtggctgcatctttgctttcatgtgcaaatgtgttactgtgaaagaactttctaaagtttcacaatggtgggttttattatttgcaggaaatattcacataccagatggttatttggactatgaaatgtaaggccctgccagactgtgagacttttctaattccaagattta

SEQ ID NO: 118438 - DNA, 1036 bp, Homo sapiens
ggcaaagtacctaatcttctctgacccttcctttactcatttgtactagtgagattagcaatacttgtgttgaaaagttgtaataaagattagagataaccagaaagtagagtatggtaggcactcagtgctagtttttatccctgtcaacttaaaacatttggagaattgtcttacaaagaggaaaataagtttcagttgctaaaattcagcacagagtcataagctcatgtttaaaggaatgactaatagagtcttaaaagcatatgtaacttgggtgttgctgaaaatcatcattactgtaagaaatacggtgactcaaatattttatatgtacacattattgctggttcaacttaaaataggactctgtgaaacacagtaaactatagctattctggtgcatgagatggcctataaagaggtaaactaaaataattattggttgtgatgcatcctctgaagtctacagagagagatgacaacgtgaaattgcatgtggattactttggacatggatcagcatttgcctccctggaaaggcaaattttagtagaagcctaaaggaatgatactgagacagtcatgggaagagctgggcaagattttaggccgaaggaaaagcaagttcaaaagccctgattgagaaaggacttagagtaggctgtctatgtgtagtgtcaagaaaagggaattgccattcagacagtctccactgtaggaacacacaccctaagtaggagccaatgaagaagcaacacacatgtacttgagtctccacactgcactatgtcattcatgagaggccatttgacctttactggcttatttctgatttgtatggtgtgatgcttacatcaggtggttcaaaatctctgccttcttggaagccctcttcaaagccaatattcctatttgtcaataaaggttgagtgttcaaatggtttagaaatagcattcgaggctggcacgtggtggctcatgcctgtaatgccagcactttgggaggcccaggcgggcggatcatgaggtcaag

SEQ ID NO: 118439 - DNA, 1015 bp, Homo sapiens
aacagaaagaggccaatcctgctggagtagtaataatatggagaaacccagtaagaaagaaaaatattgaggaggtagtagcagaccggatcatgtaggatcttgtagttaggagtttgaatttaagcctagctgtgacaaaaagccattgaaggatttttttcccccatgagagtgacataatctgtgttgaatttgaaaaggattacctgactgctctgaggataatagaatttaggagggcaagagtagaagcaggaaaatcaatatggactaaaacagctatgtttacatttccaagatatgttcatttttaattatctttttaatttgatttataatttaatggcactaaagtcagaaaatgtattctgtgtggcactgttgtttggcatttctttgtgaactaggacattatttttgcaaatggtttagtataattgaaaataacgtagattctcaatttcttgggtgcagagctctacacatccattagttcaaactagttaaatatgagcattcagggtgtccacattcttgctattatttggtcagcagaatctatcattttctaatagatttttgttaaaatttaatgctagcatttgctaaatttccttcatacttctgacaacttttaattaatgtgttttaagctacattgatagatacatacctagtcatgatttatagcttccagtcatattttgttgtttttatatgcagtctctgtggagtacatgaatgctttttgccttaaatactgttttgtctaatactaattttgatacccagctttctttttaacttttaagttcaggggtacatgcacagcatgtgcagatttgttacataggtaaatgtatgtcatgagggtttattgtacaggttatttcatcacccaggtattaaacctattaatagtatccatgagttatctttcctgatcctttccttcctcccaccctccaccctctgataggccccagtgggtggtgttccccagctttctctt

SEQ ID NO: 118440 - DNA, 1014 bp, Homo sapiens
ttcttgtgatagtgagttctcatgacatctgatggttttttaaggggcttttccccattttgctcagcacttctctctcctgccaccatgtgaagaaggacatatttgcatccccctccaccatgattgtaagtttcctgagtcctcccccaagccatgctgaaccatgagtcaattaaacctctttcctttataaattacccgatcttgggtatgtctttattagcagcatgagaacagactaattacataaggccaatggtagacagttgctggcagcttcatggtatctgagtgaacatatctgaagtccccttggtctttttctcatggtcagaagatgagatgactcaggcagctccagatatcatgctgatattcagataaaaacactgaaactagccacatccttaccctcttgtggacagtaaaactttctcagtgctcctccccagtagacagctacctacatctctttgaacaaagtcatgtcatatgtccacccctagcttcaagggagtctgggaaagtatttagctggacattttgctcccataaataatactaggattttcttggccaggggaaagggggaaatggttgttgacaaggaaatgacatgctggccatactggggatgaagtcagtggacaaggtaaaaaattacataatcaaaattatctataaatcacctataaagcatgctcattttaaagctttcgtaacaggactgtattccgaaattaaatcatttaagtgttttaatgctttgaaaccttcaattctttgtccagatttctacttgctggttcttaattttcaggtcatcatcatcttcatctctcgtaaatgattttgtaagtttctccaattattttttagacagtgtttctctgtggtcctcaattaatgtttcaatttctttcaccataggaaggcatcaccacccacttgcctggccacaggaacagcgtgttctactttttcaaagaccaggaaattcttaaaatcata

SEQ ID NO: 118441 - DNA, 1051 bp, Homo sapiens
atttactgaaaaacttttgctagtcattaggcaaatacttcactgttctaccatctaacccactgcgtagatgtcatatgtgttatgtgatttgtgccatgcattgcaataagagagctttggttgctgtttttcaaaacatttccggttgggtgactattaatagtttctgagagacaagagtcagaccttaccatttctaggcatcttttcctttctgaagccgagatggaatttgcctcatggcctcactctgatctcagcaagaatgctttcaaaagaagttccttgtttttcaaaggctgtttgcatgagtgattcaatgctttcctatcatggagctctaaagccagtggaaaaatatgtgggtatggggttgtgtaatggattcgctgcatttagctccaatcagtgtgctgattgtgcctacaggtgactccagtatctccaatctctgtttgcttttctgttttgtttacaggagcggagggcacagtgttccctaaatctatagaaacacctaatgtcagggcagaccccttcaaagaactaaggtaaacttctgactttggtttgcattgattaatggctattgccttgctctgtgcaactggccagtgattcattctgaataaataataagtgtcacagcgtgaatacataaattgaaagaggttggagagaaccagaagataagctacaaccaaaagaaaattttctatgagaacttaaaattgaggatctggatggggtaaaaggttgcccactttgtgaaatctagattcattcatttggaatgtttgttatgtgctgtattttgtggtacccaaaacctatccagttagagaactagttggtaattggtgctgatcagcccaaagaaaaatgatatctaaaagaagatgaagtctaaatacaatacgatgtcttattatgcaacaagctctctattacttggggtggtatggtactagaaagaacccccttctgcagatgttccaggtgctgatgttaatcttcaaatattcataaatgtgctgccttagcagag

SEQ ID NO: 118442 - DNA, 1060 bp, Homo sapiens
gcctgtaatcccagcactttgggaggtggaggcgggcagatcacgaggtcaggagatcgagacaatcgtgactaagacggtgaaaccccgactctactaaaaatacaaaaaattagccgggcgtggtggcgggcgcctgtagtcccagctactcgggaggctgaggcaggagaatggcgtgaacctgggaggcggagcttgcagtgagccgagatcgtgccactgcactccagcctgggcaacaatgcgagactccatctcagaaaaaaaaagaaaacacacacacacacacacacaccaatgacaaaacattcagaaagggtagatatttgtacaagtcaaatgactgatctgtgtgcctggtgttggcactcagatcagtcgtattccagagcgtgtgctctcaacaaagtcaatggttatcaaggtttgaatgatcccaggtcttcaggaaagagaacgcagttacctgttgtgtaagagtacaatggtgagctggtgggttctctccttattgctccctgcagtgtcgtagggtgggtttctgctggctgaggtgaagatggtgaagtggctactggaatgaaaagaatggaagaattgttccatttgtggaggaaaatgtgcaccccaagaaaaataaagaacaaaactagaatcaggaattaccatcacctttccatgggcccttctcctggccttccacagtgggcatgcagggcttctaccgacccacttctgaacctttcggctcctcttagaaatgtattcaaagatggccttcaggcattgccctgctatctaattatctcattaacatgaggaaatgcgatctagataatgttccacatagtcaatatatacgattatctcaaactttctatactcccaggttccctctaaatagacaaagccaacaacagggcattttatgtagaatacccaattaagctttattttattcatacaagtgatatttcactttcagaaaatgggggcttaggaatttgcactaacatgccctacccccttcacaacagccccattctgggtttcctgg

SEQ ID NO: 118443 - DNA, 1039 bp, Homo sapiens
ataagtaatctagagatgatttaaagcatatgggactatgtgcatagtttacatgcaaatactacaccattttatatagggacttgagcatctgcagattttggtatcaagggggtcctggaaacaatttcccatagatatcaaggaacaattgtactgctgtaggagctagtttgctgattctagcctgaccttgaattatgcttggccttgtaacttcatctacacaaaagttattctatttcccaagaacaagagtttatttaaaaacaggacttacgggaacctcctctttccctattaagaaaaaagaaaattactaccgaacagaaaattcaattaactagcaagaaatatcaaagaaaaacttacgtggcacaatctccaatgatacggtgattttcatgtcattgaaccacccacggtgctcaacacggcaacaatatacgccactgtcagacacagctgtattttctatggtcaaagagacatcccttcttgaaaggtcccccaatagcttatagcgtgtgtccttccgataggtgacgtgggttccattggtccagacaatgccattttggcatgtgaatagagaacatgagcctctattccagcacatggatgtgacagctccactgtagtggcagggtagtgtgacagatggacctgcctctccaccaacctttacagaaccagctacagaatctgcaaagaagaaaagacaaactgagaatgagccctcactatttcatcttggctgggcacaatggctcacgcctgtaatccaagaactttgggagaccaaggcaggcagatcaacccaggtcaggagttcaagaccagcctagccaacatggcaaaacccgatctctactaaaaaaaaaattacaaaaattagcggggtgtagtggtgtaatcccagctactcaggaggctaaggcagggagaagtgcttgaacctgggaggcggaggttgcagcaagctgagctcgtgccactacactccagcctgggtgacagagcagactctgtctccccc

SEQ ID NO: 118444 - DNA, 1023 bp, Homo sapiens
gcttagctcccaagcctccccctccaataaaagacagttacatgatgtttggcaatcagttccaatgtgatgatcttatcatccgccctttggaaagtcagggcatcgaacggcttcatcctatgcagtttgatcacaagaaagaactgagaaaacttaatatgtctatccttattaatttcttggaccttttagatattttaataaggagccctgggagtataaaacgagaagagaaactagaagatcttaagctgctttttgtacacgtgcatcatcttataaatgaataccgaccccaccaagcaagagagaccttgagagtcatgatggaggtccagaaacgtcaacggcttgaaacagctgagagatttcaaaagcacctggaacgagtaattgaaatgattcagaattgcttggcttctttgcctgatgatttgcctcattcagaagcaggaatgagagtaaaaactgaaccaatggatgctgatgatagcaacaattgtactggacagaatgaacatcaaagagaaaattcaggtcataggagagatcagattatagagaaagatgctgccttgtgtgtcctaattgatgagatgaatgaaagaccatgaaagatgtttctttttctttttttccttttgataatagcatcatatattagttcattttcttttggacagtcttaagagaagtttcactaaaaatgtaaacagctttaatcttgactccaaatttttcaattatgagatgtcataggcagtaatttcgctgtataacaagcatagacaaatgagtgtccctgcactaagaagaatcactttaaaaagcaaagtgttagctgctgttgtatgggacattcctatgttttagagttgcagtaaaactttgatgataacctcaataatagcaaagttttcgtctttgaaaaggggatttagcatttgctttaagaatgatagataaatggatattaagctctctacatgtaaaactatgaaatctttagacttattccat

SEQ ID NO: 118445 - DNA, 1076 bp, Homo sapiens
agcccggcagcggcgacatcctcgagtccaggtactgcagagcgctggcccctgcctctgccgccgtgaccaccgtcacctcccccagggccagcgagagccgcctgggcccgcctggcagccgcctcgggcacacagaacgtgtgatgggtggggcgaggggcgcagcgtcgatgtttgggggcggagggctttgatgagagaggagcaggtctgacccgcttggaagctttctggcctacactagcatcgctcaccaagctggctgcgggcacggtggaagtgggggaaggggatgagtgggctgactcctgggggaaaaggtggtttttttcttgagctctgaagaaccaggaagatgcttgcctgtctgttgtggcgtctacttttcaggtcagccctacccctcaccccaaagaacagcccacctatgtgcaaaagaagaggaggaggtgctctctgcttggggatgggggcaggtagcatgttccacataagtatggccctctatatccagaacccggctggaaaggacactgacagcccaggtgcctccccagcacagggaatctgattttgacctttgcttgcctactttccccagcacagtggaaacactcaccagggctgatgagccatcagctgtccttccagctaggccaagaatgggacaaggatctttttctgctagttcctgggtgcctgtgccctcagcatgggcagggagacggaggcaggcctgctggcaggaggggcaaatcaggagactgtcggttcctgtgttcccatttcctgcctcctgtctgtgtcccagttagggcagtgggtctcaccttactcttggatacaggctgtgccagcaacctgggtccctgagatcttagagggcaaaaatcaggtccatatctttgggcaggcctgtgaaggccttgatggttgctttctccaccattagaccctctctctgtggccctcctggtggcctcccacctccacttccatacagtgccctgcccttcccccagtctccagtgtcagaaatggttttcaagaaaggagccaatgattgtgtttat

SEQ ID NO: 118446 - DNA, 1068 bp, Homo sapiens
tcacttacttattgattctcttcaagggatgttcaggggtactattatgctacagaggagaacttaatggttattctggtaaatgagtatttttgtgtgtgtgtgtgtgatgaagttttgcccttgttgcccaggctggagtgcaatggcatgatcttggctcactgcaacctctgcctcctgggttcaagtgattttcctgcctcagtctcctgagtagctgggattacaggcacccaccaccacgcctggctaattttttttttttttttgtatttttagtagaaatgggatttctactaaagaaaaattgaccaggctggtcaggctggtctcgaactcctgacctcaggtgatccacccgtctcagcctcccaaagtgctgggattacaggcgtgagccaccacacccgtctgtaaatgagtattttttaagtttgagtagcccagaagaaacctagttacaggagaaaaaaagggaagttggataagagctgggagcttataaactgatctaggggattttatgaaaaatttgaaacatatataaaattggatggaaaaatacagtaatttctatgtatgtgtcacacacaatctatagttactaactcactgcgaatttgtttcatttctattcactcttcccccatctagtattatttagaagcaaaaccctgtgtccttttatctatattttagtagatctttctggaagatataggttcttttaaaacataaccttgatattatcaaacctaaatacaatatttccttcatattatcaaatatccagtcagtactaattttctaattttctcataaagttataattttatttgtatggtggtttgtttgaaataggatccaaataaggtccacacatgatagtgtgttcagtctcttcaaaatctatagactttcctcccatctctcttttctatctttgcaatttatttgttagaggtcctgagtcatttgtccagcagaatttgtcatagattgcattttgctgattacatcactggggtgtagcatgtttttctgccctcttatatttcctgtgag

SEQ ID NO: 118447 - DNA, 1032 bp, Homo sapiens
tttcagttgattatcttggctgtcacgatcctggataattgtattgcatggtaatttaagagtggaactcataaatatccttatgaagaacaaaaggtggagaaactaaccatgacctatgttctcacatcccacttgaggtccctcgcttgtggtcacgtgactgtgtgggcatcacataatttctctgagccttgatttttcatcagttatatggatagggtaccaccttccatgttgatcacagagggtggtggtgaggctcaaccaagtgcacacaaaataccttgttagccataaagagatcctgagatgtaaaagatacacatcgagagcaccttgggaagaagtggtgagtggaagtggcctcaatgcattttaactctctttattctcccaaaggatgctggtcatggtgcggttaagaggaattttagaggcccctgaaattctccactgaccttctcttccttcccttcagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggtaatggaaatggtagatagcaccagggggcccaggaattctggggatcccctaagagagtttgccctaaggcagagggaaggggaggtctgcatctagaaggtgaaaggttgtgagctgatggagtcccttgtgcgctggtagagccgagtataaggaacagattagctactaaatgtgccgcaggactgtttccctccctcccccagggaagtcttgttgatctgctttgaccccaaataccttcaggctattcttgctgctgtaccaaccaaggttttggcagctctggcctcatgaattaaatattgcaatttagaaaccccagagcctgcctgggtaattacttttccttcatgcatgtgaggagggcactacaacacctcatagcagctcatggctcagggaagc

SEQ ID NO: 118448 - DNA, 1008 bp, Homo sapiens
taaagggtcggggcatagagggtgtattcgttggcttggataccttaacaaagtgccacagactaaatggcttaaacagcaaaaatgtatttcctccccgttccggagattagaagtccaagatcaaggtgtctgtaggttcggtttttcctcagacttttttccttggctcccagatggctgtttctctctgcatcctcacatggtctcttctctgtgtgcacacatctctggcaccttctttctgtgtgtccagatttcctctttttataaggacaccagtcagattagatcagggccctctctaatggcctcattttaacttaattacctctttaaaggccccgtctccaaatacagtcacattctgaggtcctgtggggttagggcttcaacctataaatttggggggcacacaattcagcccataacagaaggctttagtttatttaataaaaaattaaaaacaatggaaaaatctttatccttaaaagagatatgaacagaacgcagcttgggggacagattccatgtgttagtcatatgtagaatgagttgcaagtaggaatgaggcaaataaattagtcaagataattaaagttatctacactgcaggcattcaaggctgaatgagggtgatggcactggggtacagctaagaggatatggatgtgagggacactggcttagcagtcacctgggactgcactgactgagttcccaggaagaccaggtcaagacaccaacagagcagtcggaaggaggggttaggttggagagtgatagtgttcattttctgttactgccctaatagagtgtcacaaacttagtggcttagaagaacactgatttatttgcttatagttttgtaggtcagaagtctgacgtgggtcttactgagttaaaatcagggtgccagcagggccgcattccttctgcaggctccaggagaaagtctgttcccttgccttttccagcttctagaggtgtctacattccttgactcgt

SEQ ID NO: 118449 - DNA, 1053 bp, Homo sapiens
tcgggccaggtatggtggctcatgcctgtaatcagtcccagcactttgggaggccgaggcaggtgggtcacaaggtcacgagattgagaccagcctgaccaacatggtgaaaccccgtctctactaaaaatagaaaaattagctgggcatggtggcacacacctgtaatcccagctactcgggaggctgaggcaggagaattgcttgaacctgggaagtggaggttgcagtgagccgagatcgcaccgctgcactccagcctggtgacgaagcaagactccgtctcaaaaaaaaaaaaaaaagaaaaaaagaaattagcttcggatttaaggactcctctgagaaaaattgcctggcagatttgcctttctcgagagggctggctctgaggagggccctagaggagcctggaccctgcccccataagggagcacagtggaccttactcactgcccctctgcccccagcgcaaggccatcgagcggttctgcagcgaggtgaagcggctgtgccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagaggtcagggcaacctccccctctcccctttccccatccaggcccctcctccagggctgcctgtcaagtggaggaagagaatggagcccctctcacctgctttttctttgataccaaactagccatcccccaaacatagtgaggcttggcctgtttcagtgtggtttgaggaacagggcatagagctgggccttggaagaacttgatctttgtagagttttatatctcaagatggaatcaaaccctcagttcccccatctctggagcagcagcattttatgttgccccatgtaatatgggaccagtaagatcatcacaaaatggttacattagtcattttctgcaagaatcataaagccaattcaaacagtgtatgtaaaagaaggaaatgaattggctcacagaaa

SEQ ID NO: 118450 - DNA, 1002 bp, Homo sapiens
tgtagctccaaagatcccaagagtaggaagaggaggagaatagaatggcagggcctccagctgccattgatggaggcatttatgccctagaaggctgctgcatgaaagccacacatcgttccaagttgcaggattcagctgggatttggctaggaggaggccctgtgattcttttctgaatgctgcttttttttttttttcctgaagtcccttgtcacttaaagaggtacatcccagaagacagcacctgctctaatttccagtataaatcagagctcgcagaagtagaatgattaaagactggattttaaattggttcacatttgcaaaatcacagcctctcacctggtacaccagggaccacctcagcttgcccttacctctggatagaatgcctcagcaacgttcatcatatactcactgtgtttcagtgcctctgagagttgatcttttggccacagatctttaaaaatttgcagttaaactaagcctcttagaattttgcaaaggaatcttacactttggaattaacttcccatgttctcagtttattctagcattgggcactgccgacatggagcaagcctgagaggtcagtcatgggaaagcccagattaatattcacagcagaactcagtggtgtgacatggagggcattagatcgagcctgagtcccactgactcttcaaggttaaggaaaaggaacataagtcactaagaggaatcctgtgccttggctttgcttgttttcaagggtggaacttttacttttctctagagttgccccagatgaaaatagggctcattttgggagacccttgcaaaatcttccctaagtcagcatgaatgagatgagggtagaagagaaatacaacctctcccttggcaggcctgggtgtaagtctggctctgccacttaatagctggatgacgttgggaaagtcactaaatcactgaaactgagttccaagtctgaaaaatatgaataccaagggtatcggc

SEQ ID NO: 118451 - DNA, 1048 bp, Homo sapiens
tctttccagaaggaagcactgagttgacaagaaatgaggccatatgtcccaccacagggagagctcagccagacagaatcatttaattcagccttgcagataaattctgaagtttcccagcccaactgcccttcctatgccttgtcagcctcataacagctatgctcagaaaagaatcatctcaggagcaggtagcttgtattcttaactgctacctgatgtgttttagtcccaaatgaatttttacaagtcttggttttatttgcaccctggactttttctttggactgactgtaaagtaagttgcttctaagcggtggaggctcaaggaacgtaagagagggatgaaagatggtcttttcctgactgtgaacttgtttctatttcccaagcaagtataaagctgtcttccttaaggggggttattagcaagcggctggctgtgtttttccctcttcaggtatgtcctctaccctctggatctgtacaacgacagcgcctactatgctctgaccaagtttaaaaagcagttcctgtacgatgagatagaagctgaggcaagtgatgtgcttctctttttgctcctttaatcttgttccaaattccggacttttccagtcttttgctattagcatgaagtaggagtatcagtgacttgttctggagaggaatctctgtaaccatggccatcagaaggcctgtgtaacctctgagggcagaagtacaaactgagacacccagctcagggcctgctgcctttctcttcccacccacaaactctgtgctgcaccatgaagggcttcatgtgcatgtgtataaatacccaagctctgcctgccaactctgctcaaaaacagtggcccttggctagacctaaaccctagggtcacacacacccatagtggagtccaccctcagaggggaagccagggaagagagcacgtggccctggaagaggcttgagccgcctgtagaaggcttctcagaactggttctagaaggggagaatggggcctgagtgcacacgcccaccttgaccttatggatt

SEQ ID NO: 118452 - DNA, 1157 bp, Homo sapiens
caacctggccaacatggtgaaaccccgtctctactaaaaatacaaaaattagccaggcatggtggtgggtgcctgtaatcccagctacttgggaggctgaaggatgagaatcacttgaacccgggaggcggaggttgcagtgagccgagatcacaccactgcactccagcctaggtgacagagcaagactctgtctcaaaaaaaaaaaaaattgcaaatcaaagaaaaatacaatgaaaataacatccatctgaagagatggatggggaggctgccgagttagcggacgaatttgagcactgatgggttctgacagtctgtctgttgcatccctccaggcaggcggcctcgaaacagctgaggagaggggccgtggggagattgggtcctttttgaactttgacttgtctgttcactgactgaggaccctgagagcaagggaccaaatctcccaaacttagccacagaatatttttccccttcaaagcgtctttccccagaatgcactctgggcaatcctgcctgactgctgtctttcagttggctcagtttctgtcataaagctgaacgggcaccagtgatgtttcctgcttcctctccaccaggtgaacctgtgttttgatcagtttgtctacaagctggcagaccagatctttgcttactacaaagccatggctggcaggtaggaaagccccagagctgtgagtagcaatctcttaagactgccacctagaagacatgattttctgttgtgaaacctcccttcttctttagcaccttaggaaaacagagccattccacggacccggactgggtgctgagatagagtggaaaggaaactaggcagataaagggctaacctcacacagcctgcagtccagcaggaaagacagacatcgactaaaagccgatgaatgcacagtgacaaggaggttacatgctgtctgtgagggaaaagctcatgggaatgtacgatggttaaacctttgggggcggggaactagaaaggccatcttgcggaagtggcatctgagttcttatctgaagttggtaggagtgaaggaagtaaaacgaggtgaaggatggggcaggacgttgcaggcaaaaggaactgcttgtgcaaggaccctgcggtgggagtatgatgataacagcat

SEQ ID NO: 118453 - DNA, 1352 bp, Homo sapiens
ctggccatctttccttttcttaaatgtaaccaagcttgttgtgtaaatgatagtgttcccttagatctttccaattttatcattcaggtctctgtttagcaaaacttctttagagagactttggacttcctaactccaaatgatcccattttcttattttcaaagcacttctcctctgcaatccatgcctcagtgtgaaagatagtaacactctcagctcatagggttgtggtgagatttaaaatgtgtgtgtgtgtgtgtgtgtgtgtgtgtgtgtgtgtgtgtgtgtttgtgtttaaagtgcctgggaaataataaacactatgcaactgttacctattatctgaaattattccattcctctgtttgtgtttatattatcagtctttcctcactcgaatataaactccatgaggacaggaactttgtattcccagtacccagaatgtttcctgggatacaccaagcaggcactcaattgcttttgcagtaaatgaataaaagaggaaagtggctcaacttctgtgttgcccatctttaacttagaaactctgtttcacatattgagcttctgtgactgaaaagaaatttgacgtaacttgtctagagcagaaaacaattttacttaagttatataagatagtgctctgtgggtagatcctatgatctgaaatagatgtatctgggcagttgagagtcattcacaatctgtttactggccttgtttcacttttattccttgcagtgtcctgttggataaacgttttcgagctgagtgtaagaattatggcgtcatcattccgtatccaccgtccaatcgctatgaaacactgctgaagcagagacacgtccaggtatggggagcagaagccaccttggagatggaaggggcaggagagagcagctgcgaagttagcatagagatcagaaatcaggcctgggtattgtctgcccggcatgttgccagtgtggatttccgagcctgggtgtagcacagcctcaggatctcataaacaataaagaggcattgggcttcctttggctcaagttctgggcttctccacccatctatagccaacctctgacaagttatggcaaccaaagcctttgtcttctcatcataacctgcagcccacttttttcagctgggactgccacttagagatgggtaaatctgtccctgaacagggcccaagtgccggtctaagtgaggaagactgtggcgcctttgaaatgaaagcatgtcagggcaaatccacggtagaaattgggttttttgtgtgcagagttggtttctattaacatttgaccctatatgtagaggagatgttgctgggaactgagaaacatcc

SEQ ID NO: 118454 - DNA, 1052 bp, Homo sapiens
atgaccatgaaaaattaggcttgcagactgtttaaagggtaggtaaagcagggtttaattgggtgaaaagggaaaaaaaggagggaaacagggactctcacaaggccagagtccctcagctagagagcttcccgccaggccgttggaatcccaggttccacacaagaagaggaggggccaggctcctccctgctgcaaacatcataaacttcccgaggctccacctcaatggacaggctggttggagtttctccaggaaacccctcccacctggcagtctcactcccaccttggtcccccaaagtgctgggattacaggcatgagccactgcacctggccagtgtgaattttaagtaacttttctctctctctcttcatccagctgttgggtagatcaattgacttgaacagactcattacccagcgcatctctgccgccatgtataaatccttggaccaagctatcagccgctttgagagtgaggacctgacctccattgtggtaagagtctgggagcgtgtgggatttctgctctgtgatttctcagactagaagcctagatggggactgtagttagtctagtgctgggccagttaaagaggggcagtgagtctctttcccatctgaatggagctgggaaagaaaaacttacacagaataagagtaatcttacgttcctgattgccttgggaacgatagcatggagggggtctccttgagatttctagagatggccaaccctcagacacagctgcatgtccttaggatcctgcaggctgagcaagtaggtgaggggtcctaagaagctagggaaaattgcacaagagggttggcttcacaggtgtgcagtagtataaggcccagaagggctttgcagctggtttaccattctgcttcactatcttgaaattcttaaacaagggggccccacattttcattaaacattgcaccctgcagattatgtaactggttctgatgcacaagcctggaataggcctactcctttctcccagaaaacagcaattaaaacgactctctgctaattctct

SEQ ID NO: 118455 - DNA, 1073 bp, Homo sapiens
ttccttatctatagaaatggagggaatatcagaatccacctcttagggttactataaggataaaatgagatactacctgtttttttgtttgtttgtttttgttttgttttcttttgagacggagtcttgctctgttgcctaggctgtagtgcagtggcgtgatctcagctcactgcaacctctgcctccagggttcaagcaattctcctgcctcagcctcctgagtagctgggactacaggcatgtgccaccaggcccacctaatttttgtatttttagtagagatggggtttcactatgttggccaggctggtctcaagctcctgacctcgtgatctgcctgccttggcctcccaagagtcttttgtatacatagttagcacttaataaataatagcttatggaaaaaagatgagagaaaaataaatttggggctgcaatgcagtgattttgggtgatttcttagggcttgacctacccacccacctaagtcctgggtcacttactccaggagactgtagtacagcacacatttttctgagaaatcatttggtcacctctattttgagaaacagagttattctttatgccaaatggttagcagtgattagctccaagtggcgggatttttttttcttttttgtttatctgtatcttctagttttccaataatgagcatatcttatgggaaaaaaaagatttgggatatgtgtgtctccatggcctcttcccacctgtccaaaagcactaaatgttcttttagctgggaacaaaatcaaaacaagcagtgaaagcccttgcttatcaggcgagggcagtggctccccagagaacaccagttcctgggaagcccatgaagagacctcagggaagcgctctccgatgggtctggatggcccctgctcgccctggctgagaagcttctacctcctccaagaaacaaaatgaggaatgagctcccctcagcctttccctccacctgaaaaactccattctgagatggggaggcaacttgattctgagttgggagaggttgcaaagatttggggagttagtcaccctcattttacaca

SEQ ID NO: 118456 - DNA, 1079 bp, Homo sapiens
tgtgaagcaggccagcagaatggccatcagcacccaaagggagatctgggggtctaccagggagcttccaggagccagcggactcttatccagggtgtggaacatggtgcagtagtgcctgtaagggaaggcagccttcttacagctgatgcacaggaagtagagagtggaaggggcaagatgttccagcaccacggagctgatcgttcgaggcaccttctcctcgtggtggaagctgtagcgaagatagccagagaagatgctgttccagttgggcctgtacataatatggtaatagtcctccaggcagggctccgaggacgaccaggagatgatggctcctgtataagaaatgttccccacctcgatgttcatcccgattctggaaccagaatcaaagtgaagagtgacatcccctgatttaagtatgtatttatcataatcatagccaccatttattgcacatttgagacgggcactcatgttgccctcatcttacagacaaagaaatggaggccgagaggttctgttatttaggcatagcgaaaaagtggcaggacaaaagttaaaactggggctgtcccatgccaaagttcaggcctaagaacagatgcacccatgcaatcccagccacatcccaccctagctgagatccttcagataacaaaggggattttcttaaggggattgttctcatccccttaagaaaaaagaagaaaaggtaaggagaaatcagtagaacctcagaggctccacctttattctcaggtctgtgacctcccctcaggcaattgattcacctcaattttccttcttgacctcctgtttctgctccaagtactgtgagctcagtgatctagaacattctgcccactgctttttttagcctcctggttctgttgcccatggtgagtggaaattcgcttcgtcactctttggcagctgatctcaccccaaagcttctgctcttgttttgtttgtttgttttttcaaagccagcggtaccaggaaatttattttatgggtgaagataatcagcccctaatatcagcataactaccactatttaattctgctgt

SEQ ID NO: 118457 - DNA, 1044 bp, Homo sapiens
ctggattggtcttacctatcattctgttacatttctgtgcacattttgacctatagctgtgctcctcattttctgacccccagactccttgtatttgatgactgaactcagaaatcctgatattgtccttcagcgcttgccactgactgctcatcctccccagctgtgctccattatctaatttgagcagggcaaattcatgacacatgtgctgccattttccacgcccttacccatggcagacatctctaatcaggcatcatgcttctttcccttgggatttcttgctgaacactgctccccatactgcactggcttcaagagagttctgtatccctttaccactattctgaatctgccccaaatatggtcatctgaatttcatttaatttcctgcaacactgctgaaggccaaaacatttaagatgtttatgaaaatttcaaatgatgaaagagaaagtaatatataaccaggtcaggaatagcaaataggattaatctgctaactccaattctttggcagtagctttgtggaaccatgggttgttacagattgtggagctaaatccagagtaaaacaagaaaatgtggtaattgattaaagatgtctgccttgggcacaggagggatgaatgtgccatgaattttccaggctgaaattaaatagcatgtttcaatctgcacaatttcctggctccatttcattttagctctttgtctgaatctgctataagcatcctcagccccaggaaagaccctacacctagaaatgtgccctccttgaagtctgtaagcccaagacaacgagagagctcctttttcagtcttataaaggcttattttcccttataaaggtcaaagggactgttccccgcctttaggcaagagcctgccccatcctctcagaggtctcagcataacctccataccccgcatagcccagaattcagcccactcatctgtactcttcttttgtcagctccaaggaaccattctccagtatgtgaaaacactgatagaggtgatgcccaagatatgccgctt

SEQ ID NO: 118458 - DNA, 1037 bp, Homo sapiens
agcaacgtagccctcagaagtcgtagggataaataggaacaacttctgaaggcctcaggggcaccagaacagtggaggtggggcggggtggcgggggggggtgggtccctgaagcctcagtccccgagtgtctcctgttaagcacctcttttcatgaggaactgtgactcagagaccatcaattcagcttcccctgttcagaatccagaggcagactattgatgggggccgcaaggaaaggaccacttcctcaggcaccgtctgggtggtcactcacatgtatcactgaggacaacaggacactcaatgaccttcagagctgagacctgagacagacccgctacagcatgaatctttcaaccccttctattcataagtgagaaaactgagaaccagagagaggaggaactcacctgaggtcacacagcatagcagcagcagaggtggaagaactaaagcacaggtttccaatattgatcccagtccttgggggctaggggtcggggaaggatggggaacacagagcagggattaggctcactgaagtcctcattctgctttctacttagacagctggggagatctccaagcctagacagtgctttctgagattagaatgaggcatgagctttctggagtttttttagtttaggaagctagaattaaatttttaaatgacataccaattcttctcaatgaaagaagactactaattgccaaaaaaaaaaaggaaagatgcctaatggccatcatagaggaaaggctgtataaactgtggaatgtccattctcatggaaaactctgaagcaggtaaaaagaataagctgataaagtagttttgcacataccaagataaaaaatagtgaaagatacaatattgagctttaaaaagttttaggacaagacacacatgatgccatagatataaaccacaaataactctgcattgaaaaagatctagaaaaaaaaaagcataccaatatttaacagacattttctctaggtatgagggaggaatccaggattagaggtcaaca

SEQ ID NO: 118459 - DNA, 1186 bp, Homo sapiens
gaatcatccgttttactgtgggtggacatttgggttgtttatagtttggtactattatgaataatgatgtcatgaatattcttgtacatgtgttttggtgtatagatgctcctgtttttattagggaaatacctattaggttagcttcaaagcagttttcaaattgtaccaatttatactcccattcagcagtgtatgagagttatcatttctttgcagcctcataaacaatttgtccctctttaatcatagccattctgggggggctgtcatgtttcattatgattttgatttccctaatgatgctgattctccttccacatgctactagccatttggacaccatcttttgtgaagtgctggtcaacattcttgcctttttaagtcatctttcttatggatttgtggccattatatactatggatacatgtattgcagatctattactctggcttgtcttttggtgaatagaagttcttgaggcttagtgtagttatttttttcccttacggttttgtgatttgtttagaaaacctttcctactctaacgcgtgaagatgggctatcctctgaaagttttagaggttagtctttcaacgctaaacagacctttaagtccatattattcacctagaattgatgtttgtgtttaatgggaagtataaatcttttatttccagattgttctggcaccacttcttgaaaagaccttcttcctgcaatctgtagtggtagtgctatgtctgtcatttatcttgtatccataaatggtctggtcatcgcagcctcttaatatatttgttggatcttatctgaaacaaatcagcatttgttaagtatttttatatgtatcaggtttttaaaggaaattctattaatgtctagtgtttcctctagtatttccttccctgggaaatcagaaagtggtcattagggaaaatagcagtcactaagtttttgtttaaattttgcttggttttctagactttcggccattgtttgttatgccagcatacaccaggagagggacctatttgtacgtgtgagggaaggcaggcctgagtcccccgggaaggacagagccctttagtctgccttttactgcaaggcctcttgcctggagtgttctttgccttcatctctgttacttcttctctccttattagagtggaccacagaaacact

SEQ ID NO: 118460 - DNA, 1074 bp, Homo sapiens
tagtaatgtgttttgacatctagtctgtctagccagctgcttattagatatgcagtagccagaacccagatgaaaagccagtttacattattaatagaggtcatttgtaactgtcaaagaagcacttctagaggaaataattatctgaaatcatgggcaagttttaaaagtaacatatgctcattgtagcacattcaactgtacagaagtatttaaagtcaagagtgacaatcccactcactactccaagcccatctgttcccacaactgatgttagtccttctaaaatatgctttacacacacacatcacacatactttcatctgtgtgattgtacattgtcaatgtttttaagtagaattgtagtatacattcatttctgcaatttgttctatttactttacaacttaaccaatagatctagactactgggtcaagtgtgagctttaacactcactggctgcctctctgaaccttagtttcttcgtctgtaaaatggggagagtaatggcatctacctcatgggatggaatggactcaatacctatcaagtgcttagaacagggcctgctttattacccacactcagaaagcataagctagtagtaattatagtagaagcagtagtactactagtagtatcatgtcagtcttttcaatggctatccagaattcattatgtgggtaaatcataattttaaaaattaatccgctactgatggtgcctggattttacttaacaccagtaagacttaccatgaaacttccctgctgttgcattcaggatcatcaattttgtgccctgctctgaacaagaccagttctggtgaaccaatttcaggtgcagccagctccagagttcgggaatctgtggtgggaggtggcagatgggctctaagatgtggatagaaggtgtatgtgcccttctgtttccagcaaatcgccattgctcgcgagggtgacctcctgaccaaggagcggctgtgctgtggcctgtccatgttcgaggtcatcctgacccgcattcggagctacctgcaggaccccatctggcggggcccaccgcccaccaat

SEQ ID NO: 118461 - DNA, 1147 bp, Homo sapiens
ctcttttagggaatcagaaccttcattgtcctagaagctgaaagattcttggaacattttagcttttactctcaacttgctgttctctttacattccttaagttagactttcgggtgtggcttctctcccaggggtaacatttacttccattttctagactgaaccaaaagtcttctgcagaatctcccaccgagtgtggtaagaaggaaggacaaaaggctttaggatataaatttcatgttacagagcatgtcattgtcaaaggaaatctgtggccctgagattttaagaacataaaatgtgacatttgatatttctccagcccagggaagtaagatggttagcaatggttgccttaatcaaatggtcccatttttaaccccaaaggaagtgcccacagcaagaggtttgtgtgatgcacttatgtcctccggtgaggaaagggggccacatatgaaaggccccttaggtcagatcctgagagtagcacatttgagtgcagattcctgggccccacctcaaacctactaattctgaatctctgggaatagggccaggaaatctgccctttctacaaactacccaagttgttctgttgcacatcaatgtttgggaaccactgctgtaagggaatcattctggtcaccttgagctttgagctaccactaagccatgaaagaaaatacatcatacagggaagagagaagggaggaggttccaagtagtaactggcagatcctcctgtctggaggtaccaccttctattctggtttctgacttttccttcttgatgaccatagatgtgttccagaggcaaaagagacacattatcccagatggcagaacatgctttcaaaacatataaaatgtcaaagttccagatccttctacatctttagtcctgtctgaggatggtagctggctctctgtagctgatagatggctagagttccatccaaatccttgaccacgacttcatggagatttgaataatctatttgatgagatttctatttcaataacccacctctctcaccccacattcatatccctaaatttgaccctctgggccgagtcacattaccttcaggagacttgatcccagtagactgaggtcttccctttcagcagaaagatttcatttcc

SEQ ID NO: 118462 - DNA, 1218 bp, Homo sapiens
tcaggaggactgggggcagtgggaagcacagatatttcgtatgaactgtttttaaaactatcagacatttgatgagggtttatttcagtggcaatgtggcatagcagttaagccccctgactctggaattagactgcctgggttagaattccagcctggcctcttagaacctggtgaccctggccaagttgcttaacctctcttggcctcagctagggatgctgtgaggattaaatgagttaatatgcgggatacattcagaatgttcagcacatactaagccctccatatgtgacagctgtgtttattcttcagtaccagctctgtactgtgcattttctgtgcattatctcatttagttcctgagaacaatgtctcccgtggatattattagcatccccattttgcagatggggacaatgaggcttagggaggtcacatgatttgcccatggtaacgtaagtttttttggaagaaaaccttccacgtgagaaactagtgagttctgatctgttgttctctgtgagtgcttgctcaggccccattttctttgggactctgggacaggcatggctgctctaatccccttctcccatttccacgtgcagtgccatcctctcctcatatttcctgagggagagtctgaacctgctggggaagctgggctgtgtgatctgtgtggccggaagcacagtgatggtgatacatgctcctgaggaagagaaggtcactaccatcatggagatggcttccaagatgaaagacacaggtagactccaagcccctgaagagcaggaaaatactggaggttgaacaccccctactaccccacaaaaggtcaggttgggttctgaccacctcaggtgctgccacctagaggagaaggcaagctaaagaagaaatgttaatgggctggtacttgttagcaaggctagcttaaaggcttcctggcctgatatgtatgggtaccattaataagtgtttattatgtgccaggcactgttatgaatgctttatatacattatctcactgaatcccacagaacagctttatgaggatgatcctattgttggtcctcttttacaaatggggaaactgagtttttgggggtttaaaaacctaaccaagttattaggaagtcatgaagctgggactggaacccgggtttgtctgactctagagcccacgatcttaatgctacctcccactgccatgag

SEQ ID NO: 118463 - DNA, 3527 bp, Homo sapiens
ccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttatctggtttggcagctctttattgtgtgtttgttgtaatgtcctactgctcagattagataggattcatgacgtggacttcagaaagagttcccacaaggatggtcagttcagcctataaagccttcatggtggaccctgagccacagcaaagcctatgttttcctatgaccagtagagggggctgtttgtctttacacctggacgcaggctgcttattaaaggcctgaatgatcctgagattcttcgat

SEQ ID NO: 118464 - DNA, 1130 bp, Homo sapiens
tctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggtaagtggataatcagcaaccttgggctgggaacattgcttttaaggccactttcaatgggtaatggcaaaggtggggaaggtgaaacttgtggggtcatgagctgactgccttttctgcaattcagtcaatacgggggcgcacagcaggttagagcaacgaacgtggggaaatagactctctaagaagctcctaaaccatgtggcattttctcccgggttggcctattttatgacaagccactacccaccttccaccccatattaacttctgtcagttcccccatgctcgtctgcctgctaggtctttgtaaatgctgcttgttctgcctgatacgctccttctctccttggtggggccacctcctgctcatcctcagatctgctcctagatgccgcttctcccaggaagtctatcctgattcctcaattctgaggttgatgggactgtacttctctcatcatagtactcttcctaccaaattgtacctattggtaccttctactgattggaaagtcttagggatgtatcctgatgccttgcccatcccaaggggcaggtgcctctgggaggtgagagtggggtctagactctcccccaccagccctggtgctcttggaggcatagcctgcccagcagcctgttcccactgcgtgtgtgtgctctgatggctctgaccacaccttctgcaggagatcccccagtgcagacacaggtgtttcctgggtggcggccgggtggggtgccttctggaactggcctgtgtgttttgggtgtgacccctcaactgagactgctttctctgggtgtaatccagagggctccatggaacccaagctgtctctgaccctaaggactctggggttggctgcaggctttggagggtccttgggatgtgtggcagtggtacagtttgggaaggctgagggcatccattctgtttctctgctgtgaaactgctgctctcccc

SEQ ID NO: 118465 - DNA, 1040 bp, Homo sapiens
caggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggtaaggctctcctggggagcacggctctccccagcccaccacttcccagccagcctcccctggccctcagggtagtttggaatcttggcttcaaatggcacctctagatactacctctttcatccccttgactcagggtagatgttcagggagaaccagaggacagtgttccttcccagtcccttgatgcttttatttctcagagtggacaattgaataagagtaatccaaaagaaaaatgagcagaggatggagacagagaagcaaatgcaaatggcccttaagctatgaaaagacgtttaatctcagtcatattaagggaaagcaaagtataattatgatgaggtgagatttttcatatatcagattgcaaagactgaaagttaagataataataatataacaacaataataatgatatagtgttgtggagggtgtgaagaaacaggtagatataaccactatggaaagcaatttggagatatacttagaaatgcagctaacacttgcacatgtatgtgaggatatatttactatgatgtttactgcaccattgttagccatagcaacaacaacctatgtgtccttcagtagggaccaattaaattaattctggtacattcatataatgcaatgctttatggctaaataaggaggcagccctatatttactgaataaaatcatcttccacaaaaaattaagtgaaaaatgcaaggtgtagaacagcaaataaaatatgctttcaagccagatttggtggcttgcacctgtaatcctagctactcaggtggctgatatggtggcttgcacctgtaatcctagctactcaggaggctgaggtggggggatggcttgagcccaggagtttgaggc

SEQ ID NO: 118466 - DNA, 1162 bp, Homo sapiens
ccatgttggtgtgctgcacccattaactcgtcatttacattaggtatatctcctaatgctatccctccccgcctcttgctaccctacaacaggccccggtgtgttatgttccccttcctgtgtccaagtgttctcattgttcagttcccacctatgagtgagaacatccggtgtttggttttctgtccttgcaatagtttgctgagaatgatggtttccagcttcatccatgtccctactaaggacacgaactcaagggatgaaaaaattctaaattaatgtattggtaaatgttctaaggggccagaatgtatgtgtgtgagacaatgggggtctgaacccaggtggagtcagccccacgggtagcaggagtgacagcacgagtgacacctgcctgactgctagatgctcaaactccccactaattccagccttgtcctctgccaggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggtgaggggtcacaatggtgctagtgggaggggaagaatttgcattggtttcaaaactcaaggtcaaagagaacacaattgaaaatttcttagtcacaggtgtttcctacatataactgtccaataccccatgaaaaatcagatatgaagaagccttccagttggagtgtttgtgccgcctctgctagtttgtggccagcatcgctagtgtccaggatcagttcttcttatgagtgtctggtctaaccagaaaccacgatcacgtggcatgttgactctgtcttcctcagtggagctgcacatgcctgcttgccctccagctgcacggaatttattctggaggccacacagccagatatatgggcttgaacaggggccttatgaggatgcttaaaataacaagctcatgctgtttaggctggaggagagatgatggaaaggggatgtaggaagtgctgtcaagtcccaaaagggctgctaggaggaactgtttatgtgtaaactctctccttccttctgatcttcacagtgagtgtgg

SEQ ID NO: 118467 - DNA, 1053 bp, Homo sapiens
atctctttctgctgcttctttcctgctgggtttttttcctcttgatttctttagcttttgcatcatcagacagtacaccaagtgctgtgcctggagtgtatctgtcttgtgtggttttctcaggaaacactaagccaagtacaccctatgtttgaatcaaggtcgtgttttctatgttgatttccttatgtctggagaaatatatatgttcagaagaagaatggggaaaaatcttcctcttttatttattctgaaagcatttattggtctggaagttcatccataggtcagttgtggtctgcaacctttgagaactcaggaaacatggacttttaaacatttgatttcctcctagtgacagcagattcagccttgctgtcagaggcacatatggagagtctgtatgctcagtgacagtggaattggtggagacctgcaagacttggctaaggataaggcagggatggggggcagaggcagatctgtccccttgaccttgacctcaactctgtcttctgagcaggaccactccgagaatgccattggcgtggctgccaccatggcccacgagatgggccacaactttggcatgacccatgattctgcagattgctgctcggccagtgcggctgatggtgggtgcatcatggcagctgccactgggtgagtcaaacagcaagagggaggatggggaggagggcgggcacacctggacagtgtgacccaggggttcctcccagctggccccactgagactcccttaaacttctgatggggccaaaaaatgtagtttttacaacaaagaaattgagagaagaccaaggcaaatgtgcagcaagaacttaactttccagcaggaggtttggtgctggtgtaaccctagatttatttaatttctgttttaaggtgttgagttataaaattggcttggccatatgtgtcttttttatttcatgaattttttatgaggacacattttgatcatagccacagcccttaattcttctatcccaagagagttggatcagtgctgtttcaattccaggcttcact

SEQ ID NO: 118468 - DNA, 2694 bp, Homo sapiens
caactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacattgtgtatatgaaagaagatatttgttatagtacaaaatgcagaataggtaacctagaatgacagtagcctcttggtaggctagtagtatatagtttttaaaagtagtttttcatgtgtttgggatcaaaagtctctttgagaatctggtaacgtttattgcacaattttagaatactcataacattgatgaagcttaactttgggcctgctagggattcatgaattccaggtctaaagggaaaatcattttttcctaaacactagagaatataggagatcacttaaaatatgttttagggattaataggcaaatgtattagttctgaagtcatcagatggcagtttccatgcccatggtttttttctgccctagatggctctggaaacaaaggtcagtggtcagtgacaggtgaaagtcaaacactggcatttcctggaaggacagactctagggacacagtccagtcctccctctagctcctgactcactcaagaataacatttaaataatcctacaacccaaacatttgacatctgggaaaacaagggaagcttgtttccctggggagaatatgggaggctgactctgctttcccccatgtgacatctattgtttggagacctggcaggttcggacttggctgggtatcccctctgtggggtatgtgatggaaccaagggcgctggtgacaagtgaagggagaagagaggcaccagcaagccccagtccttactgaaagccctaagcctgggtggcccatgcatcctgtgcagccgtcttggctctctcctcgcggctggtgttagtcactcctggcgggtaagggaagccacgcccacttctctggagcttgctgacctagctacttgaactgaactattgttgaactaaaactggaatgaattggactcgtgctgagtcatgaacccaatccaaaatgtttttctgtaactgtgaaaaaaagccaagtttacttccttcaaaagctccctagtaaagcaaattcaaattggaatctgaaccttttattttctgtaacgattgaactggcacaaaacagaaaaatcaaaatttctgttgaaataaactgatatttcactgaatctggagcccatcttgaccagcgtttcttggagcgagtggattatctggatgtgtaggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggtgaaaaatgccagatcataaagattagatgtagctctagcctcgaggaggtcgagtcagatcttgggtatagaatttcaggatctctggtttggacaaaaccctgaagattaccaagaacgtctgtagtctattgcttgcaacctgcttattccatccttgacaaaacctgagactatccagggatggggaagaaaatttgaagagtaagcatatctgtgcacttttatgtcatttatactcatttacttccaaaatgagtgggagacattttataataaaatatccatgtattaatataatttggtatatccatacgaaagaa

SEQ ID NO: 118469 - DNA, 1075 bp, Homo sapiens
attgtctatggaaattctaaaacttttttttttgcaaagatgataaatatattcccagtcatccgactgaaaactgtattcttgcccatgtgtgggtccatttttataatcatgttgatgccaaatgatgacctaaagccatggtccccaaaatgtggtccccagagcaccagcatcagcagcacccttgtgtaagatgcaaattctcgggccctgcccccgacctcctgaatcccagactgtcagggtggggtccagaaatccatgttttaacaagacctctgggcgattgggttgcacagtcaagtttgagaaccactgacctaaaggcatagcagttcagcctttaactccatgttcctcaaatcagacaggttctaagaatttgaggaaccctcacctggctcatcatgtatttcatttattcatcagtgatctcttgattttctattatgtgccaagcacctggatatatagatctcaagaagacagaccctccccaggcatcgcagagtttgcagtaacagcacacaaacctgtaggtccaaagtgtgataagcactaagatggaccattaggagggatgaaagtgcagataatgggggattcaacatggttttgggaattagggaaagcttccctgacattgaagcagacacctaaagagtgagtttaggccccagagcccatatttgcctaaattagccagctgttacctccaattctcactttgtttagtgactccatcatataagtactaagtgcatcttctgtgcattggatgtcattatgagctgagcgctcgctgtgttcgagcagggcagacactggccttggtctctcctgaggatagagcccatcacaactccagtctgtctgtatcccatccacatagtttagctaccatcttcccaaagagctcattctaaggcagctgtacctagtcacatttccaaagcatgtgtcctggcagcagggcctggtggtggggagagcactaggctgcaggccagaaggtctttgagtgttagtcactggatgttagcagcagaaggaggtggcccttgaagctgtc

SEQ ID NO: 118470 - DNA, 1066 bp, Homo sapiens
gtatttctaaattgaaggtgatgcctaagaaaaaggaaatagtgtttttcttttattctgtcattgttgagtgtgaaataccctcatcatagaataactgcttttgggggaaaacactactacctttaaaacactcagatgctgacttcagaaagcttaaaaagtgaaaagaaggctgggcgccatggctcatgcctataatcccagcactttgggaggctaaagcaggcagattgcttgaggccaggagtttgagtccagcctgggcaacatggcgaaaccccatctctactaaaagtacaaaaattagctgggcatgatggctgggtgcctgtagtcccaactactttgggaggctggggcacgggaatcacttgaacccggaagcctgggtgacagagcgagaccctgcctcagaaaaataaataaaaattaaaaagtggggaaaaaaagtatgctttccctattggagtagacactacaccatatgcacacagtcctcatattgattcatactgaaaatggcatggtgtttcgaggtttcgaggttctgtgggaacgtggtggttagcacactccctctcatatgctggcctctgtcctgcctgtgctcatcagctcatctcagtattttctgagaataaaggactgaatccagggtcccagagcagcctccagcaataaccaaatggcagtggaaggtgttatatgagtgatggccaccacagccaagaacatctctagtgccgaatgacaaaatcattacggaggtagctgctgcttatccagcagctctgtttcttagcagttttttaaaaatgaggccaagtccactatttctacagcgctgatctgtttctctttcttagatgaaaagggaagatttaaactccatgaagtatgtggagctttacctcgtggctgattatttagaggtaagggggaggcaatgggtcttgcagaaaaactgctctcttgatagcttccattccaggctccagactgctttggggaaatgttgcccattcatctttctccagttcatctatgattttgaccttaaatc

SEQ ID NO: 118471 - DNA, 1055 bp, Homo sapiens
tgatgtaacagttgaagcagctgcctccagtccaaggggtgatgaaactttttgctctctctgttatacattagagtgacttattccaatgtttacactcaacgcttcacaagggtaggcacttggtgtgtcttgttcgctattccgtcctcagcaactggcatgatacctggcccgtagcaggagcccagtaaatgtttgtgactgtcttccagaggactgtgagtttctcaaggacaaggattatgtctagattatgtctaggacacatgagtttattctgagttcagtgctagtatctataatcaagggaggaaaaaaagtagtccctcatgcttggtggtggatgtcacttcaccaaataactaccgtgctgacgtggggcaggtgggacaagtaggcgtgtcatcactgatgcatctagctctggtttccaagcacaaagacccttgtctttccacttaatcatccagtagtcttgataagttatcattgccgtgttagggatgaggaaactgacgcttggagagatttaagatgcttgttgaagagcatgtgacaattgaatgttggagctaaatccagaacctcggtcacctcacttgcaggccactgttctttctctggccactgtactgcttttcctgagtctctaaagttttgacccatgatttgtcatatgccatgttttggtttgggaggctttttggaatcctggacctaccatccttcataagttttaagtgtcacaggtacagccttcttagaactttttgagatttcccagtccagagacttttaacctggagtctcacgatgagcttggtggtggtggttgggtggggtgggggttggggtggaggtccaagtgccctgagctcatgcaccactttttatgtataagtgcattcctctagagaggaagtgtgagcttgcatcagagtctcacgaaggggtacatggccccataattaggttaagaaccaatgatcaaaacccactatgtcattttgcatatggagaaactaagacctacacaagggactttttcagaa

SEQ ID NO: 118472 - DNA, 1039 bp, Homo sapiens
gctcactgtctatcagcaggaagtgtatctggttggtaagttgtttacttttttaaaaatttttttttgttaaaaattatcattatataactatacaggtttagtgttaaatgttcaaatcatgcaggaatgtgtaagctttaaaaagtgaaagttgtttatcttgtcctacccttccaaccaatcccattctccatctgttattactgttggaggtatccttaattactgttggaggtatcctttattgaaatacataattgtgtgtgtgtgtgtgtgtgtgtgtgtgtatatatatatatatgtatatatgaacatatttaatccaaatgagatcaccctatgcatacagttttgtattttttttccaacttaagcattatgttttaggtatacatagatctatctcattcttttaatggttgcataatatcgtttgtactaatgtctggcacgtttcattatatagaaagtctttcagaggtatgcaataaatcatccatagtggtctatttgatggatcacccttatattacagcagccctgccttcgaaaacatagggctcactctcactgtaattacaccttaaccgtggtccctggactcagattctgtgagagagggagagagggagaacatgagattgaaaatgaatgcaggagaatgtgtaggaaagtgtgcatgatggcctggaataagctcaaaatgtaaagtcaagggatccacgtttaagatctagctacatacttcctggctgtgtggatctctgtgttttcctctccccattaaattttttccttgtctttgctgtggccaggctggtccctccacaggcccctactctatccaaaaggtggctaagtcctgggagtggggtgggtggtcagtgggggtgaggtcaggggcataccccagagtcatgaacctgaacattaggagagctgggattagccccggctctcacattaactggctaggtgagcttgggcaagttcttttttgggtgggctttcctcttttctgtaaaacaagagtaga

SEQ ID NO: 118473 - DNA, 1241 bp, Homo sapiens
aataagccatgagtcatccatgaccatcctgagatattaacattgccatgcttatcagtgttctttagcctgaccacctcctttctccttgctaggatcactgcttttaccacggcacggtgagggagacagaactgtccagcgtcacgctcagcacttgccgaggaattaggtaagagaccctgaggctgcaggtggcaccgggcactctccccaggaatggaagtttcaagatagacaaggctgaggcaaggaccttgggaaggagtccattgagaatgtgtgcaagccagcccagagaggggctgagcctgggaggatgggcaagggaaagcctaggtaatccagaaatccattgggatttaactttcctgatgaacttgatgttttaaaatataggttttgttattatttaggtatggtaaggccaaaaaatcaggagatgactgccattgaaaagatggtcatactcacagaaaagggaggggcccggctgtgccatggggggcggcacggggaggcactggggttggtcagcgggcagagggagtctggagaaatgtcagcagacgcccttcttgtggtttctgcgggaaggaatgggcgaggcagagaaagcaggtttaggattggctagtttgcatcatttcagcaggctctggggtttatgggctctctgtccttagttgtcctatacctggttctggggtgattagggaagggggatagtggcccagagggtgagagtgcccataaaataaatggctagggtatggactctggattggttggcttgcatttgaaaggcaaggtagctgggaaattgttgaccatctctaggaattggctaatcctggaaggggcagtccctctatggtcagtaagacccagatgtcaaagaaacagaagataaaaaagaagacacatggttaatatgctcgggatggatgagtttgggcatttggttccacacctcctcagttcttctctgggagatgtacttggaggtggtgaaataggaaatggacggttaatgaacagagagtaggaagtgaaaggaaaggcaaggataattttcaagacagaaaatcaactgaaaagttctgaccagaatgtgcttttgagagtgacccttccttctctgagtgagactacctggctttgagctggtagcagtttaccagctgggtgaccttgggtcccagtggtctcatttgtaaaatgtggataaaaagaatata

SEQ ID NO: 118474 - DNA, 1086 bp, Homo sapiens
gtctcttgttgttacccctgattcgttggacaccgtcctgatttcacccccttctgtctggtttagcactttagcatgcccaacagtgcgtatttgcttcctaaattctatggttacctgacttataaaatgctcggccagcacttgaaatggttatttcaagccccttcttttggtttgtaattatatctgtttggatttctcattaatgactgcctctcacaagaccataagccccacgaaggctgaagctgtgactccgtttgctggctatggtgtctccaggggctggcccctggcctggcacagagcggtggtcacagctgtttgtagtgatggagaaattctgacagccatgagacacagtggctggagagcagcagcagacctcacgggcacaggtaccaaatcaagtacaatccagatgtggagggatttgtgtgaaagagcatcttgagctgtggaagagtagggagtgtttgtttcctagggctactgtaacaaagcaccataaacttaaaggtttaaaacagtagaattttactttctcacagtcctggagtctagaagtccaaactcaagatgttgtcggggccatactccctccaagcctctggagagaatccttccaggctcttctagcttctggtggcttctggccatccttggtgttccttggcttgcaacttcatcactccagtctctgcccccatcttcaaatggccttcttctctttctgtgtgtgtgtctgtgtgtccttccctcttgttagaaggacacaaatcattggatttaggaccttctctaattcagcatgacaccatcttttttttttttttccttttccttgagacagaatctcactctgtcgcccaggctggagtgcaatggtgcgatcttggctcaccgcagcctccatctcctggactcaagcaattctcctgcctcggcctcccgagtagctgggattataggtgtgcaccaccacatccggctgatttttgtatttttagtagagacagggtttcaccatgttggccagggcggtctggaactcctgacctcaagtgatccatctgcctcagc

SEQ ID NO: 118475 - DNA, 1062 bp, Homo sapiens
tctcattgaacaaatgttaagcactgacataaaccagtgagcaaaactgcttggcctctgccctcatgaggcttacagcttttctccctcaggcaaatgggtgactcctccctcaaatcttggactagttagatgctaaggagaaagagaaaggactgggagacagattctggcaggttagccactgacccaaagtttccatgtgaatgagaatttctcttcacaaagctggggtttgtgctttgctttatttttacattttcctgttgggcttcttttcttcttgtccaaggcgagaagttgaaggccttgacatagtacaggagacaattcttgtggcatttgccttctgaccacacactggggatggagggaaatctgagcgatcccagaacttagagctggaagtgactctagaggaattctagagaccctctgcgatgaccctctcttgctgggaaatgtcacctctttcaaaacctgggttatccctgcagattcctttggctttctgtgctggcctcagcctacattttcttctttttaagagcagttttaaattaaaatttcagttttcaaaacacctctctgacagttaatttaaaagtcaaccaacttcagaaatatgcaacttatattgtaaacatcttctgcaacccctgagataatcaccatcaacaaagggcatttgtttctctctctctttttttttttttttttgagacagagtctcgctcttgtcacctaggctggagtgcaatgacgtgatctcggctcgctgcaacctccaccccccaggttcaagcagttctcctgcctcagcctcccagctaggcacctgctaccacacctggctaatttttgtaattttagtagagatggggtttcaccatgttaaccaggctggtcttgaactcctgacctcaggtgatctgcccacctcagtctcccaaagtgctgggattacaggtgtgagccaccacacctggctgaccttgactttctgtagatcaattctgcctttaatgtggctgaactattaatagttgaaacatccatttg

SEQ ID NO: 118476 - DNA, 1029 bp, Homo sapiens
atatgggtcatctacttcacttgtcacaaccaaccaatgaagagtagattcctatattagccctatttggcagatggggaccctgaggtgtggagcagtgtgacttgctaaaagtcatgtgggtgggaagagcagggccaggatgtgaaactagatctgtttgactcccaagtccaggcttttaactggggcagtatattgcctctcagatgcatagtcctggctcattatgctttgggctcttttttggttagcactggcatttcttcttcattgttctactctcccccttccctttcctcctacctttcccaggccctggttagaatttgcatgtcagtgtaatgtgatagtgtaatccaggcaggtgtgcatcccaagcttggctccttgcactacctggaggtgtaagctttggcaagtcgctcaacctttgagagtctcagttttctcatctacgtgatggggataataacctcataggatgtgtgtggaattcaataacgtaatgctcttaaaggatttacagggtgcctggtgcactatgagagcacaataaatagacactgttatttgtgttttgcagggtcagaaaagcatttaagaatgaagtcagagggaattcccctgagttggtttccaaatgtaattaagaagagttgaccttaaaacccattgcccctgggaggaaattacttctgctctccagcgatgcccagtttgacctaattgtatctcgaaaacactgctttgcagtgttctccagtgggccaaactgtacctcttttctgtgcctgcagaatcagatgaggccctgaactgtccaatatgaggttgggatttgttcactggttccggctctccttccagggatccgcagccagggctgcctgtgcagccaggaaggatgtccacggttttcttttgtctcaagcttatttctcctggctgctcttcagcaggagcacggggtaaaatgaatgggaggaagctgtcaactgccctgttggccttagatggacccttatc

SEQ ID NO: 118477 - DNA, 1048 bp, Homo sapiens
tttgctaggcacgtcattccagagagacctggtagtcctgtttgagatgtagtttctaattgtagctttgtagactgagaatgatttcatttgcatttcccatgttgtcccaaatgcctggagttgcagaacaaatggattgccagccagtctgatgtgattttttataagccaaactctcaaccccaccccagcataagcagggtctccatttgcaatgtactgaatgtttatgtctcccttcaaattcttatgttgaagtcctagtccccaaggtgatggtattaggaggtggggccttttggatatgattcgtttatgagggctctgctctcatgaataggattagtgccctgatagaagagacccgagagaattagctcaccttttccaccaggtgaagacacagctagcagctaccatctatgaaccggagagagggccctcactagacacgaaatctgctgatcccttgatcttggacttctcagactctagaaccgtgagaagtaaatttgttgcttatttgctacccaggttatgctgttttgttatagcagccagaatggactaagatgccattatttctaaaatattggacacatgatatcactttcttagggtccattgcttaagctcagactcagtaataagcctggtgatctgaagggatgcagcttcatgatacgcttgtctaaggtatcagagagcatccaaaattgaaatagcctagatgtgttgattctgaaagccttgtgcacacaagccttaaacatcctaatccatagagtagaacagatttggactttggtcccagagaccctgattcaattccagatactgacacttccggttgggtggtctttggtaagtcacttgccttctaagttttacttcttcatctgtattcatagtaatactacttggccaggtgcagtggcgcatgcctgtaatcctagcactttgggaggctgagccgggtggatcacgcgagcccaggagttcgagaccagcctgggcaatgtggcaaaaccctgtctctaccaaa

SEQ ID NO: 118478 - DNA, 1069 bp, Homo sapiens
atgagtgctgtcccgagtgtggttaaaatacaactcacagcttgtgcagtggtggggcttcatccacatccttcctctgcctccaggacatggtggcctcgggaagccagaaagatggggatcacagtcatttttgttcctctcctcttgagagtaaagccagtttaggctgtgtttcttctctcctgtgtccctggaatagacctggccagctgcgtccctagacagtgcagcgtctattggccctggatttttccttgcattgtcttcctttggtcctacaagaaaaggcccttagagggtttgttcttgaccgtgtctctcgggggcctgcctttgttgctcacggcagctttgttcccattaactctagtctaagtgttccctgttgttgcctgtgtctaatctctcctgttctgcccccagtagagcctgtggcccttcagctccctctggtcagcccaagtgatagtgttggtgttgtgggaaaatgcttaggagttggactggccaagcaggagtcccaggactcaagtctctatccttccctcctattttgaaacatttgctacagaccataggaagctaaagcaggaagatgccttagaaaacactgaatggaatgatcttagaaaactctgaaattatggatgcagaagttttgattcagagagggataggcatttgtctgaggccacccagcaagtaaatgaaagagctgaaactaggatcatgtgtattcttggtgtgagtctggagttacagaatgtgacccagggcaaatggctgaatcttttggaacttcggtgtccttgtttataaaatgagggtaataaggccagcctcgtgggatggttgtgaggataaatgaggtgaagtgcaggaagtgcttgcacagcgcatggtgagtggccagccactgttgggatttttattgtcccacactgaggctccagaggagagcccggggctgtggttctagcatctgcttttccgagagcagctctcgtttcccattgagccgcatggggctggatgtggttcctggcctccttgaattggcagaagg

SEQ ID NO: 118479 - DNA, 1073 bp, Homo sapiens
tccagtgtttcccttcaccgcaccacatacatacacttacaccacattgcagcctggagtttcttctctatgcctttcaggagaaagcagatgggggaaggatttgggtcattctgggattgaggtcattttacatgtgggctggaaatgcaattgacctttgctcattcacttcctgtggatcaatgttggagcgctgtgctagatcctgtgcccgacccagggagcctggtgccggcttttaggaactgacattgttttgttgttgcttttagcatccactcaaagctgagctcagggtaatggctgaggggcgagaactgatcctggacctggagaagaatgagtaagtggactcctcctttgtctaaaatgaaacaaataacttctgtgtcaacgccggacgcaggtgtcgctgttctggaaggaagcagtcaatggagtgaccccaagctctcagtccttggtttctttcaggcagcatcttgcaaagccagagcctttccacagcctcttgactcgatgtgagattgctggactgctaaatgtgttgctaaaatttccttaggcagtatttcaggggcccctggagttcactgcgggcacacagaggtctgtgtatgtgtgagattaagggagtggatggaccagaggtctttggcagctgccttactagcgccagcctagtgtgtggcaggaaatgaaggagattagaggaaaacagcagagaggagcgagcaaagcagggtgtgctggggcttggagcctcagactcagattgttccatgtgttctggttcagccgcatctgagattttgtcaacagggcatcgtcaacagtctcctggctacatcgggcccggctcttccatcttcttaacctcattcatcttgggtggtagcctggctcagaggcacttgcacattgatttgccatcagatgcagtcatatctggattcatgtaatggaggaggtgaatgggcacgatgcatggctatgtctgtggctcattctttggccattccccatctacttagccatgaagagctctccttacttggccgggggactct

SEQ ID NO: 118480 - DNA, 1022 bp, Homo sapiens
agcgattctcatgccttagcttccggagtagctgagattacatgtgtgtgctgcgaagccaggctaatttttgtatttttagtagagatgggttttcaccatgttgtccagggtggtctcgaactcctgacctcaagtgatccgcccacgtagtcctctcaaagtgttgggattacaggcgtcagccactgtggcccactgtggttttggtttttccagcaagtgagacgtgaaagagcaagaaaggaagatgcggttgttgtgtgccagtaaccagctatgtgacctgccacttgcgaagtggtagattttcttcatttataaaatagtgcttagagagaataaggagaaaagaaagctggggagaggggttttttctaagatctctttgggttaaaatgatttgtgatttattgggcaacatataggagcaagattatagcaggaaagagatgtgtcaggaaagacttcagacattgtggctgttgaatctggaaagataaatggaaaggagcaatgtccaggatccttgaaactctggccaggataatacagacatgtccaaaaaggctccaacttggatttaccaagggaacctaacagtgtaaattttaggacagaccaagtgcgatggctcaagcctgtaatcccagcactttgggaggctgaggcaggaggatcatttgaggccaggaatttaagaccagcctggggcaccatactgagatcctatctctacaaaaaaaaaaaaaaaaaaaaaagaaaattagctagacctaggggtgtgtgtctgtagtcccagctactctgaaggctgaggtgggacgatcgcctgagcccaggagtttgaggttatagtaagatatagtcgcatcagcatcactgtcctccagtctgagtgacaatgcaagaccttgtctcaaaaaaaaaaaaaaaaaaaaaatcaggacaaataaaagcaagtaacattttgtcctaaaggcagtaaacgcatggaattcatttcatcaaaaagtaggaga

SEQ ID NO: 118481 - DNA, 1050 bp, Homo sapiens
ttaattttcttaactatagttttggtgtattccagattttctacaagttaataaatgccactaagaaaaggggaaacatcacagctacaccttcaaacaccagaaaaagaatttttttttttttttttttttttaggttggggtatgattttgatctgggcactaacggggacactgattgcttttgccagtaagtcaagaccagcagataaaaaataatttttaaaaacctcgtgagactgatttgccgcaggacgggaggaggaagaagcaagcgtggaaggtgctaacggaggaacctaaacctccatcctctttgcctgggaggttaagaactacagggagaggcgagagagactatgactgccctacggctagagtagccgcgaagagaacacttccggggcggggctatctggccctttcctttccgcgtgtagaatgtggggcgcctgtaaagttaaggttcacgattccttggccaccatttccatcactctgagacggtacctgagattgggggcgaccatggcaaaaagcaagttcgagtacgtgagggacttcgaggctgacgacacctgcctggcacactgctgggtggtagtgcggctggacggccggaatttccatcggtgagcgagctcgactcggggcgtcgcgatgcgccagcgcttccggggaatccagcttcttcccttgcaagtcctcccgcccgctccagtcacggttaccagggtaacgcggtagccaatgagtgcgcagcatggagcattgccccgccctgcgtgttggctaggacagtgcctgaacgctggctgttagcgtaattgaatgggcgatgtgctcccgtgatgaggatctggcttggagtgcccgtgttaagtgaacagagacttgttagcaaggacctgttgttaaaagtcactctcatgcacaatatttaagctcttaagccaattgcctagctattctgttagatatctttgaatgctgactgttcagaagtctgtgtaagccttgcttgtgggcaatacttaacgtctgtgcttc

SEQ ID NO: 118482 - DNA, 1081 bp, Homo sapiens
ccttgggagggcaggcgtttgcattaatatcaaggcaaaaagcattcatagatacatgcatctgatttggtattgtgatttacttcagaccctgaaaccaaatatctgatcttccattagacttaggggtcatgatatgagtggaatttacattttagatactataggggaaagaaaagtctcaaaaagaagtattgcatgtctaaaagctagtgccctgagtactcatgaattcgattccaagagtagtggtgtaaattgccttggagccctgcatccacgtcttgtaactaacttttgaattttgcctgacatgattctctcttgatgaagaaatgacatatattatctttgaatatctacaaggaaagttaccaacttatgtaggggtgaaatttggataggcggtatgctcaaagcagccagcaatgagtgctctgttttgatccttcttcttattatggaaaggagtacaggacctcttcagtcttccccttaccagaggtagcctctgcaaatggcataccagatgggactctaagatgcttgtgtggtggcttcttgtccttctctttgacttctgtggcatggtgctagtgcatgtaccctgtggtattgcccctctgtccgtagtgtgaactgtcctgtgagctttatgtcaggagactgtgaccttcatgtccagcttcaaagagttgtgcatgaactcggtaatacacatcacacggctgagagtcccctttccaggcagggccagcatgtgtagaatatctttcagaatatggtttcaccatgaaacaggggtggtagatttattcccttgtgtcaggccaaagaagttcttacaaagtacagtgggtagtgtctaaagcgacactttactcacagcctggcttgagtcaacaggaacaccatagcacccacaaatacttctacttgaatcatattctgtgctttttcaatcactagtgcagaataggctgcatttgacacagactgttaggcaatattgatttttttgttttgtttttatttggttttatctgagataacttatgttcaaggtgagaataagaaatag

SEQ ID NO: 118483 - DNA, 1072 bp, Homo sapiens
gaagttctcagaagagtatcttcagtaagaggagagtaactttttttttgctgctcccgctatatcccaggcctcacccttttctgatcattatcagaaagaatcccctgaacttttcaaggggtttatatggtagcaccaaatggagaatgagcatctaaaaatgacacatcccgaaagggcaatctgtggaagtttgttgtttgtttgtttttatttttaaatgcattgtaaagtgtactctagagccagatcaggtgcactaaagtttatagaggttccagtttacaaactcaagtgaacagtaatctttggaagctgccagtctaaattctaaatagtgtatctgaaatctcagttcccaaaatagttgtcaggtttaatcatcaggcaacactgcgtatacctgtgtggctatcctcatctgcctgccctctcatccctcggctagaatgatgtactctactttcccaataaggtagaaatttggaatccaacggaatataatcagttttcattcattccagtgcctagttaaatctaacctgacttaaacatatgcctgtttttatgtttacctataattttcatatagccgtataaggattgatttaccattttttgcccaacatgacaattctggctatgaaaattatgtttaaactgtgtatgatctattttatgtgctctatgttcccatttgtttgtttggtctggacagtggttctggaatgaattctatctagtaaattagtaaatgtgctgttttgtataaagcatgataattactttttaacagaagttcatttttaaagattactcccttttctttctctcttttttttgagacaatttctctcttgttgcctaggcagtgcagtggcgcgatctcagctccctgcaacttctgcctcccaggttcaagcgattctcctgccttagcctcctgagtagctgggtcagccaccatggctgactcattttttgtatttttagtagagaaggggttttaccgtgttagccaggctggtcttgaactcctgaccttgggtgatccacctgcctcagcctc

SEQ ID NO: 118484 - DNA, 1216 bp, Homo sapiens
taacaaaacctctttaagcaattggtgattgccatgggacttttcccatgtcttctgctgtaattatcctgtgcagaactaggaagaaatttttttcaggactgctctatggtttcctttaaaagaaaaaaacttctgtttgtttttagcagtcattatttacaatttgcagtgattaacttggcaaggcttccttccgtgtttatccctgtagccatcatttaagtcaggaacagtcagaaaaatatttattttattttttttttgggtgtctgcaaaggtaaaaatccattaaaaccttaagttaaatataaatgttacaactcaatgtttgcttttagattttatacagtatttgttttgttttggttttgagtgtatataatgcagcattagcaatatggttccaatagaggagttaaatatatattgttaaaggagacctgtagcagtcaaagattttattgatttaatgacaaaggaaattaatgaaaatgtttttgtttttctgctgtaattctgcattaagctcacatgaaaatcatgattctagagtttggaatgcaaaattaattgttttaccctcaagctgggaatatttttcaaaataaatactataatatagatatcaaattattacctccccatgttatgttgaaaatttttttattaaattgataaaactttatttccattatattcataatgttctgttatacataacattaaaatgttcattaaaatcaatgttgaactgctttttctttcgttctgttagacatttgagaccatttggggaaaaaataattatagtttgggcaaagtaatttttataaataatttaaaattatttaatgacttctctattctttcctatcagactctactgttaggaattaaaaatgaagcagcaaagatatcctgacctgctccattcttgctaatgttccatctacaacatttctaattaggcagaaattcatgtacttcagctaagtggtaatgaaaagtgattcatttgctgaataagagatgagagtgagtgtaattagctgactgcggtttttaatctttcaacaattcaatgtgtttaacttagtttcaaagaataggagctttcaagtgttgttacttcagagcaatcaagccagcctctggtggccgcatagtagaatatggtccctgatatttaaaaccgatcatcttaagtaaattt

SEQ ID NO: 118485 - DNA, 1416 bp, Homo sapiens
ttcaattgtttccagctatttgttattataaatcaagattttgtataaatcttcatacttctgtttttttcttaatagaatgttctaaaaataagtcaaaggatataaactttttaaagatttttgtataaatcttcatacttctgatttttttaatagaatgttctaaaaatagaataagtcaaaggatgtaaacctttgaaagattttttatacacactagctcttgacaacttgttaagtaggatttaacaataggttttgtaggaatgtttttaagttggctgtttttccccagtctactcttactgtttctacatctctggggaaccagagccaatagtcactgaatatatgtctcaagaggaaccagtgcagagtaattgatttctaataaaatcactgtaaaggaattttattggggctaaagaagtatagatagatggtcaagaagttattagttctctgttctatgaacctaaaaatttattgtggtaaagttcttctgtctgttttcgtctggtagatatgcagcagcctatgaatgtgatgactcaaagttttggagctgtgaacctcagttctccatcgaacatgcttcctgtccggccccaaactaatgctttgatagggggacccatgcctatgagcatgcccaatgtgatgactggcaccatgggaatggcccctcttggaaatactccgatgatgaaccagagcatgatgggcatgaacatgaacatagggatgtccgctgctgggatgggcttgacaggcacaatgggaatgggcatgcccaacatagccatgacttctggaactgtgcaacccaagcaagatgcctttgcaaatttcgccaattttagcaaataagagattgtaaaagaagcagattgaatgaagaatttttagctgtgcagataggtgatgttgggatggaaaatgctaatcaactaccctttcttttatcaagtaattaaaataaatctacataaagaaccaaaaaggctgttttataaaagtgaaatatccagtatttcagagggccaggcaagagcacttcagatgaggcagtcaaaatcatttttttccagtgaggatagaccacaagtgggtggtgagaccattgaaagcctttatcaactgaagagtccatttaacagcataatttgtgggaagactggaatagggctgaataaatgtgtttgaatctctaattttatactttcttttcctgaggaacttgatttttctgtccctggatcgccttgtcataattgggtctgttccttttactaccactcttgagtccatatatgaaatcattaaagttggatgatcagttttttataaaaatatatatttttgtccaagaaaaaaaaaagcatacatatgtgattatggctaaatcaaagg

SEQ ID NO: 118486 - DNA, 1043 bp, Homo sapiens
attgtaaataaatggtcccagttgaagcaggcaatgtgctaaggttatagcccttgtattgtcagtggaagtatggccaaataagtgagaaattcttcatttttttttagacggagtctcgctctgtcacccaggctggagtgcagtggcacaatctcagctcactgcaacctccgcctcccgggttcaagcgattcttgtgcctgagcctcccaagtagctgggactacaggtgtgtgtcacaacacccagctaatttttttgtatttttagtagagatgaggtttcaccgtgctagacaggatggtctcaatctcctgaccttgtgatccacctgtctcggcctcccaaagtcctgggattacaggcgtgagccaccatgcctggccatttttttttatggtaaattcaatgtgtcacctacagagctgccaagagatggattttacgttatatttgggaggtttgttttttctttgccaccttgttaactctcgtgtaatatttatgagaaagaatactgtccagatggagatggtacctgcagatgttaatctgggggactcagatcagctctaatttgtttcagttcatagattgttacatttgttctgtgcattccatgaagtttcttacccttagagttatttctgtcttagtaacagcaacaagtgggaatggagactttggtgactggagtgccttcaaccaagccccatcaggccctgttgcttccagtggcgagttctttggcagtgcctcacagccagcggtagaacttgttagtggctcacaatcagctctaggcccacctcctgctgcctcaaattcttcagacctgtttgatcttatgggctcgtcccaggcaaccatgacatcttcccagagtatgaatttctctatgatgagcactaacactgtgggacttggtttgcctatgtcaagatcacaggtaagttgtctggttcccttggaatttgttatttataatctttgagatgctctaactcattgaatgatagattagtataaaacagaaaaat

SEQ ID NO: 118487 - DNA, 1050 bp, Homo sapiens
agatggaagtggttcatttataatgacagttctcatgtgggaatcttgaaggatagcacttgttgtgaaaattagcagtcttccacatgcagcaatttttggtagactcttttatttatattcctttagaatataaatttagatagaagttttctgggaaaatgcttaagtatagaaaatgaatgtggaatttggtatgaatatcatacatacagatatggatagtcttaggagagaaacattttctaaataaagagatttttaatttttgagacagttttcaaagttgaagatcacatttcttaaagtaccagtaaaagcataatatgtggcactttaaaagattagagagaaaaaacattttcagagaaagacaacttctatttgtaaaatagttacatacatctttccattttttgctcccaatattcttaagctactcatgttgaaatcaaaatccctgtaatatagatggagaggaatactatttgctatagataagttatgaacatcatataatttctgttttggtgatagaagataggtaattatctgaaatactaaatacagggtatgtcagaaataaaatttcttaccagtttgaagttgtgatctacagcttttatcctcaacatgtattttctttgtagcctagactgaataagatttgaaaatccctaactccaccaggggcggtggctgacacctgtaatcccagcactttgggaggctgaggcaggtagatcacttgaggtcgggagttcgagaccagcctggccaacatggtaaaaccccgtctctactaaaaataaaaaaattagttgggcgtggtggcagacacctgtaatcccagctacttgggaggcagaaggtggagaatcacttaaacctggcaggcggaggttgcagtgagctgagagtgcaccattgcactctagtctgggtgacgagtggaactccgtctcaaaaacaaagaaaaacagaaaagaaaatccctaactcctaacttgtttgctataataagttatatattgatgtttattcactgct

SEQ ID NO: 118488 - DNA, 1121 bp, Homo sapiens
cctggctaatttttgtatatttagtagagacggagtttcactgtgttggccaggctggtctcgaactcctgacctcaggtgatctgcctgcctcagcctcccgaagtgctgggattacaggtgtgagccactgcacccagcccagacatctggtttgacctactttctttctctatttttttttttgagacagagtttcgcccttgttgcccaggctggagtgcagtacacagtcttgactcactgcaacctctgcctcccgggttcaagcgattctcctgcctcagtctcctgagtagctggaatttcaggcatgcgccaccacgcccggctgatttttgtatttttagtagagacagggtttctccatgttggccagcttggtctcaaactcctgacctcaggtgatccacctgttttggcctcccaaagtgctgggattacaggcgtgagccaccatgcctggccagcctactttctgaaattcttcaattccctttcccgtttttctgtaactgcaaactgttcctaaaattattcattaaacttgattggactgtaatgcccaaggttacggacagctacattagttgtgtaacaatttatgtgatatatttttatatgtttaagatttgaactgtagaattaactggtagttagcatgtagtcatataatacagatatagtgtcacagaatatcaactattttggacttcctggcatgaaatatttaaagggcccctttcatgcatctgtgaaaagttttaatggagcaatcagagaagaattaactaggaaggtcagatgggtggatgtaacttttcctctgtgacatcaagattgctttgaacagagagatttattaaataccaacatgcttcctttacttggcaaggaacctttgagtggtttgtcttctccagtgcaaacagtagtttgactaattaaatagaagtagcaattgatattaatatagtaactgagaaagtttgaatgaaatctaggaggtttcttgccttaaattttattttatcttaataaaaagcaactaatagagattgatattagaagaattttttaaaattaaagttatctcctatttgaaaccgtatgtttaacca

SEQ ID NO: 118489 - DNA, 1228 bp, Homo sapiens
gcattttctatagttatataaaagtttgatctcctgatactatagtaaaatagcacagttgtaaagtgcattcccttatattttcatgcatttacagatgagtttaattattcgaattaagatgtgtgatttttttagcatccattgaacttttattattttattatgtacacacattagtctttgagagttgatgcagaattgtgttgtaaaagtggaactatagtaatttgcacacagtccatgtcaagaaaataatcatcacatgcaagtgtttgaactctcagggtcttatcatggattctgatatcaaatcctattttatttttaagttaagcttaaatctgtaataaaaacgagttattttgacattttttatttatacacatttatgtaaatacttttttgtagcagtattttagacttatataggatattctctgtgtttccacttcccctccccagcgcacatatatcattattcagacagcttagataacattctgttgatccctgtcaagtagtcaaagtatgaaattttggagttactgtatttgaaattctttagctcaaatcactgagggacccattttaaaataatcccgtcttattattttgcttcatttttaatatcttttagcgacagcgatgaggaaaagaaagcgagaagaggcagatctcccaaaggtgaattcaaagatgaagaggagactgtgacgacaaagcatattcatatcacacaggccacagagaccaccacaaccagacacaagcgcacagcaaatccttccaaaaccattgatcttggagcagcagcacattacacaggggacaaagcaagtccagatcagaatgcttcaacccacacacctcagtcttcagttaaggtgggaatggcagtagtttacacattatacatggttttatttttataaaccgctcttcgaattcctgcattagtaggcttgggcatttctaggcaatcatattaattatggatcatctggcatgtattaccaagagacattaataataagaaatctctttgaggggagaaacctgtccaattgctgaatgattgggtactttctatgaaagtagaaatgacacttttggtttgtttggggaaggttgtgaatcagaatgtagtgcctctgtccccatctagacaatactggttaccaaccacaagtagattcactaaagaaaacattggaagtatttgaaa

SEQ ID NO: 118490 - DNA, 1100 bp, Homo sapiens
gactttttagcttattgggacatgtagcattcagattggagttccttcagttgtattttttaagatactgttgctatccaatgcttttctgaaaattgggaaaccattaagggacaggaataaaatataacatattaagtgtcttttgtgaaaacagaaagattttcatttctcttttgcttatatagcttgtgttggttttgtgttttccactactcctttcagtagcctttaagaatttcctgatatgctgtgctgtgcattaaggttgtgtaagtattcataaacaaaagcttttgaatctgcattcctgccacttaatgactggcattacatgctatgccttgctgtaattgtgttgattcagcactgtgggagctttctgttttcctttgaaaatgattttattatgaggaaaagcctgagaaataaggacttgtagataccttttgaatttaatgtcgttagaattgcttctttttttaatgctctatctaggtgaaagatatgatcctgagcccaaatcaaaatgggatgaggagtgggataaaaacaagagtgcttttccattcagtgataaattaggtgagctgagtgataaaattggaagcacaattgatgacaccatcagcaagttccggaggaaagatagagaagactctccagaaagatgcaggtattttaccactttgtctcccgggtctcttagaaagagccctaaatttatgccactgggtttttggttttttgttggttttgtttggggtattaacattatctgaaattgggcctttttttttttttttaatagacttcatttgtttttagagcaatttaagctcacagaaaaattgtgcataaagtacagagttgtcatatacccacttccccttcataacaggttctgtgaacatcttgcattactatggtgcatttgttaacaattgaaaagccagtatggatacacttattaactaaagtctgtagtttacgttggggtttcctatattgtacacttctatgggtttcgacaaatgcataatattcctcattactgtattgtatagaatagtttcactgccataaatatgccctgtgca

SEQ ID NO: 118491 - DNA, 1077 bp, Homo sapiens
cactctcaaagaaaaaacactgcgtttagttagctgtttaaggatgtttctaacagcagaaaaattcccttttttatattgaagcatcaaatacaagttagttttttctttttcttttttttaaatagggctaactcataggcagtgcaaccagagtcggccacaagttagtttttgaattgggcaaaaatatttctcctaaagcatataaataatgttttgaagtttctatttggggaagtccaaagtttttggattatttacccaagtagtaactttattcttcaggtttttcaaagtagttgtagcaacttaatgtgtttttaatagaaattgctatttgaaacttatttccacactattcttgcttgtatctttctttttgccagcatgatatataattatatcagctaaacttagaaaattgaatacgttttcaaactcagtcacaatgcactaactgcagcatctgtattaaagatagagttggatatcctgtgtgtttgcatcacatccttttgctaagttattgttcatggtttatgttattcagacttaactaatcactcttagcagttttgtgttttttctttttcttttctttttttttttttttgaggattcttgctctgtcatccaggctggagtgcagtgttaccatctcagctcactgcaacctccgcctcccgggttcaagtgattctcctgcctcatcctcccaagaagctgggaccacaggcgtgagccaccatgcctcgccaatttttgtatttttagggtttcgccatgttggccaggctggtcttgaactcctgacctcaagtgatccagccaccttggcctcccaaagtgctgggattacaggcatgagccaccgcacccggccagttttgtgttttttcattctgacattagataatgtcttgccaatatccagtatctttagcagtaattcagtatgatgttcaccatgccatgctaatcagtttggttttcatccacttccatttttcgtgtaaatttgtttctttccgaagtctggttcatcacactgttgttgaaatgtacatacacatt

SEQ ID NO: 118492 - DNA, 1091 bp, Homo sapiens
aaaaattcagtttttgagctatgctaaaacctcataattagtgttccagacgtgtactggggaaaccaagacatttgtgtgcttttcagttattaacatgctaaagtggttcttcttttgatttgttttcttaaaatatgatagaaaaacacaatagcacttatggatatgtctattttgtgtggtcatcatcagtaatcctttttaggtcaatctttaattgaccttgcatagtaccattatctgtggtcctttttagttcatctttacatgctcttataagccaaaattccattttagaacttagaatttgctgaagaggaaatgacaaagttaaatagcacaacttgcccctttctattgttttttaaatattgaagtttcttatgttgaagtttttgtgtcttttttttaatcttaaagagcttgatacatattaagtgaattcttaggttttgcttatctcttaccatcctcatagatgagcatggtaaggatcaaggtataaatattcgacagaaggtgaaggaattggttgaatttgcccaggatgacgacaggcttcgtgaagagcgaaagaaagcaaagaagaacaaagacaagtatgttggggtttcctcagacagtgttggaggattcagatacagtgagtatcaaagacaagctgacacctaagcatcagcttagcttcttgagtatattttaagaatcagtgaaataccaaagaccaaaatgctaattttcttttctaggaatacatagaatactaaaatacacgcagtactaatcttgacttctactatcacatgaatcttcctatttttaacttgtgggttcggcaataggattttaaccattaatggctaattaaatgactgcatattttgaggtgtcatacagagattaaaacagatatatgcccttccctcttaggattgccattttaaaaagaagggggaagaaagtttctataactcagagtttagagtataaaaataaaaagtttgatcaggagatccatctttctaatttgaaaccaatttagctgtatttttggcccaaaccagataagcttcctgacagtcattcca

SEQ ID NO: 118493 - DNA, 1033 bp, Homo sapiens
tacaggcatgagccgctgagcctggccacaaccttttaaaacaaaagccacataattaacctcaaaattaaattttatctggggaaaatactataggattgtttaattaccaaataatttctggcaattcacagttccataatgctcagataaaaagtaaaaactgagtcagctttctaaaaccttattgtctatttatatcaagcattctgatattttgaacatcagtgttattcttttaagtctttgacacatagtatccagtagatgatttataattatttatcatgcttaatataagaggaacttcaaattgattatgtaagttctagattatgtgtttaaagtctaatgtaaagaaacctcaccaccagcatgaagattctttatttgctaatgttagaattattttttttaaccatttaccaaagctctactagaatatatttcattaaatcatttattgctttgtatttttgcagtcgttgctgctcctagcttacctcataaggaatggatcagagcgtgttgttacaagtgccagagaacacatttatgatttacgatccctggaaaattaccactttgtaggtaagcaatagaaaaaccttataagcaaattaaaacagtagttggagttgtcagtcacctgaaccagcttagaagcttctctgctctaattagaatgtgactgttgctggttgtgtgacgagtgcagaatccaagacgtggggccctagagtattaattagtgaagacaagaacttgcagaaaagactggctaataacaacagaaccaacacaacatgagtgttcgggtttatattaaaatatgcactggagactggtcccctgtggtgtccataaaggaatagctttaatcatatgggaagaaaaggttagagctccaaaacacacacatctgtttgaagctggggtttttttccctcccaccaaataatatttactgtgcaaaggcagcaaggccacagtgtgttttgaatgtgaaagaggctagaaaatgaagcacatt

SEQ ID NO: 118494 - DNA, 1054 bp, Homo sapiens
agtaatgtagagagtttcagatactaatgtggaaagttttatgcaatccattccccttaaaaatttggctcaaaaaagaaactcacagtgtatcttttttaatgaagttttgagatacactgtagctcaccatgtaaaattttgacaaatgcatataaaataacttgaagtgaaagttacaaaaaaatttttctgtgaacatctgggccattgtaccagtgaatgaagagcttgcaaagtatattaattaatttaattaattattaattgcaaagtattgattaattagtggggcttacatatgtgccaggtagtgtataaaacatagggaaaacattttcaaggaagtacatatcttctaaattttttgaattaagtttattaatttttaaaaactcttcagggaaacaccaaattagaacaagtctgccatctactgtcaaaattaatatattgcagactcttaaagaatgattcttttttcagggctacatttatgtatgaacaatttccagaacttatgaacatgctttggtcacgaatgttaaaagacaacaaaaagaattggagaagagtttataaggtatggacacaagtctgctttaattacttgacatgttgaaaacaaatgctggaaattgaaggtgtatatacataggtgattttgaagtatattaaatcctagaatagaataatcgaaagcacatgaaagaagtagatttgttatttgtgttctattttctagtcatcatgaacaattgttctgaatgagaaattcttaataatacttctaaatgttgattatttcttaaaatttttcctactaaaatgtttgtgcatatcaaaaataatgaatctatagtagagtagtgtgcatgtttagtgtatgagcagttaagatgaataccacagtctgatatggtttgtcatcgacatagaaatttacctaatttatgatagtattctcacagtattttgtatccaaaatgttcaaaatataattctaattttaaacttatgaatacgaactttttatcagattccttttgttctg

SEQ ID NO: 118495 - DNA, 1031 bp, Homo sapiens
tgccaacatgtctggctaatttttaatttttttttttttttttttttttttagagaccaggtctcactgtgttgcccaggctggtgttggttattatatttgatagtaataatagctaacatatattgagtactttctatatgtcagacactgtgctaaataaacaccatttgctgtgctagcctttgaggtagtattcttatttattggttgaggaaactgagattaagataattaaaataattttgtcaaaggtcacatagtaagtgattggaatcagatctttctgactcctgaggcccacgttcttgatcattgctgaagacctaagggaaagttaagtgtccatcgtacaatctcctgatggaatattatgcagccagtaaaagtgagggttacagtgaatatatgacatagaagtgcatatgatagagtaaatgaaaaaagactcaaggatcacagttcagtgtttatagtggttctaaacatctgtagatatctttgatttattcttttaaaaatgtgatatagatactgttcagctgttacataattttgcctaatttatagaatttctataagcaggaaacataagcctgcattgcatgtaaaccagatctggtcaagaaactgacaacttagttttataatagactccagcatgttcagtttttgtttttgttttttttaatttgaccttcagccattttttactggacttaatgccagctctaatgtaatctctcatctgtattcttgaaggctaatggtatagtaaaatctgcttaaagataacttaagtgtgttacatagtgtccttggggtagcttgtgcacaaaagatgttttctctcccatcctgtagaggtagctcattaggacacccagtagtgtcattattaagttttcatgtgtttctcagttttgatgctaatctttgtgcatgtgtgcgtgcatttttttcctctacagcaccaatgttgttatgaattattcagagatcgagtctaaggttcgagaggcaacgaacga

SEQ ID NO: 118496 - DNA, 2045 bp, Homo sapiens
ttgccggtactttaaaaaaaacaacaactaagtgtaaagagataattttttaaaatttcaagttaggaatctcaatttaggattggtgaaagtccgtaagtcacttgtttgactgtagtgttagtttaaatggtatgaaatttattggggaggggcggtgtctttttctgtaattttgtttgcagatcaaattctagacctttgtctggattgttgtgtgtgtgtttaagaaaccgttgagagtgccccctctagcgtctgtgatatattcttaaaacatttgtgtcagaagttttcagaattaaactagccatttttttcctttcaaatctggacataatttttatttttatttttaacacggagggattgttttcttttttaaaaaaggtcactggaattatgggtagggcatagattgagggcagtagaaaacatgagaaaggaaggattaaaatgccatttctacctttttagaaatagttatttttaaatgacctggaataaggccaaaccatacagtgttgtttttagtttacatttgtttctgaattagttgaagcttaaaatactttgtcttggaattctttatgccatcaaatctcatcttgagggggttctttgcagtttctgaaagcaacagcttcattggaaaatagctttttttgggggaggggagtgggagacagggtcttgttctctgtagcctcaacctcctgggcttatgcagtcctcccacctcagcgtcctgagaagctgggaccacaggtacacgctaccacgcccagcaaatttttgtattttttgtagtgatggagttttgccatgttggccaggctggtatcgaacttctaggctcaagcaatccacctgcctcatcctcccaaagtgctggggattacagataggagccactgcacctggcctggaaaataacttctaatagatctggtttctttgtgtaagcgttctgttatttttttgttttatgtttgccatatcctcctgtggatatacttaataactatattgtaagtatgttctgatggctcccattgtttttcaaccaaagaaatgaggagattcttagattattggctctctgccacctctccctctaaacacagcactcacacaggccttcagctaagaatcttgtgaagggttacggaaacagaacctttcttatttgacccatgggcctttgtcgcttgaacaaggaaagcagtgttctgaaatctacagcatttatgaaggctctggtaaaaatatttcatgtacatggactggagattaacttctttcatcttgttctccaacaaattaaacaatgcaaagagatttcaagtgcattcttggtaatgaaatgcttgggtgaattataatcctaattgctattgttcattttcacagctgcattttgacacttttaactgcctaagccacgcattcttcagccaccaggataaacaaaagcattctgaaattcatcattttgtggcatcttaaattgtgaatctgttattggctgccttagttttattttggttccatggttgataaaattaggaggaaaattgttcttctacatttatacataaaactgttgcaatagaagcattactggattttaacgaaaatgtattccttagtggtcttaacatttttaagggggggtgggcagtggagattgtggatttattttagtcctggggaaggaatttatatttattttgtcacattaattgatatcttaggaggcagctttctccaagatttgaaagaaaataataggattttgcttttcttccatagtagaacagtgttctgaatttaaatctgaaagccagattgattcagttttttggcaagtcacacttaaatgcataattgttcctttaaaatttgacccaaacctgtttgttggtttgttctttaaacatgaagaaattgaagtgtttgtaataaatttgaaatttatatttaagagatttgagtgccaatttcaaccaaaccttccttattttaaaaatagaagtttttga

SEQ ID NO: 118497 - DNA, 1098 bp, Homo sapiens
gaggataaaaggtgacttttaaatacagattttgatgtcaagaattattcatccctaacagttttaaaaaatcatattaattccaaaattgggtacttaaattgttctctgtggttttgcatacatagcacttggtgtacatattttagtctgtatgtatatattttagttactgtttgctgcacttattaacctgataaaacaagatattggaagtacagataatattcatgtggtctaccatgatgtttacttgcctataaatagttaaaatgtagctaatgatgatacagtacttatatttttaatggcctttagtagtttaaccttggttacaatataatactttgaaaaaatttggaaaatacaggagagtattaatataaagaaaaacattatttaaaactgttgcttggaactaagttatgtttatttctgtctccagatgtttctgtcttttaaattatcttagtatgggtgtgtgtatgcatgcgtacgtcagaacacatttagaggtctcaaataaaagattgcctgatctcaggatgagtgaaatcttgacaataagcttaaaacaaagagaaaccatataaaaaatatagattcatttgacttcagtttttttttaaaggaataaaatttaaaaggcaaactgggaaaaatacttctcaatctgtttcactttactccttattcctttgttagcagttagtaccacattatacctatactttaccttttctcttggtgtatagttttgttttagcaaagcatattcttgaacttttaagaggaaaaaataccaacaaggactgctcaagttttttcttgttaattattttactgatgattcttaatgtagataagaagtattgactgcctgtaagtaaaagcctcattttagcttttaatcaattctacctctaaaaactggactgaaacttaccaagtaaaataatttgatattatctgaatgtcaagtagtcaaataagcagaaaatggagaataaagaggagggctacgatgaacactaataatttacaaactgaatagttgacccttgactaactgaatactggctgtgtttacatagctct

SEQ ID NO: 118498 - DNA, 1127 bp, Homo sapiens
tgcaacctccgcttcccgggttcaaccaattctcttgcctcagcctcctgagtagctgggactacaagagcacaccaccatgctcagctaatttttttttttttttttttttttttaagtagagacagagtttcaccatattggccaggctggtctcgaactcctgatctcaagtgatctgcctgcctcggcctctcaaagtgctgggattacaggtgtgagccaccgtgcccggccctttttagtttttatctatgcaggtggtgcactgatagaatacagactgctgagtcaggggagttaggggtgatccccagcaaaattaaatcagcccagggatacttctttagcaatttgagagaagttttactacaagtgctattttagttttcttttaaaaagtcagttttaaagttgtataaattaaaaatatttttaaatttttaaacagatgctcccccttcaacccactctagttattaccactctaacacagctgttttcatatggtttttttggttcttccgggctttgctcacatgtacatgtgtttttatatagttgttagcgttcatatacttttgtgttatgaggcttcttcttctatggccatggaaggaaaggaattttctagtggtgactgcctctgcctgctctgttgcttacattgttccaagtaccattgctgccacattttggaagctatttttcatcctacttcccttaacgtcacaatttttcacttttgctagccacaaaacagcccctccagcagtcttactgctgctagagtgcctctctggaaaataaaaacgccttagcattgtgggactagcctgtcttgagacagtttttctgtaagcctgtcatctgcccaggtcataatagcagcagcacctgtgctagagagggagtagaagggcttccatatacaacataataaataataacagaaaactgaatgctttacacatgtcatttcatttaatctccataatgataataatacataggtacctttcagatgaggaagcagagtcacacagtggttgatgtgtccagggatcaggtagtatatgccagagacaaaattcaggccctaataatctctaaaaaattattgatca

SEQ ID NO: 118499 - DNA, 1059 bp, Homo sapiens
ttgtatttttagtagagacagggtttcaccgtgttggccaggctggtctcgatttcctgacctcaagtgatctgcctgccttggcctgccccagtgccggaattacaggagtgagccaccgcgcctggcctggacttctgcttaaaggcaataaggaagcctttactagatttaaaataggagctcagtttcaattagtaaggatttgtatttcatcaagagctctctttggccctagtctggtagaagatgagtcgaagtagagagactagttacaaagctgttcccaataatccaggtgaaaaatagtggtgaccctagattaaggtagtattggtgtgggtagggagaagtggacagtcatatttgagaggtacctagggaatagaattgcaaagacctgggagtagattggatattcagtgggaggaagggagagaagtaatctctcaagtgttgctcaagccataaccttggatggtactgtccactgatacagtaggaggaaaatgtttgagggaaagtagtgatgaatttgtggtgcactaacatggccaacactaaatattagaaagattaatgtggtcatgtagaagatgaatgaaaagaagatacctcagaagtggagagatagttaaatggcttttgtaggaatctcagctagaagtgtcagtattcttaagtgcagaactaacaggtgtgggaaagtaatgggaagtagacaccaaacaaatagttccccaaagatggtatcaaatatcccagtgacagcttgcagcctgctcagctttatgatatgcccctgagatcatttttcaggacaaaaagtagtgaaactacctttatttacttctcaaatttacctttatttacttctcaaatatacatagaaagtaatattgtaaaaagcagctctggctgggcgctgtggctcaagcctataatcccagcactttgggaggctgaggggggcagatgacttgaggtcaagagttcaagaccatcctggccaacatggcaaaaccgcatttctactaaaaatacaaaaattcgcgtggc

SEQ ID NO: 118500 - DNA, 1044 bp, Homo sapiens
tatcttggtctcagctcccctttcttcctttccacctctcccttctctgttcccaagatatcatggagttcacttacatattcatttgtcagtttttcacaagccatcttatgttagacattcgttgttaggcaccgagagggaaagaaaactgcataagatatagtgtagtcagttctggttatatgaggtagctatgttttataaagtcgccttaagcagaaccattgctcctaggggaaaacacaggggtaggttcctttgagcctctggtgacattttctttagccagtcagtacgtcactttgttttttatgtgtgtttttatttaaagacatcttttttaatatataaaaaaattgctgatttattaacattgaactcactgccaacagcactataactgatgtctgaacagggcttatctcacacgcatttttttcctgtaaggcatatcacaatcttcctgtgtttaggagcactacatagcacttgaacactatgctcagggccattttaaacagcgaaattgccaacgtgtaaagcataaaagtgtgaaatacgttgcaccaaatagattatagaaaggacccttgtttatggtttgagaactgaaacaagaaggcaaagtgtcagcttgtttgacctcggatgggaatgtgtgctctggacaactcacgttttttgctcctctgctaatgttcatgaacatgaaagcaccgtgaatacagattttgaggttacattttagtgagtaggcaaatttgcgtatatggagtccataaataaagaggatcaactctatttgcttttttaaaactgacaatatattaaggtaattaaaataaattcatacatagccattgtacaggcagaatataatacataagagtttaaaaatgtaatgttggatttgatcaaaggaagggggaaattatgggttggaaagaacaggaaggcttcatttttgcatctttgttgaaaactaggtttgaaaagaggtggggattctggaagcacatagagtcactgagataagaaagt

SEQ ID NO: 118501 - DNA, 1021 bp, Homo sapiens
ataagcaaggtcctggataaagaaagagctggtgagaaagtggcagtgcagtgtggcaagaacatggaagaagaggagtagcttcagaggtttgtaagccactgtgtggagtttgggtttattctaagggtcataagcagctgatgaggaattttgataagggagcaaaatgacaccgcttaatgacaccactatgctcagggccatgtaacttactcttggtgctgagttggatagtggattggaagggagaacaagagtagaaggtgatagtggctgaaatcatgattataaacagcaattaataacatggtctctggaccttcatctatggaatcagactgcctgggttcatgttttgacagttaatggttgtgtgacctctagtgagatacttaacctctttgtgcctcagttttctcatctgtaaaatggggatagtaatagtagctgcctcatagagttgttaggaagattaaatgaattgtccgtggcttaggacaatgcctggcccattagagttatgtgtattaaaaaccaataaccaaacaaatatggctgtattgtggaagagagtgtgaagtatgagaaaaagcagtcttggctttgtacagttcttctgtggtaatagattgtgcaaaaaaaggagagggttccagtatgtacaagtttcaattaacaacctgccagaaaagtgaaaattgtctatataaaagaattggtacatctatagaaatgaaattcgtgatggctcccaaatccatagtttacactcagcatgggtaggagaagttttcatgtttttgaagtatgttttttaactttagatttcatttagttcttcaaatctttctatgggacacagaaatcttgtgccaagttatcttaactttttaagtcttggcaaggggtcattgagttaatttcagaggatatagtaaattaataagtctttctagtcatgcccccaaaagagctggctttgtgtgtttgttgagtagagggtgtttattttagttcc

SEQ ID NO: 118502 - DNA, 1147 bp, Homo sapiens
agtattagttttaaatgaagagtgagaagggtaagtataggagggacgtgagtcaagatacttcctctacttctgctgtataaaatgaggataaggtctaccttccaggtctgttaagagaattaaataagctaatatgtgttaagttacagtaaaaggaacaaccactattgtgtaagttatgcaaactttattcttattcttttgggacacccactaccaacaatattccaaagccatgttggtatgtcaagcagtcttaagatgcttgttgtttgtaaattatttaccattgtgttgtcagtaaattattgttctttacttttgttttatttctttagttttgtcattgtgaggcattttctgaagttgttaaaaagtttaaaatttagatgaacaaaggccatttttaggttccaattaataggaattaagttgggaaataaatttttataaaatttaaacccctttaacagtaaaatttttactctaaaaatttttttagtggctatcttatcatacctgtgaaaactagaattgggatctaaaatacaaataaaacccttgggctctactcatttttgagtaccttggatatttgatcttcttgtgaaaccagtctaacatatgatacctctggcaagaaaaacacctcaccgtccttacttttataaaacaaaatcgattaactttaaagagcaaataagctgtgcaagtggccttaagcaactgccagcaataggaaagaatatttcatggttaaacttacacgcaaaacgatgtgagtctgaagttgctgtaagtacagaataggagtgttttgcttgttaaatagaaataatatttctatactttgtttctgtaaatgaaccctaggagcttaaacttttaaaatttattgaaaattggatttgaggaacttgtactggaatagataatgtgtaccacaagatatgcagttggatttgtaatggctgatatttgcaaagcaactttcaaataaatattttatggtaaatattcaacaaagtttttctaataagtgggatggatattctagtgatttagagtcataaatagtctgttaccatcatatccaaatataacattttgctagtgtttattaacttctgtcattaactagaac

SEQ ID NO: 118503 - DNA, 1958 bp, Homo sapiens
aaaagttggaaatattgtaagaattactaaaatgcggccgggcatggtggcttacgcctgtaatcccagcactttgggaggtggaggcaggcggatcacgaggtcaggagatcgagaccatcctggctaacacggtgaaaccccgtctctactaaaaatacaaaaaaaaattagccgggcgtggtggcaggcacctgtggtcccagctacttgggaggctgaggcaggagaatggcgtgaacccgggaggcggagcttgcagtgagccaagatcgcgccactgcactccagcctgggcgacagagcaagactccgtctcaaaaaaaaaaaaaaaatactaaaatgcttaatgcaaggttgccataaaccttaaataggtgtgaagcacagtaaagcaaagcacagtaaaattaggtgtgtccatatttcgctaccagaaaggtgaattagtagtatatacctcacacaaattaaaaaattacttgggaaaaatttatagtacttaatttttattttattttattttattattattattttgagatggaggcttactctgccgcccaggctggagtgcagtggcatgatctcggctcactgcaacctccacctcccaggttcaagtgattctcctgcctcagcctcccaagtagctgggattacaagcgtgtgccaccacgccaggctattttttgtatttttaatagagacagagtttcaccatgttggctaggctggtcttgaactcctgacttcaagtgattcgcctgccttggcctcccaaagtgctgggattacaggcgtgagccactgcacccaggctacagtacttaagattctgaaccaaattcagttgcagtgtgttctgttttccacatatgcacctatcatagaaggaattttttctgacctcttgcaatattctgaataatgactgtgaggtcggtgacccttaatgagagggaagcaaatagatgtttccataggtgaaaaagaaaatcttcactgttgttatgaaggtgttctctgtaagcaattgtaaaaaatatttttacatttgttgagctgtattatgtgcttcagaatcagtggtcctctgtgaccaacttttaaaagttctataatcctgtgatctttatgttttggtcagttcgacatgcctcagtgtgtgctatgtcatatgaataggatttatgcacaactttttccaatttttcttatgttcagtgtggataatttggaataatgttctttaatcgcttatgtaccatctaagtactatatttctggcataggatgtaaacatctagacgttatacagtaactcaaaatacattattgatatccttactaatcttggctgaccttgtaagggtccttcactgagtgcttattaaatagtaaccacaagccctgtagagtactataagacatgtgacagatcttagggttccagtaggcagcttacggttctgtaaggcatatgcatatgaaaactgcatgaaaaatagaaaatgacacaagatgatatatcagtgagtactttcttagaagctagttctgtcataaacgaaagaaggtccatattataccctaatcaaatagtgcagattaaataatttgagatataaatgtttcttttttgagaacttgaggggaaaatacattataaaggtcttcaaaatttcagtagacaggttctagaaacagttttccttcatgtcagaaaagtcaagtctagtttttgagattggataatacatctaagtttaattactggtgaaaaatgaaaaaaactatagcctacttaatttaaacagaatatcaagtatttgagttcacaaagagatggtatcactcttaccactgttgagatataggatttttcattttatcattctgttaaggttttttacagttatatacttttgattagcatctgatatttggcaatacat

SEQ ID NO: 118504 - DNA, 1062 bp, Homo sapiens
ttaccaccatgcccggctaattttttgtagagatagggtttcatcatgctccccaggctgggctcaaactcttgagctcaggcaatccgcccgcctcaagcctcccaaagtgctaggattataggcgtgagccactgtgcccagccagtaatatccttagtttgatgtatttggcttataagttcggtactgaatggggctttgaaggatggcctgtttctcactaagcatgtaaaatgtttagccctgtcatctgctgtccactcagcagcgagagggattctttaaaaatactaagtcaaatgggttcagaattctccagtggcttctcatctcattgcttaattgcctgtacagatctggctctttgttgccccgcctgtgatctcttctcccaccactgtccctcactttctctgttctgttcagtggacctcctgtattacatagtatgcactcacactcgtcactatttttttctgtgcttgccttcctctgttacatgtattcatctcctgcctctgatatgcaagttccttgagggcaggaactttgttttgtttactgctgtattactaactcttagaacaattatgacacatagtaggcgctcaaatatttttgaatgaatacattaaatttggtaagttgatatttattacagaggatatcctttaaatccagatatttctaataataaaagctaatagttattgagcatttgccatgtgccaagaacaaaggtgacaacattgttatgttcaattttcttatgaggaaattgggcacagaatgccaagagtgtgccacagatagcacatctagaagatagtctagatttaaatctagatgatatactttcagaatatgtatttagcagtttatgctaatcttttacaagacatcatgtaaacaaaaaaattgttatacaggcatacctcagagatattacaggtttagttccaaaccactgcaataaagtgaatattggaataaagcaagtcatacaaatttttagtttcccagttcatataaaagttatgtttccactatgtggtagtc

SEQ ID NO: 118505 - DNA, 1033 bp, Homo sapiens
ataaagtctttggaaagacatatcgcgaattccatctgccaattcttaatattttgttcagcttgttttgtgtattctcaagattttaaagtaactgctaatgtaaaacattactaaaacataaaaagatttatttcataaatgcaaattgaagcagacaatttattcttaagagactgaacaatatcaagaaaaagaatcctctaaaatatgtgataccaaattcatggtgtttgacaatggacaaacagtatatacaaggaaagcacattggagaaagggctttctggttattcaacccctcaaattggcaagaaattatttggcttaccagggctcttttgcctgaaaattaaatacaggtaaaggaacgtaatatattcctatgtttgagccaatttatagctacttattacttgtggatagatttagctaacgaattattaaatgtgagtgattttgttaatgtgcaacagtgcacatgaatggtttgtacttcatttaagaagagtctagttagccaattttagaatatttcatttcttttttttttttttttttgagacggggtcttgctctgtcactcaggctggagtgtaatggtgccatctctgcttcagcctcctaggtttaagcgatcctcccaagtagcttaagcgatcctcccaagtagctgggacgacagacacatgtcacaacacccagctaatttttgtattttggtagaaatggagttttgccgcatttcccaggctggtctcgaactcctgagctcaagcaatctacccaccgtggcctcccaaaatgctggaattgcaggtgtgagccactgtgcctggcctagaatatttgttttgacatgaattttatttagcttctcaattcttaggacagtatttaagttctagataactttaatataaataatcttttataattttgcacacactcatcattatgtggtaaacgtacatgcgtgctttttcaacaactattgaatgaaatgtttcattcaagaattctcattcaaata

SEQ ID NO: 118506 - DNA, 1101 bp, Homo sapiens
cttgttcccggggctgaagtgcagtggcgagatctcagctcactgcagcttacacttctggggttcaagcgagtctcctgcctcagcctccctagtagctggaattacaggtgcctgccaccacacccagctaatctgtgtatttttagtagacacggggtttcgccatgttggccaggctggtcttgaactcctgacctcaggtgatccacccatctcagctactcaaagtgataatgatgtatttcaaacactggcttttgagaccttgaagactttttctggaagtgggggtatattttccacaatcgctgcacctcctggtggcagtagagggatttgttttgcagaacattgtggaactgagggaagcagataaagccataggcctgccagagcttggaatgccagtatcttcccactcgtcaagttgcataaaaggcgatgtggcaggaaaggataagtggcaccattcccaccaactaggagcactagcttaatcattgtcatcctatgacctatctttacttgtggctgtaataaaattggacatgtttatattttgtcatcctatacatggtaaaattgaaagttgctgcagttctattttctctctagatttgaggaatgtaatgaaggtgacatggtagtggtagatcaaaactgctacttatttgttcaagctcagcgaatccttctctttccttgcaaggagtaatattagtggtaaatctctttcatcagtgacccgcccccccccccgccttttttttttttcggagacagttcactttatcccccaggctgaagtgcaatggcgtgatttcagcccactgcaatctctacctcccgggttcaaatgattctcctgcctcagcctcccgagtagctgggattacaggcgtctacctccatgcctggctaatttttgtatttttcatacagctgaggttttgctgtgttggccaggctggtctcaaacttgtgacctcaggtgatccacccacctcggcctcccaaagtgctgggattacaggcatgagccaccttgcccagcctcagtggccctttttttgatagtgattcaaacagctctggcta

SEQ ID NO: 118507 - DNA, 1043 bp, Homo sapiens
gattaggatatcaacttaaatagttttttaaaggccaaaagaagactaaaagctaccttttttttttttttttttgatggggtctcattcttttgtgtgttcataactcactgcaccctccaactcctgggctcaagtgatcctcccacctcagcctcccaagtggccaggactacaggcatgcatcaccgtgcctggcactgcctccttatttctcagtcagaggtcagaagaataaaaccattaagaaacaccttgttctcttagaggaccaaatttgtggtactcaaaaatttgaagaggctgtacattgttcgtaagacagaaatcgaggcaatattcctactattgttgtacctttcatatttgcttatcacacttgttactaatcttcacgtgctttaggttaaatttgccatgtaagtagttatctaaaggaaaagctattgttgaaaaatattatctatctttttactacccaatttaggatgtagacttgaaccaaattattcaagaacatagaagaatgttgtcaccaaagactttttaaggcttttgtgggtgtctgacacatattaagattagaacatgaggttgatttactgatgagtactcgggattttaattttcatcttttcactggcaagaagagaagaaattcttccccccaaatgtaagcatcttacagaaccgtggatctgttagactgtgcaccttataatgccataatagacgtgcatccatagaatggttggtctgattatcagaggtataaaatgatgaaggaacttgcaaatgaagaagcagtgacgtgattaagggctattcagatagatggatcaatagaatgagggcttctatgagagaaaggttaggggtttaactatctggttcatattctggcattacgtttttaattagctgtatgtatgatttgaggcagaatcacatgaatctccagactttgccttccttatctgtaaaatgaggggacctggctagagtaagactttttccacctttgatggctattggagaaatgc

SEQ ID NO: 118508 - DNA, 1030 bp, Homo sapiens
tccttttacttaagtcagtttcttctgaagccgatggcctctcgagagcttggtggcacacatactgtgtgagaatctcctttgagacttcatggaacagggtccaggcacagaattccacactctgccctccagttaacaagccaaaacctcacgtacgctcccccatttgcaagtttaaagtttactcgtcctaaatgcagacttcatacctatcttccaaaagttgataaaagcaacgtggcaggtattttcgattttcccattccagatactgcctctatcagtcgacccttaccatttgtaacataatagattgaaacaacaggttaagtgctttggaattaagagttaaagggaaccgggggtggagaaaggaaaagaaggttgagacctccaaaacatagttttctgttctatgggaatttttgctctcattatctgggaagtgttcttaaaaataagaattaatagcaaagatgcagcaaagctctgaggatgcatttgcctgatatttttttctttgctcttgtgtttttgtatgtagttataaatactgtagattttttttttgtgattttttgccaaagttgttgttctatttatacattttaatgtcttaagacattttttcaatatcacaaaaagattttactgcgtattttgcaaagaaaaaaagctcactacctttagcttgcacatacttgcaaagttaattaaaaggctttttgttttaaaggggattttgtaaaatatccatataaataatgtatttatctttcgaatttgtacattgcttttcccttcttcctcttccttccacccccaatttattttattgtgtatgtttgctacgtgaaaagtgcgtatttgtttggtcacctacacttgtattagctgtttcaatgtgatttttaaacatttcatttatagttatttttagtattgttataaaccatgcttcagtttttttaatttccacccaaaagtcattgtctatttttgtattatttgtaagttaagaagtttt

SEQ ID NO: 118509 - DNA, 1007 bp, Homo sapiens
ctgtttcatagaactccatgtataagattcacatagcttaggaaactgagtctgacaaaccattcactcctttttcatgtagcctgagtcaatgtctgggggacacagtcccattaatactcagtaatgcaggtagtcatctacagccttcccttaacatcaataggggaggtgaattgcagcctctcttcctctccccctgggtaacctcagacttcctacatgttattgggaaggatggaaaaccccatggtgctgtcctgtatggactgtagggtagtatgaaggtatagttaagataatggactttcaaagtcagacaaatgggcttatgaatctcagctctgttcttaaataggtgagtgtacttcggtgaggtttttgactttctgagcctcagtttccccatttcggatacaggcatgatgatggtgagactaatataacaggtttgtcatgagggtcacagaagttaatgcagctgaccattgaaaaccctgagcacggtacctggcaccgaaaaaatggtattattgggaatatgactgggggcagctgaaggggatattcctttgacttttcaggaaatcattctgaagagagcggccgacattgccgaggccctgtacagtgttccccgcaaccacaaccaactcccggcccttgctaacacctcggtccacgcagggatgatgggcgtgaattcgttcagtggacaactggccgtgaatgtctccgaggcatcacaagccaccaatcagggtcagaagcttgcttttctcttccctccccaaccttaagcaccccatctcctcatttattggtcatgaacaatttttacattaaaaaattattttcatcccaaaagggagattcttagtttatgtgtataagatattattgtacaatattggtcctagctatcattcgggtaatctaatatagagggctagaaaggatgcatgcatttagccatctctctacatttgacttttcaccataaacca

SEQ ID NO: 118510 - DNA, 1026 bp, Homo sapiens
cttatatactaaaatactatgaagtctttagaatgtggggttgtaaaatataattgttatacatttggcattttatgcctccctgcaaataactacttgctacctatacctcatttatgttcctcctttccatttcaatttactctaaagtggtccttagctataatgagaatgcccctttcaacagaaacatgtttaattatatccatgctaaatgtaagtgactcttctcagtcatagggcttctaaggaaagagtgtttaaagtgtgacactaaaggcttctaatgatctgcactaagctctatttcaagaagtttatattacaagaaaaatgaaaaatttgaggaatgtctcagaggatgggaaactaaacggtgcccaagtgttattttggtttgttttactctttccctcactgccctcattatactgattttttagaatgcaaagtctaccattgtggaattttccatttggctgaataaacacaaaggaagctgggatataaaactaccctccaaagaaatacatctcaggacaactagtatttattgcattgtacatccagctctgcaggaaatgggctgcaagaaacttccaatcaatttctcagcattcggcctttccaatcagtaatgtcacccaggctttcagaagtcagtggggaaagatccaggacttaaagtctaggagctgaatgcacacatcaaaatctgggtcctgcagtaaaccctatacgaaggaaggcagtgaaatcaatgctgatttcattgataggtgcttatcatctctacatcaagagtgattttctcatttcacttcattgtgtgttgctgatatttggccactatattttgaatcccctgataaagcaaagtagattggtgataaatgggtatcagggaaatgtgcagtgacagggaagtattgtgcttctttctcagaaatcacccaactcaacttgactttgattatggatgcttgtagttttttttttctgtttcaatctacattcctgaaaaca

SEQ ID NO: 118511 - DNA, 1088 bp, Homo sapiens
cagaagttcacacttcattttctttaacatccatagtatttcaagatgtgaggcttggttttctggattgggtgagctaaccctcttatttgttagtgaaatatcacttggaatttttcccttgaaaaatattattgagctgaaaagtaacaccccaaactaaggccttattgctgtttttaaagtatgcaagagagagttggcatttgtagatgtaaatgtctctaaaagtccataacattaaaaaaaaagaaaaaaggcaggaacagcatggcctaatctatactaataaaggcagaccttttggggagggaagaatctgaccaagcacagattgcctgcaagctggctccccttgtaaggatggtaagcaagcgtacatctctccctcattggttcttcagaccagagacgcacgaggaatccatagctgctaatgtgccatgcccttgtgtttgtccaatcagagtcacagactctggaaagtgaatcctgactggattagaagcagaaaagctcaatagcactttctagatcttactttattgtgtccagttattcttatgtaaatgtagggcaaggctgactttaattttcaataaatgttttctaagagaaggaaacaaaaacactatctaatcacaggattgatttcaaagccctattatcgtttctggtcagtccagtgggaattaaatccactataacctcactgccatgtaagggctctccctaatacctttattattctcacagcttgttttcttgcaggtgttacatctttaagtggcttggatcttttcgaatcgtgatctctcctgctaatccctaagtagccttggaagctaataaaagactcttaggcacctttagctgcttcctcaaagtttttgtagttggttttcctgataagaagcggccaattccaaatgcatgtgttgccttcattctagttatattttctgtaagaattttcatatattctcggggaatatatgactgaaagaatgggacaccaggacaaggtttgagcagcctaggggtaccctgagagctgtacaccacctgaccccccaaaagttggtgaa

SEQ ID NO: 118512 - DNA, 1022 bp, Homo sapiens
aactgtccctgacaatatggtggtgttcttgatctttagcatatgaccttctataatccttttgatccagacagaggcagtttttgcttctgtcagttgcccctgggtgtccagcaccattgacttcctgtgaccagctgcatttaaatgtgtttttcatttgtttggtttttttgtttgtttgttttcatgtttttacggaaatgtggagaaagatggtttgagcttggagagactacctcaaattgagcctgtctcttttcccttctgtataatatggtcctaacaagaggatagaaggaggatcaggctctctggctgaagtggccctgggaaggtcactttgcttctgtgggcctcagttttgtatgtccagtgagagccaggtggggtcctctctaggcttccttttagcatgtactattttatggtgctctgaactaaagctattggcacatgactttctgcaggaggtgactttggagaaatagagcttcctgggaacagagaaatccactggcattttctaatagaacccttcctctggatctccagccaagggataaggtgtcaataaggtggacttgaaatcgctcattcatactaagcaggcactacatgccagacattaagctaggtgcagtaggataatgcagactcagtccttgtcttcacagaatatatgatgtgaatagagaggagaggtactaagcaaaattagagtggtgcatcaaagggggaccacaaaagcagaggagagtaatgaagtgtcagggaagccttgtttcaggaaatctcatttatgccaaaaccgaagagatgagtaggtttttactaggtgtcttagtctgttttctgttgctttaacagactgggtaatttttgaggaaaaggagtttatgtcttacggttctggaggctgggaagtccaagggcatgatgccagcactggtgagggcttccaggctgcatcatcctattgtggaaaggtgaaaaggcaagcaagtgtgggtgaagagagc

SEQ ID NO: 118513 - DNA, 1003 bp, Homo sapiens
catgggcggagggctcggaggcttgacccctcggaaggtacgccctcttatctggaacatggtaggcgaatcattttcattggttggcattgctactttaactgtgaatatatttggtttctttcttccactccaccacatgttctattctgtttcaaatttcaaaagtctttttgaataagattggtcctctagggttttttctcttcaacatatggtggcaaatatttaaagacaggaaaatatctctgaggcccacctttcttgtgggaccactctctactctggaaatggctgatattgcctcctttcaggttgagagaaagaaggaggcctggaccattgctttattctaagctcccactggattacaaaataaggaaaggccaatccaagggaaaaataaggaaaggccacacaatttggtatcactaaaattgtgatatatttgacatgtttataattgaccattgaggttttataatgaacccatcctctttaccaccctcctggtgtatctctgtgaccacctgttgaacttcatttggagatcaggttcaatgtcgaggttggaggtgctttctgaatatgaagcccagaccaaatgtccctcctgtgccctgtacctaactcttacctcttcaccatgtgatagaacttgctgtctgtaagtagactttggtagggagaaatcccatttgtcttgagaattatggctaatcagtggtgcctttgagaggactgaaggaaaccagataaaaatttgaatcaaggaaagtgaatgccactcagaagaaccatgggttgggttaggggcacgcctgaatttttcagtgctgcatgtgtgtgtgtaatatatccactcttcctcctctccactcatccatccatccgttcatctatctatccatctatccatctatccatccatccatccatccatccatccatccatccatccatccatccgtccatccgtccatccaagaatgagtgactgagg

SEQ ID NO: 118514 - DNA, 1099 bp, Homo sapiens
gagttttgtaggcaagtagaaaaaacaaatgaaggcagagtctgaaatggtcgaatgctcatcaaagaggagccataatagcaaccctggaaaatccacttcaaacttttcaagtatctagtttttcaaatgttgttcctttttatgtccattgtaataattagctctgaagctaagataggattacagggagaaagaaaatattaacaataaaatatctaaccatatggaagtcttggtacactccaataaatggagaggtgttttcttcccgcaaactaaggcaggtgagaattgtctgccctaagaactcagcccacagagctgtgaccttgtatgcagattgattcccaaggaaatctcaggccttctttgcccctagagttttgtcgctgtgtatggtgttcaatccaggtgtgcaaagacccaaagtgtctctgtagttccagagctgcctctgacaggggcaaagaaacaaaaaaagggtcgccagttaaagaaacactgtatcccatcttgaaccttgagttagatgaaaatacggaggtaaagttacacccaaattacatactaatgattttttcacatatgaaatcatggcttagaagaagatatagattattcaggtctgtttagaagcaaataagtaacctcttccaacccaacacccaacaaccaccaattttgtcataaaaactcaggcccttcctctaattactggtattctaggcgtaatgtgaaccctctcctttcattgacaccattattagctgggatgtcaggctatcctgaaacctggccaggcacaatagagcagaacttacaacaaatttgaaattaacattgaccacttttatgggactgtcatggttcctagtgctgcatgtttaaccttttagagaagaaagtacaggggatattgcacagctctttgtgaaaaattatgcatcatatttattccatgtttgtgcctctgtgtatgttggcatgctttgttagtttgtgtggtatgtctgtatgtgcttagacatatgcactatgtggctttatatatatatatatatatatatatatatatatatatatatatatatatata

SEQ ID NO: 118515 - DNA, 1032 bp, Homo sapiens
actaaaacaaacaaacacacacaaaactaaattatgtaccgtgggaaatcgtgaacttcaatacctcctcacttcaggataacctgtgattcttttgtggaagacagagtaacataccagtttcacttgtggattaacttcctgagtggacagaaaatctgtcttatgctcaacagtcaagttgttttatttatctttgatgtttcaggcaaggggaagaaaacaaatagtttccataataaggtagacactagcccaggatgcagtaaagcatttcctgaggacttggctaaaaggaggtagaactaataccatcaaagctgattgagttttattttaaaatgttaaatagaaaacctacactttcaaaagtgatccattcccaagtaaagggaaaatgacatcatctcaacttcagtatataaaactcttgtatatttgataccaggcttagcagcagggtggcgggggcttcggggaaggaccaaaaacaaaggcagcagacaaaatgaaaagtataaatagaagtattgaatatacagtaacctggaggaaattactctaatgctgctctcagttcttgtctccatttgtaacaatgagaaagaaatgactgaggtatgtaagataatgctataggagtcccatggttcagacaggaaaaaggtctgtgtctttagaaaagaaaattaaaagattaatggagctcgttgagaagtttgcatggttctgagaggcatgtagaagtggctggtggctatttgttttggaattaaatatatgaggataagggctgttaaatgaataagcaaatgcggatcatctttgacattctttgtaggaaagcataattaccacattgaataaaggcctagtggccagacagcaggaattaaacatttttaaaaaattaagtaagtgtaacatttagggaaaaaactcttaaaatatccctgtgtgacagttttagctttgcacaatttttttatatctagcatatatattttcattttacgcattctcacaacaacc

SEQ ID NO: 118516 - DNA, 1084 bp, Homo sapiens
attatttttatagaataatagttatggaaaggatttttgggggtttagaaatataacccttatattaaaggcacatttcaatggtggaagtataaataaaatgtattaagcaggcactatttgcttttataattttgtcttgaagtaaacctccaactttgaagctattgaaagaaattcctcttgtaccattttgattcattttctttttagagcccaccaaactttgttcctggacacatgggtagtgggaataatattgtggactgtttctgttcttatgtattagcacactgattctcttccaagagcatgaccttctcagtttaaaaacagttgatatattaattagaattaagttaggttgtaattaattcccactcatctccacccaccacactcctaccaaataacagtagcttaagtaacagaagcttgcttatttgtttgttttcctgtttaggaaatctggagatggtgcagtgtggggtgtggctctgtgatgttggggccctggtttctattttcttctgttgtgcatggctacaattcccaaggtcacctaaccatcagagagagttgctggagcttcagcctttacctgcacatggtggccagtggaaggaggaaggagagaagaagagggagccctttccctttggagatctttgaggaagttacacttatcacttctccatgcatccattggtcagaattagtcacatggccacaagggaggccaggaaatcttccatttatctatccagttatgcaccattcatttacttaacaaatatttattgtatattcactctgtgtttgctttattcctggcaataaagaggtgaacaggcagacaaggcccctattctgatagctcttgcatcctagcagggagctagacaataagataaaagtgatatgtgctgtgaggaaaataaagcaggttgatttcataaagaggtgattcatggccaccgatagggattactttagattgggcagtgagagattccctttccagaaaggcgacccagctggtgaatgcattgattttgggtgtgaggagaactatttcaggcag

SEQ ID NO: 118517 - DNA, 1026 bp, Homo sapiens
acgagggaaaacaatcacctttgatgacattatagaataaacacatttaacagcacgctgaattgctgaagtatcattttcaacgacctcattagtgtcacttaattaaaacttcctgctcttgactttgatgctggtacaggcaaaaacacagagggaattgaacaaacaacaaaaaaggtgtagggggtgcattttctagtgataaatcgcagaggttgctaatgaaaccgaattatgtacctttttcctgcaactcccataaaataatctgaaacacgcagcaactttgcatcaaacaaattaatcagctgtcagcagatttgccttataataatcttttgcacttattgatcatttaaaaaggggaggggctttttttctctgtacacaagcattaggttggtgataattaaagcctcagcttcagaaatgccataataactgttaattagcaggatgctattttcaacataatttgctaattaggcagtgagctggtatagtgtatatacctaattatgaagggtcttgtgctgtagacacatgtgactggagtgtaaatgacaccattataggggtcctagcagactttttaaaaatatagtttgttcagaagtacttagttctttagggacttcttcgtatagggaatattactcttggctgttttgcatgaggcttagaagaggaaacattatgtagaaatataccatttcttttatctgtactgtggacagacagggtcactaattctaaagaagctttgtcgcctgatgcctgatacaaaggctgataatttaggcactgaagttgtacatactctactagtagagaattactctctgtttgcttgccacacgcgattcatctgtggaccaggacgctctaaatcttttaatattatatgtctgccatactttgatttttctgccacacactgataacctataacatgtatctctctgcctctgtctctccctcctacttttcccttcatgtcataaagaaaatctagacttttcg

SEQ ID NO: 118518 - DNA, 1034 bp, Homo sapiens
cattttcaattaaagtctgctctgtcagacagacataacttctcacaaaaagctgtcaggagctgtctcctacccaaatgttacacagataatgattataatcataattggtttcaattcatatacaggccatcctttcatctggagtggttttattccagagatagtccaccaggaagtgtcctctgttggggattcactttccattggagtccatcctccatttgacctgcggggggggggggggggcggtggggtgaagggggtgcagtcagaaggctaattgtgtggaaagagcctgttttatcttctctccttgtaaaaggctggataaggtggcctgtatgaacttcctgtctttgatgtctccctgagaatgttccaagaacgttccaagaactacagcagccaaatagcacagcaaaatgcttaagatcctgggctctagagtcagacaaacctaggttcaaatcccagcttcaccacttgccagctgtctggccttggggaagttattttacctctttaagcttttgtttactgatccttcccatcagacgaatcacttcaccttcagaacattagaaaagaggatgtatttaagtggcctaggataccacagttctggacacagtagtagaggttgtcacagttattactactccctggactcgtcgcgatctgatgtgggacctccaattcttgggcaaatcctgccctttggtttcagcaggtgtgtggactgagaaaccgtcctgcacacaatctccaagttgttcagtcctcttccaggtgaagcagtttgcaggatccatcacacccagctccttggctagttgctttgtggttctcttactagcaaaggctgcagctggtgattctgctaaattgaagtgagaacaagaaaactctcccagaatgcaccagggcgaggcaaggcactacagctacccgccaggtaagtaagtactgggtgctgcagttagaaagagagcaggaaagcccctgggtgaagcctttaatgaggagagtgg

SEQ ID NO: 118519 - DNA, 1124 bp, Homo sapiens
tattgaatagatacaatgggaaagcctgtatttgttgaaagaggcagatatagacatctaaaccaaagtaccacattggccagccatgtctagattgggtgtgggtcacctttttatcttctaggaaattatcttacttgttgaagtggcctcttttggaaaaagcctgaacatagtttgtctattgtgatctgttctttttcctgaagaaaatattttctttttagtttttaattttaaaaagtttaaaaagttgtttttgtagagatgggggtctcactgtgttgcccaggctggtctcaaactcctggcctcaagcaatcctcccatctttacctcccaaagtgcttgggattacagatgtgagccactgcaccttgcccataatgaaaacgttttaaaggaactagaagaatgataaatgggtatgccatcacgatgtggaaactatgataattcgaaaattaaatctgctcaaatgcttttgtggattgataagagacaagtgattatggatcaagtcattaatattcatcaatgtaaagaataagttggggaattatatagaattgtaaggagaacaggaaaaggtataaaaggggatataaattactattctcctatatgcacagacaaaaatcacaaatgtctagtataaaaaaggaagggccttgaaatccattggcatttccagaaaatattccatgacctactcctgttgcaaatgtgccttttaccattgcagggtgataaaatgccatgatccaactccagagtacaattaagggcttgtgtgatacagcaggcagccattccatacttgagagttttcattgtataattaaaataaactgaggggcgggaggcagggaatgaagtaggggaggaaggtccggctgaagcgtattcagacatgacattttctaatgtcgataaccatcgagagctcggcttctctgtccatgaagacgagaatgccacatgtcagtcaaaggcagggtcgctgagcagggctggagactggagaaagcaagggagggttcatttggctctgggagagcgcagaccggcctcttctcaggctttaattgtgcttcctttgtgtcagtggtgtccacgtccag

SEQ ID NO: 118520 - DNA, 1049 bp, Homo sapiens
acacacatttatatttatttaattaatgcagtatctggcatattcaagcaggagcttgtaacaaataagtaacaactgtaagaaataagtatttgttgcataaacaaagcaatggcctgcaggtactcctcctttggtaagccattgctaagcaactctttgctactcttcctttcagctgctggctgaacctgcagcatcttcttgtgactcccctcaatggtagcacacttctactctttgagggttgatctgagtttcggaaacagccagcagtaatttgataacgaggctggtgtaaaacatcagtcgattaaagatcattttagatcagaaatgatgcgtccctgtaagggaactactatattgagatgaactcaaaacattctgcctggatttccaagaagagctgcaaatgctctcaagcagtcttccaaagtgacaattaagaatgggatggaattcattttgatgtccagctctggtctaaaagtcagtcacattccaggtctcactctggcccctgtgctctggaaagagaggagcagtgagatatggccattgttgatatgaaaagcagaaggtggaggtcccaggctgctgagttagccctcagtttgaatcctgcgtctgctgttttttagctctaagtcctgaggcctctaatatacatctactctgcaattacttctctctctctctcttttttttttagatggagtttcgctcttgttgcccattctggagtgcagtggtgcaatctcggctcactacaacccctgcctcccggattcaagcgattctcttgcctcagactcccaagtagctgggattacaggtgcccgccaccactcccggctgatttttgtatttttagtagagatggggtttcaccatgttggccaggctggtcttgaactcctgacctcgtgatccgccctcctcggcctcccaaagtgctgggattacaggcgtgagccactgcgcccggcccaattacttctctgtaatttttttcccctgaggattggtggggaaaaaaaatgctt

SEQ ID NO: 118521 - DNA, 1094 bp, Homo sapiens
aaaaagagagtgaaaaaaagtcagattggttgtaaggaccacttcagttgagggtctccttgaaggtatttaaacctgggagtgatgttggcatcttttctgcattaggggtattggctgtttgccaatcatttcccttgaaaaatatcatgcggccataaaggaactatgaaatgtttggcagaggaagcgtccatggcagaatagggacaaagggaaatggagattttctgattcagcctctggtgccagacccaaataaaaagaagaggcacatgccatggaactatggcttacctgaaacaccctgggtcaaggagctttgaaatggtagtggcagagttgggaccatttttttcttgaaccttgattaaccaagtgctctggagataaaatgttcagagagttctaatatactcacttgctacgtattgttttctacatttagctacaactgttgattcagcatctcctataggccagatattatgccagacctaatttgcaacaaaacagatttggttcctgccctcttgggacttcctgcttagacctgcctcatcaattttcatttcttatgtgacttaatctttgtcatttaaattccagtattttcttgcatccatgacagtgcttaccattgtattaataataccttacagaaaagtctggtaaatatctataattttattggctgttcaagtaatgtttaaatttatgaagcctcagttttctcatctgtaaaatggggataataatgtctatctcacagggcgcttgtgaagagtgaatggtataatgtatagaaagcactcagcagagagcttggcacagagttcttagtaattgggagctgctagcatttttcattagaagtgtggctcacgcctgtaatcccagcactttgggaggcctagacaggtggatcacagggtcaggagatcgagaccatcttggctaacacggtgaaacccggtctctactaaaaatacaaaaaattagctgggcgtggtggcaggcgcctgtagtcccagctactccggaggctgaggcaggagaatggtgtgaacccgggaggtggagtttgcagtgag

SEQ ID NO: 118522 - DNA, 1046 bp, Homo sapiens
aagttctgggattacaggcgtgagcaaccgtgctcagccaatcctgagaaactcttgatatttgtattttcagtggtatccaggctaggttggtacatccagaattacttacaagaagcaaatttcctttctttttttcttactttttctgggctgggaggggtgctagggacttcagatgtcatttcacaactttatacaaggaacaagatttttgtggcatcaatgcatattttctcattgtaaattttacttggaatacatagctattagtgttgataatttacaaataccctgttcaatttcaaaaatgatttttgaagttgttttcataaaagacaagttgatcataagtcctttgatgtttacacagcattttgaggccccttctctttttcagtggtatgttcttcccaaatcaattttttaagtatgtgttttgtcttcatttttatctgatatttcatcagcagcaagttaattctttctcttttttcctgtctccaaaaatgcctgttccactttgtctctcatctattgctatgtgacagaaaaacaagagacattctgtgtctagcagtgcacctccagggacatcttttgaactctcataatttgtatttattgccacccactttgtaagttcacagtttaatttgccggcagtggcagtgttaggccgacacagtaaaacaagataacgttaaaatgtcagaatgagagggggcatgaatgatgcattacccctaccaggacttgcacttgtcattcctttccaccaaagtgatgttaactaccttttgagagctttatctgactggtattactcagaaataggatcattagttcactgttctgattaggaagccgctatgcttgattaactcttcttggactgggatctcagtggaagcattaaatgaatcgcactgacttagacatctagaactaatttataatttttttttgcaattatttgtagttgttgacatgtgtttttccatgatgtggtacttaacgggaatgagttaaacctactggagaca

SEQ ID NO: 118523 - DNA, 1035 bp, Homo sapiens
tgtgagccccttccagctctgaccccccagttgtttatgtccaacagtgtttctcatgtggctgtggataagtttctccctctttccattttaaacttccatttgtaggttgcttgtgacattttgcttcaggccagcacttagcatataatattacagatgcctgaaatctttcagcctttctttttcttttcttttcttcctttcactctcactctttttttcctgcctctctctgtctttcatttcactcccaactccttttttccttacaacaccaaaaactctttcgtttaaaaaagttggaaaatatatgaagacaccacacagcattcacaactttagcactgatctgatctatttttctgctattcaacagacctggattttttccctgtgaaccagaaagtcttttgttttcttgtctcagtaaacacagcatacggtatgtactaagtattaggactcaggggtcttattcaaatattttttggggggagtggggtcaggactatggaaagagatacaggaggtgtaggagactgggttttaatgtgagatcattaatcatttcttttttcctgaatcaggcttgggacaaaagggataaagagggttttcccctcaaatattcaatttatcctatcagatttcccacagtgactttctctaccaaggttcttaatgcactactcttagaatgtctcatcagtgaccagagctgatggggtctttgaacattagacagtacccattagtcaaggtccctgggctaacatctctggatggcattttcttctaagtgtgccattagttagtataatggactggtgtctgtcagcctttggggcaggacagagaggtgcatcgaagaccctttgttagaagatgggctgtgttttttcttcaacctgcaagcatgtccccagcaacgtttttagcttttgaaagacaataaatgttaatagcttcagtgaagtctttataatctcccaggtcagaaattgttgctgttttttctccttaaagtctcaa

SEQ ID NO: 118524 - DNA, 1074 bp, Homo sapiens
gtgttctcaagtgtgcagtagttccacaccatgcagcaaatacatgtcgtgattgggtttttaaaagacatccgcctggcccctgactgacagggcctattgattttttaggtttctgccgtcatcggtttccagcctcacagcggccgcatgtcgggggtcagggcgcaccggggcgcagtgagccagccctcgccacttcccaaagtgaagggccgctgaaagaaaatcaatcatgtcataagtgagaagcatcaaaaattttccccctgtatggccaaggcccatcagcctgtctccactcagtagctaaggttaggcatctgtcaagtcaagactaggtgaaaagtattagaaatgccagtttacccacgggtagaccgtgtgggtgtgaggcagcctcttccctttgtctggccatcccgggatgacagggttggcgttttcacttaatttttgagtcagaatcacccattttcccttcctttagcctttgtgtgtgtgtatgtctctttctctctcctccctcctcctaaggcagggcgggttgaggcctggtaccctgtttatttaagaaccagtgaaaagtcaaagtggatgcattcccaggcagcccactgggaggtcagcgccatggcattcttactaagtcacagagtatatttccctaaatgaagcagatttttaaccacccctttcatatcttgctgtggaaacgcacatgacacagataagtttaattgtgaaattaatagtgcatatcccatggtagaaattttatttggctactgtgctgatgtttctgaactgataggatgctaaattttcttcctgtgctactaattgggagaacgtatatttttaattctcagagaaatgatcaggaatattctgttcatttttaaacacctttttatatttcttacattccaaatccatgtcatgagattgcatagtttgttgaaagaaaccgtattaagtgtctaacttaaagaaaccctttacgtgtactttctaattgtgagtttagtatttagtttccaagctataaatcatagattatgtattctgtga

SEQ ID NO: 118525 - DNA, 1042 bp, Homo sapiens
aaaaaaaaaaaaaggaagaaagcagcgtcgttagattgtagctggacgctgttgcctgccaatgactctgctaaacatggagattggtaagtggtaggtgttccagatactagcaccaaactgagactccctcattgatgtaatcagaacaattaagagaaaattgaaaacggcactcttactatgtgattccatattatttaatgctcatatccttgtaccattagaattgtcctgagcacattactggtacagttttatttcccttaacaagtgatggtagtgcttatataataagcaaagtagtctaaaaaaaggtcagtatctacaaaatggaaaaatgaagtataaactcaggtcgttgaacaagagacttgagaaacttagagaatagagttagaaacatgaactaatcatgaacagcaccatagaaatcaattttcaaatcaggtgagaatcttaacatttatggttttggccaccattgatatatcgttgttagcagacttgtaggtagtgctctcagctaaagcaataagttgaatttagaggagctggaaactttaagaagtgtttcttgagattctgttttactctttcttttgagattccaggtatgatttggaagattcatggcaaataagcttctaactaaaggactcaaatattataacagtaaccagcattttaattctattttttgttattgaatttccactggaagagacatagttctatgttctttatttggttacacacacacacacacacacacacacacacacacacacacacactcttacagttgcaggatgagaatctgcccagataaagtactaacatactctcaggtacttataaaaattactatcctaggcctggaatctattctagattttggttgagcacattatttcagatttggtcataccttttccctctctccgtatctcactcccacccatgtggtagcattcattttccaaattgaaacacttgcttcatattccctttgatttttccaaagacattagagccaata

SEQ ID NO: 118526 - DNA, 1138 bp, Homo sapiens
tgatgagttgttcagactgttaggtgaaatagtattgaagagtagtgaacctgaagcagctcttacatgctagcaaataaaatctatctcccacatcatgattaaatggatcattgttcacttggtatgctatggtagaaagctgctttccaatttggagaaaataacttgtaaaatcaattttaacatttgttgggtgactgggatctatctggttgctaagatttttctttccttcatatctcatgatacttaactttggtttaaacaaatagaacttatgtgtttctaacacccctcatttctgaactcctatttttgaaaaaaaaaattggaactgtgcattttggtggagggggagagaataaatgcatatttaaggtatgaatgcttctttcaggaattgatctgcatcttggctggcaaatctctcaggtgcacgaaggggccctggctacttggtcattcatggaggaatatattttttaaatgctttcttgaccctcttctaatttggaggcaagcacattcctcactttttcccaaccagagcgaaccaaattttcatgtgcacagagtgtgttttcagtggattagacccaaagctatgttgttctagaggtcttagaactgcttatgtagtacacaataagctttgtagcacaatttaaatgttgattttaacatataaacagtcatccaaaagcattccagaaaagctgtttttaggatttggcttaaaagtgtattggataatgacttctcaagcatgtttattttttttggtgtctttatttaggcatataaagtttttccttttactgggaccccataaagaagtctgtgtcccctttttttctctctctgtgcttcttcctttcctttcccagctgttcctttaattcatctgagacattagatgacattctttattttgccaacaatgacttatttataactaattgcctgggttctgggattgttaggaaactgtattgacaatgataatttttagttgtctcacaatgaggacacatgaattatcacagattccaatcaaaaaatggcaaatgagaaacaaagcccccaccaacggtacatttctgacattgcctttgttaagtgttgcattaatagg

SEQ ID NO: 118527 - DNA, 1211 bp, Homo sapiens
agtggaatgggacacaattcagcccatggcagtggccatgattagactcttaactaatatggaagccaaatgttcttcaaatcacatgtcagcattttcttttcttttcttttcttttttcttttttttttttgagacagagtctgtctctgttgccaggcgagaatgcagtggcgcgatctcagctcactgcaatctccgcctcctgggttcaagccattctcctgcctcagcctcccgagtagctgggattacaggcgcgtgccaccacacccagctaatttatgtatttttagtagagatggggtttcaccatgttggccaggttggtcttgaactctggaccttgtgatccgcctgccttggcctcccaaagtgctgggattacaggcgtgagtcactgcacccggccacatgtcagcattttctaagcagagaccagggtcattgcagtaaggtctctcttggttagagtgatgcaaagccaagtggcttccgaatgacacagcaagaaagtcaaagaaaaggctccacaaaggctatgtgggccacattaaagcgcaagatttattttcattatattttttcttagcagaacccatcttatctggttagacaggcttctttagaaccagattttgttctttgtgacatttggagttaatatgaggaaatgctctttgtattgcccagtattgaaaatgtcagtaaacaaacgcagcagtcagagaagggggggttctaacaaaagacattgtttcttgatgcaggaggtaacaagagtatttagaacaaaggttttctcaaaataggctttttagcaaactttggagccctgctctggtaccccacccgcttccattctgctgaaacagcgatgttgatgaaaatacttattattttaaccagccccccaaacttaccaacacaaacacactcttaatttcagggctgacagcagggctgggaaggtccttataggatcgcaaaacaactcgggcagttgagggcttccggcagccagctaacaaaaatatactctcagaggatgcagctcagggaggcgtgggacctgcacagcagagagcctgaaagctggcctttccgttttttacagagcttcacccttcacatctggcggagctgtgacaatcagtgttagaccattttagaaatcagataccctgggtaccaggaagttgatttgcctt

SEQ ID NO: 118528 - DNA, 1024 bp, Homo sapiens
ggggtgttaagctaaagtccttattggtttcccactggatgaacccatctggatcagtctccactgcaccaccacagggctccagtggtctgatcttctgcctcaccagcctcagcctggatctcaggcacagcattgtgggccctccagcctcattcatgctccctgtaccttggggtccttctgcaattggacccctctacctggagtgccttccttgcctctctgcctcttcaagtgttcctcgtccttcagatgctatttccaggaaagcctctctgagttcctgagttgtcaggcttctttgttttcactcttataacactgggcctgtgtccttcagagacatgcctagagtcctcttaggagactatttgattcatgcctgcctcctttagtctgtaagctcactgagggcagggcctgtgtctgcttttgctgaccttcttgttccctgtgcttgccgtggtgcttcacaaatatccgcagaataaaccaatttgaaaattcatatattacttatggatcatcctctggtaacttagaagggctgctcaaaaaggactttaatataaatatatatttaaagcttagcagttgcatgatgggcacactggtttgccagggctgccataacaaagtaccacagaccaggtggcctaaacagcagaaatctatttcctcacacttctagaggccagaggtctgagatcaaagtgctgttagggttggtttcttctgagggcctctttccttggctcgtagacgccgtcttcttccagtgcctttgcatggtcttcccctgggcatgtctgtgttttaatgtcttcctcttataaggacaccagtcatattggattaaggcccaccccaatgaccttatttaattttaatgacctctttaaagaccctgtctccaaggctgggtgcagtggcttatgcttataattccagcactttgggttgccaagttgggaggattgcctgaggctaggagtttgagaccaacctggccaacatggcg

SEQ ID NO: 118529 - DNA, 1008 bp, Homo sapiens
agaacacagtgtgtttgtagatctcatcaagcaagctctagattcaagtccaggaaatgttattgctttactttctagggactaggttctgtatggaatgtttgtacagacatcacctcttttaattctcacctcatgaaacacatctagtaacctctactgaggttttatgtgcttaatcttaagagaggcaaggaggaacacttgacagtctctacccacctccagacatgctaaggatttaacaattttcttaaagacaggatagttagagtgcccagatatgggcatatggattttccttttgttcctttctttggtccagctcagtggtgctcaaattttagtaggctgtaaacacaaatccacatgtgtggtgttttatgggtaatctaagtgattttcaagggtagttttgactacacgtgatttttgcttttcaggctaagtctaggacccgactttgtggctaaatggaactcgtttaaatgtgtacaagttcttagagcacaactccaggtggttggacacaaagatgcggaccgtatagccactgtccccagtgcttacagaataatgtgtgttcttcatgtgggctttggtgggatggggagaaaacccactgaagtttaaatagtctcagtgttcctgaagttaaggagcagaggtctggcctggcatggggaggcattctttggaaatggaggtggcagcagacaggcatcctgaagagaacagcccggcccaagacaacttcccagcctgaggttcaggtcctccaggtatttggcttcacttcagccacgctcaccttatctctagaagttgcttcaagatcagctccaagctgagttcctgcagcttccaagagtgtcagttatgaggccctcaaccttaagtatagctggatgttggagcttcctggttgttgcagggaatacagtgaaattcatccatttagtgggagttcaccatgagttctgttgtgcgaggaacttagtggcagta

SEQ ID NO: 118530 - DNA, 1401 bp, Homo sapiens
atgctcagactcagtagatggcaattatagacatattttcagtttatagacagaagacaggaggagtgaagctgtggacttcagctttgttgttgaaaaggggtactctgtgacagacctgggttcaactcttagcgctgttacttactagctacgtgatttggggcaaattacttggccactccaatcctgttcctgtaaaatggaggcaaaaagaataattcttacatcatagagtttttgtaaggattaaatgatagaatatttattaagcatttggttcagggcccagtacattataaagtgcttagccagtgttagctgttataaaattatcatcacagtcgattctcactgtgcatgcaattatccttctgatttcaactatgtgtgctggaacaaaaaattaaaaaagagaaaagaatgctaagaatagtttaaataatgttcttcatacactcactgtgtatctgcctcctagtgagcccaaaatgtaaataggctggtgatcagacctttgtatatagatgttaatgctcaaggttgcaaacgcatgcatactgcactctatgtgtagtttcagggatttgcaaagattttttagactttctgaagttttatcttataccctgacttgagacactaactcccacatcatagttgaagccactgttgttggtgtgttgatagtgttactattggcttgatgtgaaagaacaaatagggtagctgatggagtgactggaagctacagttgagaccttggattagatctagatgtccttggatgattttgataaggagagaaaacagttagtggggagaagtggtgaaagatccttaaatgtccagtgtgagggagagagagaagagggggtggggttagcgatgggaggtgttgggaggggccatggctccttgcccaggaggctggggcagggacgggggagacaggaaatgggcctctgagtaatgggagccgcagagagaccgactgggtgcttagccccatgtgggaaataagcaacacagggagaaagaagtttatacaggcactagtatttttagagactgtcctttcagtgatgcatttgaataacaaggtgtcctaatactccttagccttctcagtcttatgtcttcagttatttgaaaaacaaagtaaatagcatagcttccttccctaggctgatttccgtcttttcctgaatcagtaagcaaggatttgtttcttctttgtgtgtatgaccccatttaaattcagagttcatggtaacataaatggtaactggtaggaaaacaaataaagtacaaatgcataaatacatttctttttcaaaatttatcacattaaacaagccaatagttttgatgttatctccacaaggttgagaccttgct

SEQ ID NO: 118531 - DNA, 1374 bp, Homo sapiens
ttacttggacacatcaacagcccccttttctctctggaagtcatttactctctccccttttagaagaattttctaacatctatcagactgtgtaaaatataagaagagcagagccagggtagcttagcacctgatgtcaaagaaaggcagttataaaccaccacaccaaggaggtgattcactttcagtcccctttgacctctaccctggaaaggaaggtcagatagataccttttgtgtgggctgtatttgcccagctgaccaggaaaattcagggctttggtggccaaaggattttgcagattattctgtacatttgtgtatttcctgtaagtaacggaaagccttgatgaccttgcagctgaaatgccttcacagccatagacacttgctgttgtgccctagatggaaatcttgcaggcaaggtggctctgcgcacctatgttactgtgtaagtgccaggctccagctcagttttaactggttgatggctggccattccagctgacttgtggacctcacttttattgtttcttgtctacttccagactcaatggctatggagaatgcttctggttagtggtcactcttacttagagacaattctataaagcatgagtacaaagaatcatatgatgtatttattttttaaagaaggacaccccacttacacatttaagtcaatattactcttttgagaagttgagggcttattccattgcttcaaacctattttgactcccagcctgtggcatattactttgactatccttggtagggacaagcctccatccttgggatctgtgtttggaaagagcctaacattaggagtcaaacaggtgatcacgttgggtgatttttttctttgttgcattagattatgaagtgtaagcactgattttttttgtttggtttggttttcgataggactgtcaagggctttccaaaatatatcaagcaagggccgtaaaattggaaaaattacgtagtttctccaagacttaggttctggtagatgtgttgactaagcatcagcctatcactttatagtcctagcttgtcaactgtcacgcaggtaatgagtttttgaaggtgaagtttctattctcaggaagagtcttccagcagggaattagtagtctacgaaaagtgaccttgctgccttctttgcttggatctgttgagctcctggaactctagaaactggtttgtgaagtgtaagagttccaggatctcagcatctggggtggcccaagtcatggagattttatcagaatactatgggctttccctttcttaggagataaggttctggccttcaaacactattttcactgacaatttctctttccttgcttgaataatcccactagc

SEQ ID NO: 118532 - DNA, 1049 bp, Homo sapiens
gagccgaagcagaagcagagaatggatactgatattatttccatctgcaagccctcatgacgtatgaagtgccgagagacatttatggttttgttgctaccattaagacctttggcagagtcctaaacttattttggtctctctctcttttattgcaagctatttccagctgtttatttttatcttgctttgagatgtttaaataaaagacataatttgaatctaaattgtggttgttatcagatctggctagaataataagacagtgataccaattctcctggcttgaagtttggagtagtgggtcatttattcattcagtggacacctactatgtaccaagcgaagactgttgtagactttgcatagactttacagtctagtgggagagacagtcattcaaagaatcacataaataaaggtaaaattacaattgttttaggtgctatgaaggaaagggcaggaggatgatatgatatgccagggagaagaactggcttattgagggttctggaaatgtgtcctcagtgaagtgatgatcaaactgagcaaatctcttatgcctgcattttccccttagagtccaaacatacatgctggagtcagatggacaagggttccaagcctccaatgttcctaactagccataagaccttggaaaagtaacctcatctctttggaacttggagtttttgtctgcaaaatagagaaagcaacatccatcctgctggattgcttggtgttgttgaaacaatacattctataggtacctgattcaattagacagtaggtgcttcataaatatcagctactattattatttcacctatgataaaatataagttatgtgaatcaggccttatcctttccagagatattttttaagagggctttcctgaagcctaaccttaagcagctacctagtagctccctgtcatgacatcctatttaacttttttatttttttttttttactgtgaatgtttggtaaataaaaataaaatatatgtaacacatgctataaagtcatccaaacttgtgaacactct

SEQ ID NO: 118533 - DNA, 1069 bp, Homo sapiens
tcccttccaccactccacttaggcccatggctcttacacattccgcttatgttacagtagaatgttttaataagtaggatttttgtcattgcacaagtcgacacaattatgggaatagctaaaattcaccagtagacctagtgggttcaattcaacaagattattgagagcctgttttgtgggagatgctattgctcatatgctagtgaaacagacattttctaccctcgagggtctgtgcactgagaggcatagtcatatgcaaaccaagagtaactgataagatggttaaatggtgggacagagtgtcaggggcacctgtatcggaattgattaattctgtgtgggggtcatggaaagctagagagaagggatatttgagttagacttggaggaatatacggagagctgtagggaacagttcccagaggcaaggagatcaatttgggaagttactgggatagtaatggcccagagataatgaagtcttggtcattactggtggcagagctagaaggcagtgggcagggaacaaagctcagataggctatggggagctgagggagaagagaatcaaggtgaactgtctggatcattttttcctccagtcctttttgtggtgggaagatgggagaattggaatgatctaaatatggcttcctaatgttcatgttatcttgactaatcttgataagactttatgacaactttatctcaagctcctgcagtttcaatagaaattggattttaggatgcacaatttgatttagccaaacagctttggacttccatcctacttcattgtccctgagtgtcatgactgtcattgtctgcattctaattctgtttctatttgaatcattcattaagtacctaaaaattatgcatatagtaaattcacaggataccatatgcaaataggaagcacccctcaccctggtcctaaataaacattgtggatttgttaagtaaatttgggagtttcagatcttttttttaatgcaatgaattgtaatgtcacacttccaatacgacaaggattcttttttttttcttcttcttttaaata

SEQ ID NO: 118534 - DNA, 1045 bp, Homo sapiens
tagagtgctgtttagtttactaatagtgattctttcaaaatcactgtgcactcaacattactcgtgaaatgttagttttttttttttcatcaaattgttgatagacagtggcttaaaaatgtttctgcaacattgataatgacatacccaaaataatcagggcagaattaggtccaattccttgatctatcctggaagtttggtataatgaatttcaggaaactctgttatattatatgtctgtttctcttcttaccagctcttttatttctgtctgctgctcagggtagattgcctggaaatttgtcagctttccagacatggttttagccagctttggtttgtatctacggacacccgttgggctacagttgccacctacatattgtagaaattaggagtaagttgtttgaggaggcctgattgaaatggtggctacatggcagaagtggccatgtccctggaatgtctgtcaaggatttgggggttatgagaacatgctactcatataaaccaggtccatagcccctctgactgttcagaaaagaattctagctcagtccttttcttggaactgtttggagggtgtttgacatgaatggccttatggaatctgttggtagtgggaattcaaaacaagggtatgaattacgaattcaagcactaagatacgtgaaaattaaacagaagggaagtggctgcagctgaatattactaagaaattagcccaaactctacagatccttcttccactaggttggattagtttgatctgttgttcatattctctgggaaaaccaaatgaggcagttcctttgggtttccggaaagatctcaggtctattggaactggagtttgaaggtggcttttccttttctttcagttataaatgattcctggggactcccacacacaactttgtcattgtggaaatgtgaaagggtatctccagattttctagcagacagcttcatttgtctggttgcaaggtagggctgggggtggactggacaattccccagggtccccttcagctgagaactt

SEQ ID NO: 118535 - DNA, 1053 bp, Homo sapiens
tttctcatcttcaaaatgggaaaagtcacttctattttgaagcgttgtgaggattgaaacacctagcactgggcttggcacataacaggtgcttaaaatcaggtagctcttgcaatttgagcatcgtatattccatgtggattttcattcttaatgtgatcattgccatgggacttcctttgagcacaattaccttactgaagttaatcatggtagctaagtctccttagataaagactcattcattgttttgtttccacaaatatttattaagcctctattatatgtcatgcactgttttcagggttgggggtataacagtgaaaaagacaaacatagttcctggcttcatgcagctttctcagtgtctcagggttgatctctgcccccagtcccccaaaaatagttggaatagtaatagcaagtataaacaaagaatatattgatatatatgttttaaaaatagaagaatgccattttacactgggatcatgatgcagaagaaaaatatccccgggttaaagtcaccttttagctcatacccagaggtatcgaacttgggcaaattccacggctttattgcactcttctgaggcagtctacatgttggttaagactgaaggaagagatctctaagaccctttccaactatggaattctaattttagctgtttgtggtattgctgagcacaggcaggtagatgagcgctttggagggtaggttgtaagcctaagagggcagtgactacgttgagcacagtgcctccctcctgtgtactagatgcttagggcttgtttttgtgaaaagaaggaatgacaggaactagaaatgcagttgttgaatctggtggtctcatctctctgtctaaagacaagcttgttataactacacaataaagtgaaatggcactgccattaaagaatgatgaggaacagaaaatgtaagataaaatattaaatttgttacacttaaaaatgttaatcttcacacgattaccatgcaaatctcctcattgcctaactgtttaattgatcaagtaaatcacagagcag

SEQ ID NO: 118536 - DNA, 1048 bp, Homo sapiens
acatttttcatgggtggggcagggggtgtcacatatgttaaatgatgcaaacttaattaaactgattctggggaaggacaggccattggcgttccatctatgaaatgtgtactccactttcggtgggaacagagtggtcttctgtgtgctttgggaatttctatttttgaaagtgaagtgcttggttccagttgcaaacatgccctaaaccctacttgtcatgactgagctagacatgctggcaaattatatagattgatcctacacaataacctccaaaatggcacttggtaactataccatcctgctaactgtttgaggcacaatagttttgtaatataatataaagtaatggtgttagccaacacatctttaataagatattgttcgtgcctttgccatatgctacagagcagcctctcactcggtgggccttttgattcctctcaataagattatttcaaatactctaatcctgaatcattgacatgaatacaaaagcctagtgacatctaatagatgcctcttagctttgcttttcctcttgttcctttcctttttcttctctttttacctgacaaaaagctcatagacacttgggctctgtctctcagtagcagcatggggggctcctcatgaaatataaagggggaaaaaggactgacagaggcccgataagctacagagtgaagggccatagattaaaagtaaatgccagtaaatcctaccctgtacactcacttgttcttttattgttttctttaacactttcagagccagggcagggaaaaaaccagaaaatagtaatcaagctgcccatgtacatttttaatctggacactgtcactattatacatattttatggggctttggcgacattctcaaattttggttcatgtaaaggttgtggtgggttttttttttaatgtccttttaatcaatatcaagaatccctcaagaacttttttgctcatttgctgctcaattaacttaatattgataccatgtgtgggtaggaagagcccttctgtagggtgtgaacactgg

SEQ ID NO: 118537 - DNA, 1022 bp, Homo sapiens
acacagtaactaatatttgaatttaaaaggtttgcaataaacttcatgtttagaaattgaataaataggagttttattaccacattggatatccttgtgtcctaacctttttccttggagttatcttagttcaataaataaaacctcattagactattcccatttcaacgagtttattaaattttgcaggagtaattagcataagctgtgctaatttttctggaagactaatgagggaggttcttaattaggtttactttgtaagaatcagaaaagatgataatgacaaaagtcacatagggtagtctgaattgggaacccagtttttctgcatctattaaaaaatctttctatatggaaactttttaataaatgtcggaactgaatatattaagtatgcagactgttattccatatctggttaggatgaccattcattcttaatttgcttccccaaactctttattttcctaaactatctttgagcaatgacatggatgaatacagatggtcttataaaaacatttctttctccaaagtatgctggaggcttcttttcacacagactcctgaagtttctggctagatttctgttgcttatttgcagtggggtgggatagggggcagcttaatgtttgtttgtttgtttgtttgtttgaatttagaattagtgcaattgatgaaatgaaccattaagtaagggtgacaatgtgagcatcattccttgtgcaatgaatccttatctgttaacaagtggattttttttttagtagatagaaatactaaaggatgaaattccatctcaaattatgttctcctattggtgtgaatttagacctagttttttaaggatataatgtagctccagtaacctaaaagttttgggttcctcaaagccgatatttaaaacttggatgttaaaagcttgtcaacttatgtacctgtaagaattttgagtttgtttattgtaatattaacagaattaccatgcctttttcccccatttttaagaattcctgtat

SEQ ID NO: 118538 - DNA, 1046 bp, Homo sapiens
ctcccattcttaacagcgagagaagagaataacaacaagagaagaacttatgcaagaaagggcaaaatagaaaagatttttcaattccataaaattgctgcaaaggggaaaaaatgatggcaaccgtgtttgaatttcatagtttccaatttgattctatattactgattgcataatatctgtgttacgtgcttagggtttgatttgctttcagatttatggatgcaaatccctgaatattttgtgaaaataggctatgaggcctgcattcagtagcaatagtaactgttttcaaaagatgcatacaatatgcaattacagagctgagggtacaggccatccttgcgttaggatttagcatagttttaacacgcagtcaacttttgagcaccaataatttttagctctctttgcttgtccttcggaatttgggagaacactactatttttatcagtcaaaagacttttagcagtggtttattcaggaaaactatttatagggtagagagaagagactttctggtcatagtgcaatcgtgcagggcaagctatttctgtgttaaattttggctgtattatttgctgccactgactttgggacatcagcctggcatattctatcaaaaaagtagaattaacaaaatcagcagttgcaaactgtgatttagaaaaggggcttctattatacttcatccttatggcatgcacagactgagaaacatatgaccccaattctttttacaatcatgacaatttgtcaagtcacttcaaaaaagtttatagaaaaattgctgtaaatgcaggaagtgcacatctggagttgaatgccaggttacatttctgtgtggtgccaaatagcttgattaagaagcacataacccagcctgcactcagtgatccagatatttgagctgcatagacatgggaaaagtcaaatgtgttatgtttaatagcaaataaccaggaactgataacagcagatttcattatttttgaggtaaagggctatgtgtggtaattattgttaaagtaaaaagcaaaaaatg

SEQ ID NO: 118539 - DNA, 1091 bp, Homo sapiens
attttagacaatgggaaaacttgataatgtttgcaaactgaaggaaagaattaaccagggagggaagaatggcaaatgcaaaacagaagaggagtccttggtggggctggtcccaggtaaggcagaatgagacggacctgtgagctcaggtacttgagttagtgtgacgaggatggatcacttactttaagacatgggaggaagagagaggatagaagagcctattatgtaatggattctttaaaatcaagtcatctttataactattaataagactattcagataaatcatagatctcagtctctagccactttagggaaataggtaaggcatcttgttttttacaagtttgaaatgatgctttcctcctgttgagaaagacactattcataggaaaaagttccatgtccctaagatgaggatctgccgattccatgactgggaatatttaggtgtttcttgctctagtttatgaagctctagaaatacgccacctgtgttaggctggtaagaaagagactcataagttcgcttttctctggatgtgcagaattgtttgggagacacacaatcctgctgaggaaagggctgctgatttcggtccgtagtgtaggtaccacaccaggtgctggctaccaacgcctgagactggccacattgttctcatgtcactggggttgcaggttcggaagggatgtaaacagtggcctgcttttaaaatcttaccctggcagcaaagcaaattaggaaactccaagccttgcaagatgccagcatgagagagcaaatcccaagtctgtgcctggtacagtgcccaacacacatcgtaggagcctaaaaaatagtgctttgaacggatgaaggtccatcagtcacacagtaatgaggacctaattatcattgtgatttcttttattaacactgtcactttttccgttaagtgcttttgcatctgtttcatctacggaattgtttcagtatgagccctcttctgccttaaacataagtgaattcattctcctttcagcttttccttcctggtttcctcctgtgtatagtggaggttggtgctcactcttggtccttctga

SEQ ID NO: 118540 - DNA, 1052 bp, Homo sapiens
ccaatctgcggaaatccaacttcttccacttcgtcctggccctctacgacagacagggccagcccgtggagatcgagaggacagcgtttgtggggttcgtggagaaggaaaaagtaagtgggcgcagcgctgtcgcccctcgtccccggctcggctcgggagcaggcccgggagccttgggcagcgcgcccttccttgagtgcaaagcatccataacacacttctatgtgggggtcccccaagccacttcccatcccagacgaacccagggtcctggtccactggctccttctccagaaaagttcgcacggagcccccagagctagagagaggcaagcctggctctacaatccacagccatgggcacccggaatgaacccgccctccactaccagattacgcaccgcctgcctctggtggccggggcacgagcccctaggccctggaaagaggatagcctgtgtgcgcccgacggaattttcttttgggagagagggagcagtcaggaacagggggcggaggagggatcacaattggccacaatttctgctgctaccgtggctgcctggctcgccagcgggggtcccggcttggggaaagttgcctcgaaagttggtccactcgctcacgcagacctctctcctgcatctcttgtgtctttgcgtcctgatgcaacccaggaagccaacagcgaaaagaccaataacggaattcactaccggcttcagcttctctacagcaatggtgaggcccgggtcgggtctatggcctcaccctggggctccgggtctgggcagggggcgcagggagctccaggtggacgaaatcctccagcgaaggtcagtcatccgctttatttgaggtgaaccagcctctcctaaatttcgccccaggaggtttcacctgaggaggctcctagtggcccaagagccttatcggtctcgcgtttacctggggccaggtgtagtgcctcatccctccctgagccactttcattcttcctccccttcctgaggcctgttcctttggcttggcccaggctgcaggcccat

SEQ ID NO: 118541 - DNA, 2666 bp, Homo sapiens
tatatagaccaaatcttgaaaactgggtatatacattgtccgtaatgagagagtgccacttccttgccaataccctggtattatatggccgattttgtctctttgccaataatttcattataaactgttcagctgtgttgaagcaaaactgtagaaaaagtcctgtcttcatcagattttctgaggttgtaattatactcttgtcataccagtggagacccagtaatcatactgcaacaattgtgtaacacttgcatttcatactcaggcaaaacccagttataaaggtagcttcttcctcatttttggtttttccttcacttttagaaagtacttagccagtagttcttgcattatttgtataagggggatctgtgatggcagcaggattattactgatatataaagtaagttttattctaagatctatgttacaaattttctattgtgggaaagagatgttagaaccagaactttggggatagcaccaaagatactagaaaacagacatttataaggtatcttttttccccctcttttaggacatgaaatctgctgtgatcacgccttgcagtcattttttccatgcaggctgtcttaagaaatggctgtatgtccaggagacctgccctctgtgccactgccatctgaaaaactcctcccagcttccaggattaggaactgagccagttctacagcctcatgctggagctgagcaaaacgtcatgtttcaggaaggtactgaacccccaggccaggagcatactccagggaccaggatacaggaaggttccagggacaataatgagtacattgccagacgaccagataaccaggaaggggcttttgaccccaaagaatatcctcacagtgcgaaagatgaagcacatcctgttgaatcagcctagaggagaagcagcaggaatgatgctttgatactctggaggagaagttaactcaagatggaattcatgttctgatttgaggaatgaaaatgagatgatcaggcaggaaactgacattccaaggatctaatccaggaagtactctcagtggggaccacctgctttcatcccctgacattgtgggagaaattttgcaatgtatgctaatcaaaatgtatttatatgttctctgctgatgttttatagaggtttgtgaagaaaattcaacctcagcaacttcagaaactgcccctgatacgtgtgagagagaaataaaatcagattttgagtgttgaagggactgaggaagtgaggataaagagcatgaggacagcatggaaagaaggaggcagaagtggaactgaactttcactctccatgggacagatcaatctcattatcaagtctgaatagcaaccagccctctcctccaccccgtttctcctcagttaattggagctcagtcaggtgattattgagtcttgtacagcactgaaatgaaatcaaagatgaagaagcattgattgtattcaaagattgaagcacgctcatactttgtatgtgctttagggaaggggtgggtgggcacttgggccttgcgggtgcattcatgtaatctgagactcttgaactttatgacggagtcttcagtattttgatgtatatgaaacttttgttaaatatgttgtatacttcgctggctgtgtgaagtaaactaaaactctgatgaacactttggagtctgctttagtgaaggagaccaaagtgggaagggctttagggcactgatagaggccctgggtgtacttttcaatcctgtgtaatgtttaattcttgcaactgaatcaaaacagtgttaaattatggcaatatttgcactttgggaatgagtacataactgtatgatcacactctgcaaatgccacttttaaagctgttaatagactttgcaccttttctttgacaaggatgtgtcatatttaaatttttacattcatcatggctacaggtagaactggggaggggggaatgtaattttttatgggaattttgatatgaaaagaaactagtcatttatttatacaataggcttggctcaaaaagtgtttttcagacctcggtattcctaatgtgggatgtgactttattttatttttagtagcaaatttggatgtagactgacagacatagctgaatgtcttaataaatttaaatttgaagataattatgttttgttcttgtggtttgttgtcattataaagtgctttttttgaagttctgttcttaggaggttctgtttttaatttagttggacttacatgttgatccttgtcagaaatgccctgtagatggcaaaactctttgattgaaaaggaccatttcttttgaaatcttctacacccagtgttagcaaacttacctgtgcttcagaagtgtttgggaagctttttattttaaaaaagtacacatttctgaaccttacttctgattcagattgaatcagccttttggggtgcctgagcatttcagagcttctatccagctagcctagcactaaggcagtatgacttgttggcggggggaaagtatctaggctagaattcatttctccccaggtgtagctggaagtttatcatctttttggtgctccgtgttaggcagaagacaaagcagatagctccctctagtggtaggaaggctgcttatccaaagacctagcag

SEQ ID NO: 118542 - DNA, 1037 bp, Homo sapiens
tggtatgaggaaaattaagatggagttgatgaggtttggtgacctaaggaataagggaaaaagatgaatcaaaaaattgattactcatcagaatcattttaggaaagtcacgtctgacggtgtggctttttgttttctatgcctggattactaagatcacccacattttagtcatcagtgtcttctctttagagttgattttttatttattaaaacttttttttcccctggatactcttctgtatatttgaaatattgcaccctaaaaacatcaggaatgtgttattgtttaaagcctatgaaaaaagtatcttagtgatcatatttcaagatacgtacatttttttttttttttcaggttctgggaacactttttatttatgtcttatttatggttgaggaattcagaaaagagccagtggaaaacatggatgatgtcatctactatgtgaatggcacttaccgcctgctggagtttcttgtggccctctgtgtggtggcctatggcgtctcagagaccatctttggagaatggacagtgatgggctcaatgatcatcttcattcattcctactataacgtgtggcttcgggcccagctggggtggaagagctttcttctccgcagggatgctgtgaataagattaaatcgttacccattgctacgaaagagcagcttgagaaacacaatgatatttgtgccatctgttatcaggtaactccttcaataagaatgtgtttgggtaagtcatacagtgtatcccttgggactgtaaccatattaaccaaattcaacttaaatttctaggcaaaattatcttctggattaaaaaaaatggacctcagaaattatattaaagacctgataaaatatttccattttatttctaaattaagttttaaatttagtcccttgggttctaatgtattgttgttttcaacattattgctcacccataaataaaggaaaaacaggtcaggtgcattttatatttactcctgaatacacactcacacggactattgaatatactatc

SEQ ID NO: 118543 - DNA, 1040 bp, Homo sapiens
tgagcgcaattaaatagccacttagtagatctgaaaagtagatttctttgacctaagtacaattagtattttgtcatctctgtcaatgtcatctgttattaattacactaattaatttagtatatattgataaaactaatatttagaaaagagaaaaaatatgttgttccactagtataagaatcagtggatggcagttgtgggtcttcccaggatactgaactatcctcactactggctttctccaaaattagatgcagaggagatttagagaaaaaggagcaaactgagaagtgttgtatgtgggccggggtactttgaattggtgtctgtgttattccttgtggctgcggctgcattaacctgaggcgggagaggctgccctcttggctgtgggaggaaaaatagacatgaactattctattctgttcttccctcccaccattgcctacagtaataagagactaaccatcagctacatgccagtatgttttaaaacaaatgaaataaagttaagagaaaaattccacttaccacaactgactcaagaactaaaaagttgaatagttctataacagttaaagaaattaaagcagttggcaaacttcttgagccagatgatattacaggcaagttctaccaaattccaaagaacagttatccctattttatttatttatttatttatttatttttagagatggaatctcgctatgttgcccaggctggactcgaactcctgggctcaagcagtcctcctgcctcagccttctgtggagctgggacacatgtgcacaccaccacacttggcagattatttaaaacaaatactttcaaactataagaggaataccccccaagtccactctgtgaagccatcgtaatcccaatattgaaataaaccagacaatttttaaagtatttcactcatggcaggagatattgcgaggcatttgtaatgttggcttaaggtagaccagtggaatagagaccacagactgacccacatatgggtggaactctggtatatgacagaagtg

SEQ ID NO: 118544 - DNA, 1054 bp, Homo sapiens
tgttaataataatgcaaaattagtaagttttaaaaaacatgctatttattaactatataggctaactttaaaggaatttagctgaaacagtcttgcaatcaaagaaaagctatttaatattttacttctgatttgactcaagtgtttaaagtgtttattgatggtgatgcaagaagttttcctatcttacgtttttatttaggtagtggaggtatatggccttctcgccttgggaatgtccctgtggaatcaactggtagtccctgttcttttcatggttttctggctcgtcttatttgctcttcagatttactcctatttcagtactcgagatcagcctgcatcacgtgagaggcttcttttcctttttctgacaaggtaattaataagagcctatgatactatatataaccttagaaagagaaaactttgatctaggaatagtaagttttgcagattacttttatcgttcatgttacacaacttcgtattttgttaagataggattttcattcactggatacctaggtttggcaatgcagggaggtgctaacataataatgtggtttatttggctgcactatggaccagagtgtagcaaatgatttgtggaaaggtacatagcaaatcgtaaaagtattttttcaatttcaagttaaaattattgggtcaatcagaaaaaagtatattataaaaataacatttattgagtatttaaaatgtaccataccattaaacactttgcctcacattaatctttacaacgaccctaagagataggtgcctttattataattaccattttatagctgaagaaactgtaccaggaataacttgccccaggtaacactgccaaaagaagcagaactggcactcagacccacctgagttcgaagcctgtgacttactctctatactttgcctttgtccctgttgacttcagtatcgagaaagagtccggtaattggtgaaatgggtagataatagtactttactgtctaacccaggggtgttcaatctttcggctttcctgggccacattggaagaagaatt

SEQ ID NO: 118545 - DNA, 1066 bp, Homo sapiens
tattgttgcagtatgatcttgaacaagtaattatatctcttggattttatgctttcacctatagaccagaacagttaaatattgcgtacctttggaaaagaagttatgtataaacattagcaactgaattgtcacaatactgaattagacattgtttaaagttttcttcatattacacatggcatcacagacgaccagtggagatttatgctgctctttccagatcagccctacagaattagtattcaaaattcacagaacatgtgaatatgtaattatagtcagatgaagtttaagtttgatttaaaatattatctacgagattttagttagacttcttcaaaagttgtgttattatccttatcaacagtgttttttgtttgtttttattttgtggatgccaaatactcaaaattaaatgtattctattccctattttaggtcagttggtggtgtgtactttatgctcctgtgtcatgaaaacaaagcagatttggctgttttcagctcacatgcttcctctgctagcacgactctgccttgttcctttggagacaattgttatcatcaataaatttgctatgatttttactggattggaagttctctattttcttgggtctaatcttttggtaccttataaccttgctaaatctgcatacagagaattggttcaggtaagactgctgacaaccacaaacaggtagataaaattctacataaatgttaagtacattaaagttatagttcatttttatttcacagttatggtaccattcatttttgcagtttcaaaacagctgctattttcagcccaattaggagcatctgaaagattcttgattatgttctattgagaaggcagtaaagtgaagtggttctcttaaagcagatttatctgagatcgaaccctgatgctgctgttcactagctgtgtaaccttgtgataattgcgttactttctgtaaaacggagctaataatgaaagctgtgctttcctcatagagttctgtgagatttaaatgagtttagtaccaggcagacaatgttccatatgtgttagcta

SEQ ID NO: 118546 - DNA, 1037 bp, Homo sapiens
aagatatttgccaagttagaaagcttgtaaagttttagtttatgatgcatatacttgtattataaatatgaagcatatttcttaaaactcttcttatcagtggccatggtcttctgtttacttaactaagattcaactttccaaagtccataaactattaaggagcatgttttcttccaacttagattttaaaataattttctggtgtttttcttcatttcagtaacaaacttttttgaaaaactaggtaattttaatatgccatgatttcttagggttgccaacctcttggagatatttctaatagtggaatcctgaaatctaaagagtacattgggattttggtttatgcagagttaaaagttgaaataggcaaatcagaagacaaacaacttattcttttggaacttcaggggaaattccactaacaatatgactccttccttcttttacgtcagcaggagtagtcttctcttaaatacgccatatgagtcatattcttctatgaaagaagataaagggagcctgtaaccccagcactgagcaccacatgtgctggcatagacttaagggaattttcagagcttagaggaagtttacattgtgctcaacaaggacatttaaatttcatagctataaacacagtgaaagccagatcatttggtggcctcttgttttctatataattaggagtttttcttttctttatgcctttatgattatttttcacattactttagtatcagttttttaaaggccaaaattaatgctttgtgagataaaataccgtatgtgtttatgacatagtagattgttgtaagtgtttggtcttatgtaaaaatggttgacatttttgtatttttctaacacaaattgaattttccttattcaaaatgcttggcaccagaagtgttttggatttctgatttttttacattttggaatatctgcattatattactgtttggaaatccttaatcccaaaatctgaaatccaaaatactccaataagcattttcttggagcataatgttaga

SEQ ID NO: 118547 - DNA, 1023 bp, Homo sapiens
tagataagtttctgggggaacacatggtgtttggttacatggacaagctctttagcagtgatttctgatattttggtgcatccgtcgcctgaggagtgtatgctgtacccaatgtgcagtcttttatccttcacccacctctcacctttccaggaggccagaattccactatatcattcttgtgccttttcagcctgcaaaatctaaaactacattgtccaaaactagccacatgtggctggttagcacttgcagtgtggtgaattgagattaaggtgtgctgtatgtgtaaagcacatactcaattttgaagacttggtacaaaccaggttaacttttaatacatcttgttaacttttaatatagattgaatgtctatatgatgatgtttaggatatgttaggttatataaaatatattgttgatttcacttgtttctttttactttttgaaatgacactaatagaaaatttaaaattatatttggcttacattataattctaatctgatataaaggactagcaatagactagttgcttgttgagtgttttgactgtggaatgaaaatgccttatagggttttcctgtatcttctgatacaggaaattgtagagcaaaggatgtaagtttcttgtgaactagacagtggccccgaaagtctgtgtaggattttcttgggtcctgttcaagaaggccttttagatggatgagaagacctcaacagggattgaccttccagattcccaggagctgagaaaagagccaaaaatggccagttgagggtgtataccaagcaccaagggtactgctgcaggtgagagagccacagtgataggaacggtttcagaagaacccataaaagggtccaggggaaaataaatcagttttagatacctcaagtctaggaagcaccagtaacaaccacatcattgtaagagtccagttaagtaggaacctgcctacttccctccctctccttcttccctacccacttcaatccttggtaagtcagagagagaggg

SEQ ID NO: 118548 - DNA, 1520 bp, Homo sapiens
acttgattgcctaatgggaagtcatttcatggaaaaagtaaatacagccatatgagtttgtttggaaatacttgaaatgttctcttttaaatacaatgaataaagcattaaaagttgaaaaaaagggaagaatttttttacacaaacttcccttctttgatgccaaaaatactttagacaaactgtcttccagtactcccatgtaacttactgataataaactaaattctccctggttgtgcttcctgcctgttttctgagtgtgtaaaggctctggttattacttaaagcttactatttctcagtagtcacacgttaaatgagttaaattttaaaaggaatattttgtttgatgtaaaatttgcttcaaagtaaatatgtagcctacttaaatattataattatcttagatttcatatagagttgaaaatgataatttttaagggttgtactcctatcccccagttttctaactagtttgtggttctacttgggactaataaaatataatcggggccaaaactttgagggaaataagatgagggtggggtgatggtggtggaagatagccaaaagagatgtttagtgtaatatcactagatgtgattggttagtgtagtagagttgagagagatcagctctcaattgggtttttactgggcataaaatatttaataaggccatgaaaagaaagaaaatttcataatgtggagctttggcagctttctctgtatggtaaaattccatttcaataagttgtgtctgtttctagtgcacagaaaacagagatgaaggccatttatatataattcttcatatctaaatttttccttagatatggaaaggggtatcattaacataatatgcttttataagcatattgtgattccgctaggaatgtatctaatatatacattctaatcaattttcttatttagggactatgttcggagtgaactggagtttgcctatgagggaccaatgtatttagaacctctctctatgaatcggtttaccacagccttaataggtaagtattataaaagaattaaagtgtaggtaggaaccgaccagtcttactaacttataaaattcatgcatactcatttttttttaaaacggaattctcaaaagtgattcatggggacttttcccacatatacccattgtttggtggttttttttttttaagtcttcttttccccatgtatagattatgtatttatagtcatattgtacatagtgcacagttgcttgtgtttttttaagggttttttaagtatttgagaagattaatttttaaatagagctaattattactttgaaagattaaaatgaaacacgtagtatcttaaatttacttattgctgttgaaagccatgaccttattgtcaaaaatgaatgtccggaaacatcaagaacttgagatgtgattgaaatattcaggtagcagaatgttaaaaatagaagtgttggctaaggcctaaaaacaatatagatacaatttaaagtgaagtacc

SEQ ID NO: 118549 - DNA, 1057 bp, Homo sapiens
ttgtggctttctccttggggatagtgctcttggagctgacctctctcccttttctaatgtaaaattcgtataacataaaattaatcattttaaagtgagcagttcagtggcatatagtacattcataatgttgtgcagctgtcacctttatctaattctaaaacatttttgtcacccaaaacaaaactcagtactcattaagccgttactctcatctccccttctccccagcccctggcaaccaccaatctgtgttttgtctgtatggatttttcctggcccctgtttaaactgtatccattggagagagatatgctatgaccaaaaagaaattattgggctttaaaggtctggatagtactgacactcagagttgtatctcttttaggtataaatttatttttcaaatagcattttaaaatactttgtattaatactatttatatatgcattttgttctaatttcataattcttttaattttttagttttctaactatataattccattgatggttacctatagtaatcagatatttatgtgttatttgcatttgtgtctttctacatgaaaacagggttactcaatattgcacagttgacattttggactggatgattttttgttctaggggctagcctttgcattgacgaatatttagcagcatctttggcctttacacactaggtgctagtaatacctctccccaattgtgacaaccaaaaatgtttccagaggttgtagaatatcccctcaggagcaaaattgccccttggttgacaaccactgcattacaataattcttcctgagaatttggcttcctctttcagtagaaagagacaattaatacattatgtgttagaaaccatcatctaagagtgataaaggagaattgctagatcacccatataacttagtcatgcatttttataatctcagaaactgttttaattcttttaacaatttttagttttaagttttgattcttttttgcaaatacccttccggctgattgtgtgagggtctttccttgtttggctatgcagtgctaaagga

SEQ ID NO: 118550 - DNA, 1063 bp, Homo sapiens
tagatcttgtacattccttgtggccccagtttgagttaaaagaggggaggctgttatacaggactagggacgtagatttttcagtttattagtgccttggggtgattatcagccttccacaagtgaaaaaacatttaagaaggaaaatattttattcagttataagtagattggcaggaattcttgtttctgaagatattaaaacattctaccttttaagtcttctgaaatgaaaaattgtaatgcttctcttgaatagctcacctgagtcttaagagaatcatatgttgttgttaaaagttagaattttatgactcttgccttgaactaatttttcacctaaaatgactcatggaattttggataattcccactttggatccttcttatttaggcttactgtcttgtttttcttatgttgtgaatgaccatccctgttaggactgatttaccaagaattctcaatgccagcatgagatacctggaatttgtgcataagtaagatatagagatttttgttaaccctgattcttatttcagttattctctacagtttgggatgggatgcccagatcctccttttagaagtgacagctccatagtggttgtgtggcatactaggtagtttagctgtcaccaaaactactgccttgactctggcatgctaagctgagctggcctaaagagagagtctgcaggctttctaggcctggctgtttttactgaggtggggctttttggtgagtcagccaaatggaggattttggaggactgtattgaaagagaggaatcgagcaaaggggaaacgttctaaggggcctagggatgatactaattttgaggctatgatgaatgatacagacttaaattgaacaggaatgtggggggcagtacagtattggagagctaatcctgggatcctagaggaggacaaagtaaggagagcgagtgggaggaaaccacttaacatcagggctgtcattgtggcctaaaggttgatcatttattcttctggaatgcagacctcccttagggtcctataatcacagcaaatcgcaaagta

SEQ ID NO: 118551 - DNA, 2519 bp, Homo sapiens
aaaagccctgcacattctttgaaacaaaggtaaggagtgatgtcagggggaacgactgaaagtataggagatagagagtcttcaggggttggagaaataaggtcttaaatcacatggaaggggcagccttggaaagagacattaagacacccagtttttcctctgggactagaaagaaagagagaattggcataaaacaagtaagttgatatcaaggaaaggtagatgaagaaaggagttgtgttacacatttgtgtgatatatttgattattaggtagagaaatctacaaaagaagtgaaaaacacaatacattttcaacaacaaaaaatccataggggtgtcactatgctaaacttactttggtaagtataataaaaaacctcagaaagtactgaaacctatttggaaaattatttgtctcaagctctttcttttattgtaattaattgggaaactaaattaaaattgtattttatttatctttctggtacaggttatatcttaagtgtggtgctgctaacattgcccaggcagcatctggttcagctttatctatattttttgactgctctgctcctctatgctggacatcaaatttccaggtaagaatatgaccccatttttgaaatgtatgattgaatttaaagttttcttttgccaataaaatacttttcatgaacactgttaagtaaagctaaggctttggtaggtccaaaactggtttgatactcattttccaaatcttacacaggattaatagctggtttatgctgacattttatttctgcttttaaaaacaagcttaacatgaaacaagccttaaggttatgtttataaagatatccttgaactggctgggcgtggtggctcacacctgtaatcccagcgctttgggaggcgggtggatcacctcaggtcaggagttcgggaccagcctggccaacatggtgaaacctcgtctctactaaaaatacaaaaattagccgggcatggtggcgggcgcctgtaatcccatctactcgggaggatatccttgaactttcctgtattgcctgataaaagaatttctaaaagtaggctgtaggagcattttaacaattatagacttcattactttaggaaatcaatttatgatgtgtaagaatcagcataagatgcagccatgtggagtgaatgattgatatacattatcttgtaaggttgattgtatagctaaccttctatctctttagccatattgtctgtgtacctaagtctgctagatctaaattttaagacttgggtctgccaatgaatatgagctttctactttgcaacagaatgttaaaatataggtggaccaaaagttacactatgaagtagtgggttggaatatattttggaggtataatttcttttgaaacttaaattttatgatttttgatagaaaggcatttaccatattaaaatatattcccaattctaagaggagtgaccttgcatatagtacaagccataataagagtctgaaacagattttggggtagttgaaatttaatcttagaagtagcatttttacattattagaattacattgttgagtttttaaaaacattaactttttctgattataaaattatggtgctcactatggacaatttttggaaaatacagaaaatgtaaaggcatttaataatcgtttgaaattataccacccagagatagatgtgttaatattctggtactttatttcagtttttaaaatactgttcaattctcaccacttctgtggatatgaaaggatgagaataactaaaatcactgggtttttcacccctcttgttgaaacaggaccaccaattctctttaatgttttgtctaattgtttctcaaagtcccagggtgtttcccagaagcttactcttcttgcattttcctcctttattccttcctggttgattttctatgctcaaaatggtgcctggaggatggtgtcttactctttaacttctgccaccatcctgcccagggtaggtcctctgatgtcaaagttgcaaaatctggagctggcagagtagtgttgcatttcttgcaatcctcacaatgtttaaatcaagctgtgttcccttcaagaatggagacagtgacattccccgttttgcatgacagaagtatgtcactgtgtcttagactccttcatgaaaacaacttagaccttgtcctgtagcatccctctccatagagccaaactaggagtccaagcaccaatactgatacagacatgatgcgtttctcatcctagtaccaccagcccccacacctctgttcctgtggccttaccccgatacctctgagtctcagctcaggctgaggatggagacactttcccatctttgcttactcttttgtaaacaaaaattgtatctatagagtgtaatgcagtcattagggtatactgagctctggagtaactgttctattttataaatgagtgcctgggcacttatttttcgatagatggatggtttggataggttc

SEQ ID NO: 118552 - DNA, 1049 bp, Homo sapiens
catagttttgtacagtgtgtgacaacctattagattcgtgaaagggtatctaaaagcgatttgtgttgactttttatttttatatattgtgtcttctgaattttaggtcttctccaagaaaaaaaaaaagaaaaaaaaaaacaacatggctgcaaaggagaaactggaggcagtgttaaatgtggccctgagggtgccaagcatcatgctgttggatgtcctgtacagatgggatgtcagctcctttttccagcagatccaaagaagtagccttagtaataaccctcttttccagtataagtatttggctcttaatatgcattatgtaggtgagtgtctacatcacattttctaatcttctagtgagcattctgatttatgtcttagtatctttttgaatttgggtaaaatgaagttcattttcattaagatgatagtgatatagttattgatgagtgtttatgaatcttgatagttttgtcttatcattgcacatgaattattaaggctacaagaaagtaagcagtattggatttattttactggataaaactggaaggcagaagaaaacattctagattttaatatgatgaaatataaacaatgagaaatacttttagagacatttggccccttctaatttgtccttgttttggggtttggtagtaattcagaaagtaagctttttaaaatgcaacattctttattgttccctgagataaacgaaaacattaacatcagctgaagataaagtgttcagttaaatgaaatttgggaaatgatactataatactttgttccataaaaaaaatcctcctggaactataattttttttttttttgcttgaatcccctttcaagaaaaatggaactatcattgatatgctatggggttagtggtaaaaataatgataagagattgaagaaattaaagtcaagaaatacaagcatgaaacagataaaatttacctagaataaaaatcatgatccttactttttaggttttggtttatttgtaatgtatatagcaatatattttattaatgttg

SEQ ID NO: 118553 - DNA, 1057 bp, Homo sapiens
aactcctctacgttggggaggggaaaacatacattagcctgttttgaaccttagaccaagacaagacaaacacacaaacaccatttaatttcatactgcaataaaattctttgtaccaaaccatgggatcaaaattgttacagatactcagtgaacagttccaatgcattcattcatccagtcacttactccacaggggtttgagtgcctgcacttggtgctgggcacggctgagccatcccagacgccaaggagtttacagtctagtccagtcagtgacgaggttaaaacgaattctcgcatcattgctactgcgaatgcaccgggacaggatcagcccttcaaattctcccacgtggtccctgcaggtgagtgtgggtgtgagcgcttgcggcccgtggtgtttgggagtgagagagcacgtgtgtcagaatggcgcctgtcacagtgcgcgtccaggtgtctctgcagtacgcctctccatagccacccgagccgggctgtatgggcttggctaggcttatgtctcccgcccacgcaccggaggcggtgcggaaagcactccgcgggcgcgattgtgagtgagcgcgggcgcgcgcgggaggggcgcgccgcgctggctgggccgcgcgcaggcgcagagtgcggaagtcgggccgcggccgccgcagagcgccgggggcgggaggagcaaacgcaggaggccatggccgccgacgccggcgccggctgctaaggggctcggcccgcgagcgcctgctgccgcggacgatggtgaccgtacgggccgggccgctgccgctgccgctgcctccgcctccccagaagcaacatccgaggctcggcgcagaagagccgccgctgtgagccgtgccgtaccggcccccgccgccgcccgaggagaacgggagggcgggcgagagagccggggagttgcggagcccgcccgccggcagcgccgctccccagggagggagtccgcagcctgaggtgaccacgccgcccgcccggccccttcccatccccgcgccccccggccgcttcccacggcctccct

SEQ ID NO: 118554 - DNA, 1036 bp, Homo sapiens
cggcctttttggttctggagcctccacctgcctcctaatgctcccctaagtcagttagcacagcccccgaccctgcaccacctcgcagttgttgctggtgtgcggttctcgccggagttcttagtgcttcacggttatcttttgctgggattgttgaaagttaacctcccgttaattcccaaagtgttacttttactgctatactttaaaatttcttcatttgccactttttaggtttgtggtcccgggcaagtttaatttcttttcaggattctcatttgtataatgaggacaacagctgttggttcaggattgtgaagcttcaatgagataattgtttagcatgtttttattccatcatgaacaccatttgtattgtgttttacagtttacaaagtgctgtcacaggtgttacttcataccttaacactactcctgtccagtgaatattagtagcctcatcttgttgagaagactgaggccaagaggtggattgactaggcaaagtcaacacagtatgttaggtagaactccaacctaaacagctattcttgaccctaggttgaccatatggaagtgtattctttgcttgcttgtttgggtttgccaacttcactcctccccacaccccaaatcatttttcagcttataaatctgatgggatctgaaatgatacaaaatactaagaaagaaggttaaatgtgaaagcaaaatagctcatgcatttatatcacactgcttcattggtgtgaacggtcttaatgatgaaataaggttcagtaacttttaaacaaatcttaaagacatatgcatttacaatttttatggtgtttgtttcgcttggccctttaaggcatttgccaacttggaatttccacttgtgggataggtgcttcgtaacgtttttatgctgctttattaaccatatagagcccatgccctctggcacattttttttaaggctgaaaacattgaagagcctgtagtactgactctcaaatttgagcattcatcagaggtgaggaggactgacctt

SEQ ID NO: 118555 - DNA, 1822 bp, Homo sapiens
gatggctaagtgggagagatctgggatctgaacccaggtcatctggctctagaatctgtgttcttaactacaccacactacctttcaaatgttaaatgaacatggatggtctgtcagggaaggacttgcttgtagcatcaacctgaccaaatagaacaggaggaatggtagctcataattgcacatttccagttgaacagtgagactcagagtattagaaagtagtaactctaagccaaaaattaggagtgtgggggaatttaactttgagtcctagtatcttttggtgttctggtagcactcctgtatggacaaaaatcctctctatcataagttgtaaaataaggcttaaactgtacacataaaacttaaaagtttggcttcaataaacagtatctattttaacttgttcatttttgtcttcctttccaggtatttttttttctgaaggaaagctgcttcctcatatgtttcaagaatggctctccctatcattgtaaaatggggtggacaggagtattcagtgaccacactttcagaagatgatactgtgctcgatctcaaacagtttctcaagacccttacaggagttcttccagaacgccaaaagttacttggactcaaagttaaaggtaattctctcccctcttcagattttttgcattgaatttttagtattatgaattttaataattattttgaatataattgtttaataatttatacttgctatttgtagtttagtaagtctctccctttcgagatttctctggtagaaatattcttaaaattgttttagtggtaaaagtaagaatattaaagtgttctcgaaaataccatgattattaagattacttttgatgttttagacagtcagtatttgcttgttaaacctttggcacagaagtcccggatgaaactcatttattttctgacatctaccttttagcacagtgtttcgttgtaacgagggcctcgtactcttcccaaattatcttttctgtttcaaaagtaaagacaacatttaaaaattacaggcagcattcatatccagtttaaaagggattttttttatggtgttttgtgattatcatattgaagagtgagttttgagtaacagtaaatctgcagttttcttaggcactcaatttttaaggcttcctggaaaacagtaatattcatcttgaacaacagaataaaacatgaattaattttgtttaggtagttgaataaaggtgttcatctaacatagaattggggagaaaataacccttgtattaattttgacttcttcgtgtcttagatatgactaattcagcagaaacaatttgttaatgtaggaaaaaacaaaacaacaaaaattgctgtgacatctgtaccaaaccttttaatgttagggttttatataatggaatagtgaaaccagcacctgaactttagtgagaaaacagtcatttgcttgtattgtaggcaaacctgcagaaaatgatgttaagcttggagctctcaaactgaaaccaaatactaaaatcatgatgatgggaactcgtgaggagagcttggtaaatgtttactttttgttaccatttgtccatttgaagatattatgatttatactacactgttgtattatagttttaattgtggtaaaattgtcagtctagcaatcaatgaaaaataaaacccgcaccgtgaatgtgttattaactgtataagtatagtagtagcacaaatgatcaaatttaatatggtaaatctgcccaggaaacatacataacgaattattaattgtggaaattttccagtatgggcttaaaagact

SEQ ID NO: 118556 - DNA, 1395 bp, Homo sapiens
ttgaaagacatctttttgtcagccaacgtaattcagtctgaagcagtttgcaatgaaatgtttatgtttgcatttcgtaatatattacatttaataataattggtattaggtacttgttcatgatggtaaactaataattatttatgatcaattttcttttagaccacaggtcttgtgcagagactggggtagaattaatgcggccatatcttcatgaatttctaacatctgcctatgaagattatgacattgttatttggtgtaagctgtatttttttgtttagatttccgtggaaataggttgttccatatattattgtgctgtataaaatgtgacttaaaatgacctgtgtttaaatatgaaatagttttcattttttagcaaatttctaaaatgaagcatgtatcacaatataaacttaaacatatattggccaaataccagtgagatagttaatttaactataggacatgagtacattatagtgtaagaataaaaatgactaattttcccaatgaccccaccttgatttgaagtttttccttctgattttttttttttttaactaggcacatatctttagggtctcgctgtgttgcccagactggttttgaactcctgggctcaagtgatcctcctgccttggcctcccaaagtgctggattacaggcataagccaatgtgcccagcctttccttctgatctttgctgtgaaattcttgatgcttcagaatatttttcttttctccttttttcctgactccagttttaaaatacttggaaaaaggtgtttaaaacaaaatcacagtgatatagttctctggaaataaaggcaacttgaattacttaaggaaaaattaatatgtggactaaagccagtgacattgaaattgtggtctgcggaccatttcaagaatgtacaggtctgtgataagatactgagtttgttccaagaagtaaatatactgtaatcgtaagcacactattcagttcaattaacgttttttggtagcaagattttcttggaaaatgaagcaatgcattgatttacatccctcctccccacaaatatttaaagttgcctcttggcaatgtcataagcagagaagagttatcctgactgaattaaatgaagtcccatcaagtaaaggtgctacatttcattgtactaggtctttgagagaaattatgttagttgttgcagtctgtaaattcattttgtatttttccttataatcagagtacttccgttgtttgtgatatgtgagttccatgtgagttcacagctgttaagattaaaattattgtcaaaatatataattttctggtttagtaagataaggtgaagaaagcttgctggtttgtttagcaactttgacatctaagatgatat

SEQ ID NO: 118557 - DNA, 1052 bp, Homo sapiens
aaatttatctcactgtactgttagatcaagctggtattggggttaaatttttatgaataaaataatgtgaatgaaattaattagaagcaactagaatgataggaggcgggaaaggctaagtagttttgcaaagtagagtagctgtgtatggattcaagtgcaataagaaagctggtgttgtcaggttcagattgaaaagataatgttaggtaaaataggtagaagagtttgtaatttgtaaacattatacatgactttctatttaggctaatataaaagtaatttttagtatttatgttcttggtgatattttaacctcattaactctaattgaaatgatagtatagatttgttagttttccttatcacattgtgatgtgttgagtaatgtttgtttcctaatagataaggccttttatgaaagcgcacctaaatcgtgataaagacaaagaacttttaaaattaactcagtacctcaaggagatagcaaaattagatgactttttggatctaaatcacaaatattgggaaaggtaagttttaattgcttatttattttctctttacatcaatgaagaaaaaattatcatttttcatcagtgaccccagtatatatatagctgtcttaatttttatttaaaataggtgacttctaaaaacattttctaatccagtgacctacccccaaaagtattttcccctttcatcttaacctctaacttgttcataaacatacctcttgtaaactctttaatacttctagaagagagaacttgagagactagcatatgttggtgatgctgcctgtaaattattttgtgatgttaggtaagctactcctttatgaatcacatggaatataatccctcttctcatactgtaacttaatgtcaggataagataaaacacatgtaaaaatttcataaatagtattaaaaattaccagtaacttgagtgtagcagagaaattagaaaagtttatcctactaaaaaaacaattactcataattttcctttttaaagataaccactgttaccatcttggtatatag

SEQ ID NO: 118558 - DNA, 1022 bp, Homo sapiens
gatctgtatttggaagttacaatactagttaatatagtgactttcacattggaagtaaggcagtatggagtggtagtcaatgagtatgacctctggagccttgttttgaatctaggctcttccactttctagctgtgtgaatttgggcaaattgcttaacctctttgtgcctgtaaaataggaataattctaatagtaactcctcagagctgttgtgaagactaaatgaattaatacatgtacttagaactgtgcgtgcacataatcagtagatgtaagtgactattaagaatactcatcttgaaatgttttgtcattagaacaaactcctttgggagcaaagttaggttatcttcatgaatttagcatgatacagctttgacatctttattttatttcttgcagatatctctcaaagaagcaaggacagtagttacaagttatactggcagttattgaagatacttaagatccaagaacttcttgcttttatgctagaaatcattatgatagtgctggacactgaagcaaataccatactgcttatacttggtcttccagttttttgtaaatttaattttatattttttgaagatgatagcaatatgctaaaaaatgcttgtcccctatatgaatattctgttacgcttgaaaaatattttctccagcgttggttactgaccaccccaccctcccaccacacacacacacacacacacacacacacacacacacacacacacacaaagtggagaaaaatgtatactcaacaatgtcattttgtgactttggaaacaagttatgttttgtgtttttgtctcattgtgttattgtctgactaaatctaaaaccaaacccatgttgaaactagtacttttccctttaaaaacaaaccaaaaaaaaaaacaaaaaaaaactttttaattaaagaacctagtttgctatgcttaaaattaccaagaattttttatttctttgtcatagacacaatttctcttctgtatgccactagttacatttct

SEQ ID NO: 118559 - DNA, 1068 bp, Homo sapiens
tgaaaaggcaattcctgagacagactaatcacaccagaacaatgtgtgttcaccttcttgctaactggctagcagctgtttccagatgccccccattttggttatgtaagccgggctcacccacatgcaaagcccttctctatgaagctcagcagatgccattaacttctcttcattctgatgggatcagtctctgcttgcgagagccttgaaactgcagctctgcaatgctggcaccaaagtcagggcgcagagctgtctgcaaaggccaccctctgtccacagatgatgcaatgggtcagtgtctttctcaccatggggacagcagttgacatggaaacggttgttcttgcttctacacataaccattacgcctcacccaggcttaccaaatgttgaaaatatttgtctgcccagcatccattttttctacctctaggaactgcatcaagattatcttctgggaagtcatccttgctgaactcccaaacctgttgttttagatagtatgtgttctaccccagccctaagccgagcatgtgacttatacctggtcaaactaagtcacaggaagtttttagttatagacatgtgacccattctgtatccatgagtgtcagctctgggattctgctgaagtgattaggaaagtgacagggttttgctggctgttgtcaagctgatgaaatgagcctggagccgttggtgtcttatctttcccacaagcagcatagaacatgctagaaaatacagttcagaggaaaagcagagttgagggactgagagaaacacatttacactgatatgatttgagcatctggattcagcctcacctggatttaactacaattttagacttttcaattatatgaaaaaatttatgtcttttttgctgagggaagtttgaattaggtttctgtcacctgcaccccaaaaagttctgatgaatgtacagaaaagtcctgatgaaatgttctcccttcacagagattttcacaggaattgggcagaattagacataactatgaaagtgccagttttaagcaaccagtacctttctagaagtgc

SEQ ID NO: 118560 - DNA, 1096 bp, Homo sapiens
gcactgttttagtttctgcctaatttttgctatccaaacagaacacgaacggtggaacgtggaagagttacattaaaaacggcttcttttgttgcttttaagaagttctgggccaggcgcggtggcaggcgcctgtaatcccagctactcgggaggctgaggcaggagaatcgcttgaacccggacggcagaggttgcagtgagccgagatcgcgccactgcactccagcctgggcgacagactgagattaagtctcaaaaaaaaaaaaaaaaaaaaaagaatctggtaccagatttgaccagaaaaggggtctcagttaaaatgacgatttgacattattattacttatgataagctgtatttttaaataatgaattccagtgaaaggaaattacggtgtgttttttggctgtaatgcagaggtttgtttaggtttgaaacagaacttttaaaaatacaagcaccattatatagcagttttgttttgttttcccccagctttagcgtcacctccctcactgggcagcatgggggagaagtcagagaactgtggggttccagaggatctgttaaatggtttgaaggttacagatactcaggaagccgagtgtgctggccctccagttcctgatcccaaaaatcagcattcccagagtaagctgctcagggatgatgaggcccatctccaggaggaccagggagaagaggagtgttttcatgactgcagtgcctcatttgaggaggagccaggagcggacaaggttgagaacaaatctaatgaagatgtgaattcctctgaactagatgaagaatacctaatagaactggaaaaaaacatgtcggatgaagagaaacaggtaagtattttatttattgtgcaagatctgccacttacactgcattttaaaatgtggtcgatactgtatcatagaccacctcatctgtggtaaagaataacttgcccctttgtcttcttatggctttagtagtgttggatctgagataaatcggtggcgtgacagggaagcacttgagtgtgtctgcttaacaaagaaattttcattattttctgtgaaccttcagttatgttcatct

SEQ ID NO: 118561 - DNA, 1113 bp, Homo sapiens
ccctgggattatgcttaaatgggatttaaaatcctaggataccaccaacctcgatttcagataacaattacataaaaacagtttagtttcttcattgaataatcattccttgaggttcattaggatgcagtcaagatcatgagaatttttatttagaaaatggcactcaaagtccctttagtgtttgagaacacacgagagggcaggaattaggagtaaagagaaatcagactgggggtaggggtagggcaaatggattcatttgatccatgtttagttatttctcatatttgccaaagcattttagagttggaacctcccacgagcaatctgcttaagtaagaggagtgagggttcctgaacacagacttaagtcttttccacatgtaacctgtctgatatttcgctggtgaagatctgccatgtattttcctttttgagtattttctaaatctgttgtttgaattacattttataaactgcaatcatgtggccctaaaggaaaaatcatttaaaataaattgagcctgtctggcatttatggccttcagacatcagcatccagacaatgggaacaaatttcccaaaggatcattctgatagccaagttgattgagaggaggccattaacctagactatccagagactttggcccctgccgggtagactcagactgtaaagacggctgcttccgattcaggatagctctggagccttccccagattttccaaaaaagggagggggatgggggagcttttcccctaatttacatatttaattaaacttggccaggcacggtggctcctgtaatcccagcactttaggaggccaaggtaggaggattgcttgagcccaggagttcaaggccagcctaggcaacatggtgaaaccccatctccacaaaaaattagtcaggcatggtggcatgtgcctgcccatagtcccagctacatgggaggatcacttgagcccaagggttagaggctgcagtgagctatgatggtgccaccacactccagactgggcaacagagcatgaccctgtctcaaagaagagggaaaagagcattttctcacctatttttactaacaatgatgctctattttagcaa

SEQ ID NO: 118562 - DNA, 1238 bp, Homo sapiens
agaaatggctagtctggtatagaagctaaggatttgtttaggaaagcaggaagctcttgaatatgaatccaagctcagtggaaatgggctgagttgaattacatttagcaggtggctgctgccgttctagagagaagagacttggagggacctctgccctcactaccaggcagacctggcttggcagggtgccttgagcctcactggaacagcagttggttttcccagaactcaccccagaagcctgtgtcctctgatagcactggccagttaggacaggaggctttgattcccagagagagccagcaggactccactctcatctatgcaagcacaggctgagggtggatggcattaaagtgactgcactgctgagtggggaataggggctgggaactctcctggaagctttcatcatattaaaagtaggcatttctttaactgcaaagagatacttttatattttgtactcagtggtaaggcaagattaattggtaccttcctgcttctgttcattcctgtattcatttgagtttttgcttttacattacaggtaaattaaaagatcttgggaacttggttctccgaccttttgggctctccacggaaaatttccagatcaaacaggattcctctaccggctcgtactccatcaatttcgttcaaaatccaaataataacagataacaaagataacaaaagctttacaagctgacttggaattgtgtgctgcttgctgttagctaggggaaaggccctgccaatgtttaacttttaaaagcatcttatctaaaagaaaggctatccagtagagcccagtgctcccttgtccctcttttatgatcagggtgaaatgtacttcctgatgtaatgaacctaatttgatttccattttaaggtggtgtctgtgcagctggtgtccccgattctggctgtcctatgtccaggaagaagcccatttgttgaggctgaccttcctgatcatacacacacacagcccagcaaaagcctctcctgaaccaaacaaacctgttggttgggagactgcccagacatgattgatgacgggttcccgcctgctgtcccctccctgatcacacagctaacgaggctgcctccagcatttcctgatttcctctgtggtaataaaagctttctgtgcttaggtctgggttaggttgtgaattttgtcacgtaacgacaactaaggcagaagccttctctggctttgggagcag

SEQ ID NO: 118563 - DNA, 1072 bp, Homo sapiens
caggctggaatgcagtggtgccatcttggctcactgcagccttgacttcctgggctctggtgatcctcccacctcagcctcctaagtagctgggactacaggtgtgtaccaccatgcctggctaactttttgtatttttactaaagatagggtttcgccatgttgcccaggctggtctcaaactcctgggctaaagctatttgcccgcgttggcctcccaaagtgctgggattacaggcgtgagccacggcgcctggccagcaacatttcttaaagcactcccctactttcagttacataaaacgtcgtaggaactgcaactctcagcatttatggattacacaaacattcatgtctttggctatatccaagcagctctgaaggacagcgtatgaggtcttgtcattttgccgaagctcagatgtatgtccagtgccaccatgtccctaaagttatagggacatctataacatgtaggcttagtgactccccagcctccacatttagacatggtataacactgtctccttaagtacagttatttgtaaagtgagatgatgtgtgttttgcagggaatgggacaaggagcaaaaggctaaaaaacaaccacaacaaactggctgcagtgcttgtgatggaagggaagcacacatggaaaagcatagttttttgttttttgtttttttctttcagagacagggtctctcactgttacccaggctggagtgtggtggctcggtcatagctcactgcagcctcaaactcctgggctcaagtgatcctcctgcctcagcctcccaactagctggggctgaaagcatgtgccaccatgccttgcttggttttaaaacattttttggtagagatggggtcttagtatgttgactaggctaaggtcttgaactcctggtttcaagtgatcctcctgcctctgcctcccaaagtgttgggattacaggtgtgagccactgcacccagctagttcttagaaaaatggttgagatttttaaaataggtgaatttaacagcatggatccatgagtaaaatgaaagaatgaatccacagtgcact

SEQ ID NO: 118564 - DNA, 1056 bp, Homo sapiens
gtagcgacggggtttctctgttatccaggtagttctaaactcctgggcgaaagcaatcctcccacctcgccccccgcaggtgctgggattacaggcctgagccactgtgcccagctcataaactgccccttgaagggttgtaagcagtcattctcatgcgctaacgttattttcaccctacctcttgaactggctggtagcaagtaatccattttttttaattgactttttttcagagtccatgctaatcttctatcattccaattttagtatatgtgctgctgaagcaagcacagtaatcaatttttcattttcagaagcattaatggatctggtttagtgtgaggtcaggatagctctgcacacaacaggaggaagtgattgcaaattatagcttcctttccctgtacagcttttaattgtgcagttcactgaaggaacagatttttcagccacttctggtggaatgcgcacatacttttttaaaggaaatccaggtgatggaaggattaagcttgttactatcaagtaccgaggaagcaggctggcaagaatcctaactgaaatcacttcaaggagatttgactaagattgtatgggtatgtatcaagtacagagtatccacagataagatcagaggaagagtttctcttccctatcctcatccctcctgtattttttaaggggagggacgagcatatggaggaaaccggcacagtaatgaagggaagtgatcacagaaaacaacaggaaggaacatacaatccagctggcagcgaccatcagctgcaggctcataaggctgcatctgaatgggggctgcgcagctgagagccaacagctccagcctttcctcttaagccaagggcaatctggagagagcacagataacaagcagaggaaacggatgagggctcgtcaagatatttcccatcctacgtggtgtctcagatttgcgctttggtcttgggggattattggactcttcctcttaaagatctttcccaagattaaagcaaccattcacttgcacaactgtcttaatcatagcctttc

SEQ ID NO: 118565 - DNA, 1013 bp, Homo sapiens
ttttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattg

SEQ ID NO: 118566 - DNA, 1852 bp, Homo sapiens
gtgtgtagtatttgtccctagaggtcacttttcattgcttgaggagaaacatgatagaatacccagtgaaatgtattttgtagggcttgatctagtaagcgaaggaagcatgggaacaccggaaggcaacacaaaatcaagtcagttctgtcaaatcatggggaaggtacctcctgtgaaatgtttggaagttaaataatgggaaggacggagtggtttttctgttttccttgttgcattgtgtttgatgtgtttgttattattccactgaaataccatttttggtatgcatttgaccaaaaattcatctttctttccacggatcatctcttttggaactcaaactcgtgttggtacttgggtttccaggtttgagaggcataatcagggattgtagagggtttcagtgggcttctttctacttcgtagtattagacggaggttagtagtgttgatcattctggtcatgctatttagcagtaatttgtataagccttgccctttataaacagtgcgcttggagtcctgcttcttgttggaggtatggtgaagaggcctctgctgagaatcacgtttgctggtgtaacaagggatactggtccgtctaaccagtgtacatgtgttgtcttctagtatcaaaatggtgctcttcatgccttccgatgtgctgtgtctacttctggggaggcaccctccattcccttcttattttgctctttgcaagtatgtggacagtgtgacctgctgctgatttgtacatagcctggctctgtatataaatttgttccttaaaactgtaggctagtctgtgctagtagaaggctgttggtgcttcatagcagtccccagcaactaagctgactctcagagcactgtactgtgaaatggcgatataaggaacaaagttaaaattcccctgttactaggcatttataagcaagtattttaaaaaaacactcaagtgcacattgattatgtaaagatgacagccattttacttgtgttggaaactggcctgataatacttcagaaataacatgaatatttctgctggtttagagtggcagtaagttgttttctcaaaacaacatcggtcaggtttaaccgatttaaaagaaaaaatcaggtgtgatcccacaatctatgtagggcttaaacaacaaggacatcattttcctcatataattacttgtgcttaacgacattttcttccttttctttactatatttcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatctttt

SEQ ID NO: 118567 - DNA, 1028 bp, Homo sapiens
ttttcgtttttattgctgctcgtatgattgagtagattgtctcctctttctaggagggaaatgccacacattccaacgccttgaactgtgtgtggtttggccatattttccagaggatagtcatttttacccatgggtcattttggggatgctgttaatcacaaatctgtcatctcccccaacagtttagttttagcaaggaatctggctgagtgtggcacatcttggtgtgagtcctggtatactgggaagaattacatgcagtttgtctaaaagagctggttagaaaaatagcactaaggttggaaagccagaagggctattgtaagatgagatactgttgatgcttttcctgcttgttcatgttgcatcatgctttactgtattaagaaaattcattttgagtgttcagtgagataatgtctaatgctcttaagtttttagtttttaattgtgggctttctttaagagcataaactctacttctttcgtgcacgctaagagggagattgagggttaccctgttctggtttgcccattacagttctgctgcttcccaagaatagttgccattgttgcacttaagctttctctcaaaggacaaaataagtaatttccgatgaaattgccgccttttcatgggtctctccctccacttactgcatcacagctgggtctcctggctcttcctaatggatatcctgtgctagtggtaaattctaaagaaaagcctcgagatcctaaaagcattgaggggaagattatcttaaacattagcacaaaagactcacaaaccaggcactgtggaccagggactggtttgttaatattttggcatttcagggggttgcaggtgaggaattgcacagggaaacatgagatcattctttgatacatcttgactctccttgcttaaaattgaaaagcagattctctagaatgattgttgaaacctaacaagttttacttgtagagggagaggttcaaaagataatttctttttttttttttttgagacggagtctcgc

SEQ ID NO: 118568 - DNA, 1050 bp, Homo sapiens
aaaatatgatagaatttttttattgcctgtggaaaaattttttgtaatgtgaaagtgtcatcgagttgagtgtaaaagaaagaaatggatacttaggagtatatatatataacttgccagtgatgcaggtgagtttaagcattcattaacatttttaggaccaggtgccttggctcatgcctataatcctagtactttgggagaccgaggcaggagcatcatttgagtccaggagtttgagaccagcttcggcaacatggtgaaactctgtctctacaaaaaatacaaaaaaataaggtgggctcggtggtgcacgcctgtagtcccagctacttgggaggctgaggtgggaggaccactttagcctgggaggctgaggctgctgttagccatcatcctgccactgcactccagcttgggcgacagagtgagaccctgtctcaaaacacaaaaaagatttttgcaacagtagtgcttaatagcaggcttttattgagcaaagaaccattccctttcacttttcaggcacatggctcaaagtacaagctcttgagccagatttgctggattcaaagcctgactttgatcagccacttacacactatgtgatcttaggcaggttactcccaatatcatcacatgtgaaataaggagaataatagtatctcctcataagataattgtgagaatttaaaagaatatttaaagcaataaaaaaaatgtcttgcatgaggctgtataaatacttgccatcattactaccactgcagtcactttgtgttgcacggtaaattctggtagctttcgatactatcattctgcaacatatactcagtataaatggaaatataacaatgttatttgtacctgaaaattttgagaaatcatagcatgattattcacaagtctctggaagtagcatggactcactagttttaataggcatttgcagaggttaactgaatcgaaggtcatgaggattatggttaaaggagacctgtgttaacatatttcaactcttgccccattcatttatttaacacacaaatt

SEQ ID NO: 118569 - DNA, 1056 bp, Homo sapiens
tttttaaagttgctttcatactttgtgtcttaacttttggatatctaatttcaatacttttagaaatttaaaatttagcagttttttgtggatttctaaatccaatttgaagtagttactatggaactcataatgaaaagattaatggagattgaaaatcaatagtcttgtcagctttcttaaggttattgactgattgcgaatttttgcagaagcaagtagaatttcttatggggaactcactcaatgctttttgattataataaacacacattttgaaaacatgtttcacttgagtagaacatattctttcctgcaaacagaaacaactatacttaaaaaaaaaattctttgaaattcacagtgtggttgagaagttataaggaactatcctaaaagattttccaagtatttgtttcagattaatgaacttgttcaatcaggtgtttttaaaagtttgaaatctaaagttcagaaagacttaaaagtcatcaaaatatgtaattccaaggctttgtgtaatgatctgggtgagttttaacagtagtttgaagtagacattactgatatggtcaagtgcttggtaaatgtgctgttgtggcataaaccaaattggatttgtttcagaagccatggggaaagagaagaaaaaaaaaacatgattgttgaatataaaaataacaatcagttttgtagaacacacctttgaggaaaaggttgagcatatcacaaatgatatgccaaatgaccccttcgttttaaactggcagtctggcatatttcatttgcagtttcagtagggaagcaagttttaaagaatctctctaatcttaaatgtgtattctaaactctaatagctgaatattaaaaacttttattccaatggaaatgtcttagataaatttgtccagtatctactgcagatggagatagagttgaattgggtagttgtagccactttatatttctctttgaaatgataaaaggcacttattcttgatatggagataacagaagtgggtattttttccccttggagtgggagtaaactggctt

SEQ ID NO: 118570 - DNA, 2508 bp, Homo sapiens
cagctgtttgtttttaccaaaaatgtagaacctaaagaaatgaaggtctttgaacttttgggggaagagatagtagatttttgtagtcttgttttttaatatgaaatagttttcgggaaaggttatataaataagcatcagatgttgtttacgtttaagaaattgaattatagatgttaacttaatgtcttctttttttcttccatttctttcaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggctttgttgacacagtttgaaacgtgaacatgggcagtaaggtaggcaagaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtgtgtatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgca

SEQ ID NO: 118571 - DNA, 1002 bp, Homo sapiens
ggctcaagcgatcctactgccttggccttccaaagtgctgaaattacaggcgtgagccactgtgcccggcctgcactcctgttttcataattagaaagcagaataaggtgagtgtgctttctattgatgtattttatttatttatttatttatttatttttgagacagagtttcgctcttgttgtccaggctgcagtggtacaatctctgctcactgcaccctccacctccctggttcaagtgattctcctacctcagcctcccaagtagctgggattacaggcatgtgccaccacgcctggctaattttgtatttttagtagagatggggtttcaccatgttggtcaggttggtctcaaactcctgacctcaggtgatccacccaccttggcctcccaaagtgctgagattacaggcatgagccacctcgcccggcctctactgatgtatataatagtaagagacactctggtgtgtatgctgttgaatgaaacagaagagatggccagtgattgtgtgagaatctggatttcaaatctgcaaaaggaaggtgcagaaggtaagttgtttttggaaatggaatggataagtgctcattgtgttagtgctttatttttaaaaaattttctttagtggagaattgctattgagttttggtctcatgctatcagtgcttagaaacagcaatttcttttgttggaggagctattcctaatatgaaccttttccatttgaatattctgaagtgaaaggatcctattactattatttatttatttatttattttttccaagacggagtcttgctctgccgcacaggctggagtgcagtgatgcgatctcggctcactgcaacctccgcctcccgggctgaagcaattctcttgcctcagcctccggagtagctgggattacaggggcccagcactttgggaggccaaggcaggcagatcacttgagcgcaggagttccagaggatcctgggcaacatggtgaaaccc

SEQ ID NO: 118572 - DNA, 1035 bp, Homo sapiens
gtctgtcctctaacgtttaactttagcgggattggagaaaggggtgtgtacattggggttcccaaaaggttacctgtcactccttacagggggaagagcatttgttaaaatgaaccttttaactgtaattcttacggttagaagtcattcccgttaggttaaccattcaacagagaagcatattttgctaattttaatgatagtttaagaaaagtttaaagaagagattggagatttttaaaaaatcctttaatgtcaaggtggtgtagcataaaaatgttcaagtaacttctaacacctgggattcagtttatgtattaaggacaagaaggttgagttcatctacaaatttggcttaaccacattttcattttttgatttaaaatgtttttgggctctgctttcaacaggggaagagaacctgttctaagtctggagttaacctttttattctcttcttttgcagatatgaagtgcagagactcccattcacggctttccattctgtttcctgcaacagcacacgctctgatcgtatctcacctgtttgcaatggcttattagtatgttttactcttaaacttgcttgctctcccatcaagacccaggaatccttctttcccatttggggaaaaaagccatttaaaatttcatattgaagtatggtgtttgaggggaaagatgagagcagttattctgtattatttaatctcaaatatctttttttttttttttgagacggagtctcactctgtcacccaggctggagtgcagtggcgccatatcgtctcactgcaacctccgcctcctgggttcaagcgattctcccgcctcagcctcccaagtagctgggactacaggcgtgcgccaccatgctggtctaatttttgtattttttaactagagccgggatttcaccatgttggccaggctggtcttgaaatcctgacctcaggttatccacccgcctcagcctcccaaagggctgggattacaggcatgagccgccgtgcccggcctcaagtatctttttta

SEQ ID NO: 118573 - DNA, 1057 bp, Homo sapiens
ctgtgaggttcaaatgagataatgtatgcaaagcactgaagcaagacacttggcatgcagtaaatgctcagttaatgcttgggatcacaatcactgattttttttttttttttagatggagtcttgttcttgttgcccaagctggagttcaatggcacgatctcggctcactgcaacctctgcctcctgggttcaagcaattctcctgcctcagcctcccaagtagctgagactataggcgcccaccaccacacctggctaatttttgtattttagtagagatggggtttcactatgttggccaggctggtcttgaactcctgacctcaggtgatctgcccacctcagcctcccaaagtgctggaattataagcataagccaccgcgcccagtccaatcattgatctggatactcatgcccattttagtttgtggtaggttatgggatggttgtatcaacagtattttttttttttttaagaccgagtctcgctggtcaaaatggctggcaagaaggctgttgcagcatcaggcaagtggctggatggtattcgaaaatggtattacaacgccacaggattcaataaactggggttaatgaaagatgatacaatatatgagaatgaagatgtgaaagaagccataagaaggcttcctgagaacctttataatgacaggatgtttcacatgaagagggcactggacctgtccatgaagcatcagatcttgcctaaagagcagtggaccaaatatgaagaggaaaatttctaccttgaaccgtatctgaaagaggttattcgggaaagaaaagaaagagcagaatgggcaaagaggtaatcatgtagttgaagtctgtggatgcagctgttacgaagatggttaaacctgaaacaatcttaagaattatttggtctgcagctgttttactttaaataaatatctattgtaaaaaacaaacaaaaaaaagacagagtctcgctctgttgccaggctggagtgcagtggcgcaatctccgctcactgcaatctccgccacctgagttcaagcaattcccct

SEQ ID NO: 118574 - DNA, 1015 bp, Homo sapiens
ggatttcgaccagcctgggctctactaaaattacaaaaattagccaggtgtggtggcgtgtgcctatatacctaggtactcaggaggctgaggtgggagggccacctgaacccaggaagttgaagatatggtgagccgagattgagctacttgcactccagcttgtgcgacaggagtgagaccctatctcaaaaaaaaaaaaaaaaaagaggttgatagggctcctgctgttccaatttaggacaatgtgaacatcaaaaagaaaaatgtagatggaatgatatgatttttaaaacttccttttcaacccccagtataataatttattcagaaaaggatcatccatggatgcaaagccattgagctaaaggttgttgagaaacaggatattcacaaagtgtgccctcccagattatttattaatttcccagggaagctggtaccttgaactggagcagtctcgtgtcaccaccttaatcaagtgatctaacataagccaggacaaagtgacgtttcctaggactcctgctatggtccagtgggtgagaaggacagaacagcttctgtcatttgcttgcctgtactgtttgacctgcatctaattgtgaggaaacaatcaggcagatccagaatgtggagcattttacaagacaactggcctagattctcccagagtcagtgtcatgaaaagcaaacgaaacaaggggacttcagcggtaatagactccatgtgtgaacctagtttggattctggatccaaaaacacaaaacaaaggttataaaaggcatttttaggacccctggagaaagtcagatgtggactgaatattagaaaatgtgattgcattaatgttcatgtcttagaaatgctaataacattacaatttgtaggaaaatgacctcaggaacggatgctgaagtgttcggggtggcatgtcacgtctgcaacttgactagaaatggtctaacaaaaccagtatttacagacagaatacacctagacagagcacacatg

SEQ ID NO: 118575 - DNA, 1005 bp, Homo sapiens
agaagttcgagaccagcctggccaacatggggaaaccccttctctactaaaaatacaaaaaaattagccggttgtggtggtgggcacctgtagtcccagctactcgggaggctgagggaggagaattgcttgaacctgggaggcagaggttgcagtgagccaagatcgcgccactgtaccacagcttggatgacagagtgagactctgtctcaaaaaaaaaaaaaaaaaaaaaagtggcggcactttcgtggtgctttgcaaacacgcacagagctgtgtgtcccatatggattgacccatacccatattccaagctgagacccagtaagaagcactctgtcttcttctttcacctctcacactgtaaacaaatgtgtttttagtggacttagtgccacatttttcatatttttgtgctttttgttggtgattttggtgtcaacaagtctccaagaatagagctgaagtgctgtctagagctcccaaggtcaagaaggctgtgatgtgccttgtagaaaaaagcctctgttagagaagctgtgttcaggcagaagttataatgctgttggccatgagttcaatattaatgaattaatgtattaaacaaatacacaacacaaagttataggctgatcagttgatgaaatgttgtgatcagagccttgcaggaacctaaccttgtaccttcccctaggagcagtggttcagtattcactaattcagtgttcacaatggctttatagagcataactgacatgaataacaagaattgaccagatatatttacacagctgggttactgctaaaggtgctttcttcatagtatgttacggaacctctttttccatcagcgcttgtggatttacttcactctttttattgactgcaaagtcctttgttttataaacactgtcatttatgtaatgatttctctatttttggacattcaggttgccatctctttttttcactgctgtacagtgactggctttttccctgtatct

SEQ ID NO: 118576 - DNA, 1022 bp, Homo sapiens
agaccatcccaggcaacacaatgagacccctgtctctacaaaaaatacaaaaacaattagctgggtgcagtgatgaatgcctgtagtcctagctacttgggaggccaaggtgggaggattgcttgagcccagaagttcaaggcttctgtgagctgtgattgcaccactgctctccagcctgggtaagagggggagactcctctcttaaacaaacaaacaaacaaacaaacaaatagtgtctaatcttctttgattgaacggtaaatatgagagatactgcatataagaacattattatgttgtaaaaaactttgttggtttgatatcttttattggtttttcttgagttagacaaataaaataaggtaatgtggcagtatatatattgcaaagtagaagtaaaagtcatctagtcacctcccaggggtgtgggaagtatcatgatatctgaacttacttttagaaaaaaaatgtatatgcatgtagagaaaaagaaggcagatgtcaaaaattagggaattgaggtgaagggtatttgggagttccttgtactattatttcaacaacttttttaggttgatttttttcaaaaacccgtctctcgtaatcctaccctcagaaagaattagatgtggatcctgagaggtcacaggtgtgctaggcattttgcatacattttaaatttagttctcagctctcgaggaggaaacaaaggtgatggcaggtgaccagggtcacacaacttggctgagtagtggaaccagaatttggatgtgttacttcagaccagaccctaggggaaaaaaaaagaatttggacttagacctctgaccccaatgcctttattcctttatggccttgtgtatctcaaatagcaaacctttcccatgggaaggaatgactggcttcctctgtcatcctctaggtccttgatactttatgagcctgtgcttagtgaaagcagatgggagatagcccaggcggggctgccatcctgggacttgcaggaaaactaagaaggg

SEQ ID NO: 118577 - DNA, 1041 bp, Homo sapiens
gacaagaattgtcagggaaatactattcatcccagtacgggggggaaccccctttttaaataggtccccaggggatttgaatgcgtgtggtcaactggcaacccatttgagaaacctttggactgtagatgggtagggaagtagagtcgcagcgagggggtagtggtgcagtcaccctactgtcccattttgggcttctcattagggtcgaagctcccaggagaatccacaaaaggaatctggaaatcgggggcaggagctggaggtgtggagggaagagctttggagccactccacagagtgatccaggaggaaagcggagagatccaagaattggacctgtgacagagaaccagcatggagggggacatcgggacctcttcccctggataacagagggcgtgggaggatgaggggcaccccagtcctccactccagaaggtatgggggatgcggtcctgtaggaagctggcagaagtaaagaattcagttggagggtgtggcgtcttttaaaaaggccatgaatgttgtgtatgggggtgtttggaggccccagagccatgggttggatgggggaccagtgagggttgtgcacgcatgtgtgtggtcactgtggatgccctggcagctgtggctgggcctggtacagagtttgcccagaagggcagtggctctggcttccgggaatgaggaggtgtgcttggagctggcctgcctgccatctgcccaggagtagtacagacgccggctgcggatgtggtgcctgggttacctttcactctgctggaaggaagctacaggctggacttcagcaggaggggacgttacgggcattgttggccttatgtgacacgggccaccctctcaagaatgttgaaatagtgttcccacagaggtgttgatgctttacggaaaatgcttccttgggccttatgaagcaatcggggcagagagaggaaggagggtgagcctcctgccttgctgggcctcccaggtcgtgctgtgtactgaggcctctgaagagccagcctttctccccct

SEQ ID NO: 118578 - DNA, 1053 bp, Homo sapiens
cttggcttggttgtcacacagtgcctgcgaaagcagcctctttatccagtggtcatttagtgagcctcatgtgtaatctgcaagacctgtgggaggctctgccaggagaaaccatgacccaaaacctgccctgaggcccttagcatagctgaagatatagtcatatcaaaccacttatagccatatgttaatggccataatagccatttaatgttagtaatgatagtccacttttaatgggtgcttaccatgtgctgagagcttgagatcccctccattagctaagtcctcaggcaactccttccagtaggtcctatacttatccccattttacagatgggacatgcaaagtttagagagttacataccttacccaagcccacatagctagtaggcaacctggctccaaagctcactcctaccgctataccaaagacaggtccagttgcccaaggaagtcttaaaaagcttcaaggaggaggtgctgtttgatttgggtttgaaggatgagtagaagtttgccaggcagagacaggtgtgaagttcatctctctgcagggtccagggcagctagggagagtcaagcattagcggcctgcaaggggcagcctggtcagttgtggggaggaccaggagatgcaccaggaacactggcttagaggatgtgggtcttcctagatgtttgaaccttatcctgagaacccatggagggcaatgggaagggtggggaggagagtgccagctccctggaaatgcaccctggcctcagagactagttattacagttattgcagtcgccccaaagcgatggcatctgaactaggggaggaagtgaggatatttgacaggttgtagacaatagggtcaaaaggaccagcgaacaaaaagcgtggaagatttcaagtttcttgctagttggaacaaagtaactttccttagctgagcttgttcagcctttttcatagtaaacattattcttggagggccccttctggaaactgtcagttgaaggactccctctgccctgtaagtgaagggaattgatgttcattg

SEQ ID NO: 118579 - DNA, 1150 bp, Homo sapiens
actcttagttgaatgttgcctgatgaatacaaagcatgtttacatatgtgctgtgtaactgtttccatacaaccacaagcaattatcctcacctgaccgacacaggaggcgaagttgagatcactgagacgttgggagccccagtttgtcaaatatgagattccagtctggcatcatactacagggtatcaaaaacttgacaccatggaaacaagtcttggtactgcatgcacgctagtgatggaagtgaaaccctgatctgctcatttaacctctctaaatctggcccctatcatccattcttcccagaatagccagaatttagattgtgtcattctctgcttaaagacctccaatgtcatctcactgcacttaaaattcccagtccttaccactgcgtggaatacccagcatagcctggctctggcctgctctctgaccttgtctcttaccccttccctaccctccatgccattgctcttaagccacactgacctcctttctgttcctggaacaagtcaagcttgttcatgtctcagggtctttgcactggctctttcctctatttggattctgtgtttctcagactctcacatggttgcttgtctcccttaatctattgctgcctctccatgtcactctattaaatcaccttgctttttctttgtagcatttaccaggatctgaagtgtttttctgttttttgtttgtttggttggttggtttctttgagacggagtctcactctgtcgcacaggctagagtgcagtggcactatcagctcagtgcaacctccgcctcccgggttcacaccattctcctgcctcagcctcctgagtagctgggattacaggcatgtgccaccacacccagctaattttcgtatttttagtagagacggggtttcacctgttggtcaggctggtctcgaagaacccctgacctcgttatccgtcagcctcggcctcccaaagtcctgggattacaggcgtgagccaccgtgcctggcctgaagttatttttcgtttgtttgctgcctttcttcccacactagaatacatgctacacgagaagagacctgtgtctgtcttcttccttgcgggggcctcagtgccatgaacacagcttcccgatgtgtatggaatgacaa

SEQ ID NO: 118580 - DNA, 1037 bp, Homo sapiens
gctccgtagtttgtaagttttggcaagtccttgagaaaagtcagaattgtagtctctaccagaagcatcatttgtgagcttgtataagtaaagtgaacctcatttaatttttgttattaaataaaatttcttcaacattgatttaaaatgttatagaatgttttgtgctgtataaaaatatcatataagccaaatagtgattagttgtagcttgacagtagaagggctgactccaaagctctttcaggcaatctgcgtttttgatagagcagttcatattcagtggggtgtgttggtactctgccacttttgaagaaaagacatctgatgtagagctgtgatacacattttattcctctcactataggcactgaacgcagaggaggcccgccttcttcatgtcaaggagaccatgcagattgatgagaggaagcggccttacaatagcatgtatgaaactcgagaacctactgaagaggaaatggaggcatatagaatgaaacgtcagaggccagatgaccccatggcctctttccttggacagtagcaactagtcagaagaccatccaagatagatgcagctgatacattcttttcagcttcttattgatgattgtagatagaaaaatccttgtttattcttcttgctgcctggctttaataaatatttcagatgcctcacagtaagttcactcctttccatactgaggaaacaagaaaagaagaagaggcacatgaagtgtgcttttgggaatagaatttaaaattggattaagattttatttccagttttttttatttatttatttttttttttgagacggagtcttgctctgtcgcccaggctgaagtgcggtggcgcgatctcggctcactgcaagctccacctcccaggttcacgccattctcctgcctcagcctccctagtagttgggactacaggcgcccgccaccatgctcagctaattttttgtatttttagtagagacggtttcatcgtgttagccaggatggtctcgatctcctgaccttgtgat

SEQ ID NO: 118581 - DNA, 1014 bp, Homo sapiens
aatgctgtcactcttttttcaagtattcctattgtactggagaagctgggaaggagattgttgtaagtaattgtctttggttcttaaaggtataaaacaaccgaagctcctaagtcaaactaaaacatgctgtctcatgtttcaaattttaacttgttcttagatgattagtaactatgacactcaactcaaattacatgtatttcccacagaactctgaggagtgtattataaatgagataactggggaagaatctgtgaaaaaacctcaaaccctcatggaggtaagttgataatcatttgtcctgaatttttaagtcctggagggagggctttaaaacctgcacctgagtttttttttttcttttgaaacagaatctcattctgtcgcccaggctcgagcgcagtgcacggtctgggcccactgcaacttccgcctcctgggttcaagtgattcttgtgcctcagccgcccaagtagtgcacctgagctttgttttcacattaataacactgcatttcaatcctccctttcagctgcatcaagaaaaactgaaagaggaaaagaagaagaagaaaaagaaaaagaagaagcatcgaaagagcagttcagatagtgatgatgaagaaaagaagcatgaaaaattgaaaaaggtaatttgtgaagtctaaatagtaaaagtgacaagtagcagtattctttgttttttgggttgtttttatttttttgagacagggtcttgctctgttgtccaggctggagtgcagtggcacgaccgcagctcactgcaagctccacctcataggctcaagcaattcttctgcctcagtgtcccaagtagccggtattacaggcacatgcccccatgtgcagctaatttctgtatttttttatagagccaggatttcaccatgttgcccagtctggtctcaaacttctgagctcaggtgaactgcccacctcatcctcccaaagtgctgggattgcaggcatgagccaccgttcttgccagta

SEQ ID NO: 118582 - DNA, 1785 bp, Homo sapiens
agctttttaaaatggcattctcagagttctagagagtggcagcaaaaagtgtgctgtggtacataagtgcctttgcttgcatcacatttgccaactttcattggtcaaagcaaataacatggtcaggcccagattcaagggacagagaaagacttcgtctcttgatgggaagaaaagcaaagccctgtggcaaaagggcatgtatagaaagataagaggaatttatggccatcttgtaacttactgtactcaacagatgaatagcaactgagacatcttctatttgcctcagaaaaaatttgtggctttttttttcctactgtgctttctataacaaaacccagtaaagaatgttccctttctttctgattagaaataaatgttttctggaaatttaaatgcaaatcaggttgtaaaatgtattgaataatgtccaatgtccttttagtatggtggccaagaacatttggatgcccctccagctgaattgcttttagcccagactgaagactatgtggagtactcaagacatgggacagtcatcaaaggacaggagcgggctgttgcctgctctaagtatgaggaggatgtgaagatccacaatcacacagtatgtgctaaactggaacaattttgtgtccttgttggttttgctctgtattgcatttttccactacaactttattagctaaccatttgtattctctatgctttaaaaaaaaaaaaaaattttaactgtttcatggaattttttcaaaaatagaaaaattttgaaggaatactatgttcatctatatacccatcatctaaattctgaaatttttaacatattgccttatatgctttgtctagttgtatgtgtgcatatgcacagttttacatatatatgtaaaatacacatatatacacacatatagtttatgtatatatttatttgactgaaacatttggaaattatgtatatcatgacattttatccataaacgctgtatcacatatctccttaaaatgaggattttcttctatataaccacatcgacattattgcacttcagaaaattaacattatatcacctaatatctagtcattaatcacattttccaaaatatacagaaaaatgcctttaacacctattttttgttttagtcagaattcgtttcaaatttcttttgatcgttatgcggttattatgtctcttttctagagtgtatctcttcattttcatgacggtgaccatttaacagattaggccaattagtttgtaaattgtctcatattctgtattgactggttcctagtagtgttatataacttgtttctctatccctgtatgttttataaataggaatttaggtctaacggcttgattggatataagttaaatattttgacaagaatatttaataagtaatgtagtatattcatattgcattgtaaacatcataaagcatatattgtcctttgctgttctcttgaagtaaccaaactacaattgtctctcttagttgagggtcaaaaacctaactccctataggagccagaccagtgatcatacatgagtgaagtgagccaggcaaattgtacaaactggagaacacaagccctatctaatggggcatccactgttcagcaacagctgattattgccaagtggttatataggcccagaatttcccactcctacgtttttcaagagaagtcagataccctaaattttttaataggcttttgggaatagaatttaagagttttgtaactacaggtcctgcttctcacacttcagg

SEQ ID NO: 118583 - DNA, 1067 bp, Homo sapiens
cagtttttactgttatgatttgacctattcacccttattcctttgaagtcatagtcacactgccttttttttttaattagaggtatcattttaaaattataagatttcatataaaaatctggatttcatcttttcttgaatattgtaatatatggtaaccccacgcctgcctggtaagagtcagtcatctagagttctgtggcaactgcttgtttttgtcagggcttgctccctgcaatttactactgatgccatttggctcagtttacattaatgcctggttcaaacactgtgtaactcctgctctttatagagtaataggtctagggctacaaggaatcccaaagagataggtttgttcagtgaccttttctgaaataaattaatttaaagttattcattttaaatatataaaaatttaggtggtgacttgaatgttgtaagtaaaatttaaatgtttactttttctttctttctttcttttttttttttttaaaggcaaaacgaacattgaaagcccagaaactccaagaggaattagcctcaggaaaattagtggaacaggctgtaagtaatgaaaatgatcaataaaaaggttttatttcttttaaacaaagaaatgaaaattgaaacaagaattcattttatagctcttcagttaggaagagagaaatgctattgggggaaaaataaaactgatactttgtatacagttcatagtaatataaattgatgcagtcagtttgggaacaatattgccactatttatatttagacacacacaaacatttactttttcaagttaaattattaaagctatccatcctaaagaattttctagagtttagaaaaatcatgatgcataaagatagtacagcatttttcacaatagtaaagaaattggaatagcttaaatgtccaggaacagggaattggttaagtgcatctgcatggtgtaatgctgtgtagttcttaaaatggcatttctcaagacttcattaacaacactggttaacacttgtatttgaataatacatgaaaagatagtataatattatcacacagaa

SEQ ID NO: 118584 - DNA, 1050 bp, Homo sapiens
tgactgctatgaaatctttctattttgagtttttctggttgttaccgtcacatctctagataataatacctacacaattattttaattaattgactatagacattatttgaaccaaaacttcttgtgatagaagatttagattactaacacacatctctattttccttcctctcttgtcccccttcagttatatcactattcttagtttcttagttggaaatattttcactctaaaataaattacttctttatttttaattattctttattatagtatagagatagcaaccttgttctcttccccctaccactgcaatatttctgttcttagattttgtataagctacctttgtaattgtaatactgattattttccaattttatccttaaattttttttttttttactttaattacagagacatcaacccccatattcctcagtatatttcttcagtgccatggtatattgatccttcaaaaagacctactttaaaacaccagagaccacaaccagaaaaacaaaagcagttcagctcatctggagaatggtacaagaggggtgtaaaagaggtatgtaggcaacctgtatacatcttcatggatatggagagtttaagaacttaatgtaagaatttttaatgcaatactatttaaagtagaaacagataataaaaccctttatctggtattgaaattcacagtgcattactattttatctttgtgtttcttatataaattttacactcctgaactctttaaagtttcacatttataaatgtgtggagactctaacttattttccttttaacaaagaaatcatttccctagacaaaatagtaatgagagtcaaagttatttctaacttacgtggttaagacatttttgtttttctttatatatatttatagaattccataattactaagtaccgcaaaggagcatgtgaaaattgtggggccatgacacacaaaaagaaagactgctttgaggtaagttcacctttgaaaattttgaaaaccgttgtcagagtctttcttttttctttg

SEQ ID NO: 118585 - DNA, 1003 bp, Homo sapiens
aaaaattagccgggcatggtggcgggcacctgtaatcgagctactcgggagactgaggcaggagaatcgcttgaacctgggaggcggaggttgcagtgagctgagatcatgccactgcactccagcctgggcaacagagcgagactctgtctctaaaaaaaaaagaaaaagaaaaaccaagagaatgtagtgtcagggaagtcaagacataatatataaaaagggaaggaacagagctgaaaaatgtccattggatttagcacaatggtccttgatgacttaatgatgtaactcttttctttagaatggtagggaatggagggctaagttagagtgagtgaggatgaaaatagaaggtgaggaaatggaggcagtgaatatagataactcttgagatattcattcttgaaggggtacagagataggaccctcttttctctcattaagagttactgtgttagaaaagtttgagacatacacagaaagagggattaaggatggatatgagaaaagagtcctgtgaaattttaaatacacgtgtgtgtctctctccatttgtaaattggagttgagagagaaacagtgctaacagtatgtagagaccttgaggagggggaagagacccttccttacacataatataggagaaaaaaaaacatatgaaacagtatatattattaggatgtatttttggtagtttgagtgaattcatgaaggcctactttttactgtaagtttcacttcttttcctagaggaggccagataaccatgtcagccacagttgtagatgcagttaatgctgcacccctatcggggtccaaagaaatgagtttggaagaaccaaagaagatgaccagagaggactggagaaagaagaaggagctagaagaacagcgaaaattgggcaatgctcctgcagaagttgatgaagaaggaaagtaagtacttaattttttgtatgatccattcattcagaattcaaattcatgtctacttagttta

SEQ ID NO: 118586 - DNA, 1019 bp, Homo sapiens
ttgaagcatatataataaacttgcttggaatgatgattccatgttatatccaaagctaatataagatcaaaacacctgtgctgtagcatagactgacaataacttcttactgcagaaggtctgaggtcttcgtttgaactggtagtcaaagccaacattatgttttctgtttgttctgatgtgggataatttgtcctaataagttacattagtgagactgttaactcttactttggtctctaagaacaatagagattcagatacttctaaaacttacttcctaatgaaagtcaattctggggccacagacacattccaaaaaatgtgtcaggaggggatgcaggtgattgatttgacaaagggaaaaacatgaatttttgattgacagctaatgtctatgttgatatggacaatgactcaaggatttgcagaaattttaataagagattcctgttttctagatctgttgcagtctccttcaagcattctgtcgaccctggatgttgaattgccacctgtttgctgtgacatagatatttaaatttcttagtgcttcagagtttgtgtgtatttgtattaataaagcattctttaacagattcttcctagtattgtggttgcttttccatggaggttacttaaaataacatgaaagctagctgaggtgtttaacaaagagtctataatgtgacaatagagatttgtctgatgtctaaaaacttaaatctttttggtttaacagcttattttagaagctgccactgttttttcctgaaaagtatacccctcaatgtgtactttattgactttttgtggccattaactagtgacagttattagatctcttaattagaagagctacttccaactcattaagtatctattgctgggcattctttattgccggttctacttagtttctaatgactttaatactcagtattgaaaggctctaaatctgagaattcagcctccttgggatcttcaattagattccttaaagatcactggagataatt

SEQ ID NO: 118587 - DNA, 1106 bp, Homo sapiens
ggctagtccctgggactgggtcggcagacacgaaaggcacctcaggaggccggatccggctccgcccctccagcctcggactagcctgggcttgtgctcacaacagcggtagagtttagtgtggaaaagggcgcgggccagacctactcctcgccccgcgcccccaacccagctccccacccgcacctggcggtcaactcccgcgcagtcccactcaccttgacagagactgcagctcctcagcggtaaccaccctccccgggcctgctcacctcaccccacgatatcagatccgagaggcctacgaggagaggggactcgtaggcaagaggagagaggcccggggagggggactgtcctgggtggaggcctcggcagcgccgccgagacaactcggccctgatcagggtcagctcggagccgaaggggccgcgcctgccctaacgaggaatatattggagggcggggctttctcgcgagaagggggcattttcgccgctgattggtgtaattcttttgatggatggcctccgcgatccgtaaacggctgggccgtggagtgagaagtccggccaatcggctcacacttcccgttatctggcctcaaattccccggcccccttccacgcccctacctctaagcgtctctcattggagaatttaacaaagtgtcttcattcagtagggggccaaactaaatactcggtgcagcaaccctcgcctgggtcaggtcaatcggctgccagccggattggccggcgtatcattccagaatgtactgtttgttctgtggggtttaggagttctacagtggttctgccccatctttctaaaaatacagtgagtagttaaaaaaaaaaaagtcaacctttgatttttaattacagataaagaggtggtggaatttatatggtttggtggtttatcaacttccagagtgctctcttcgtgaactttggaagtcagttgattcttgccttagtttgctttttatacaatttatcaaataatggagttggactgtgtaatttcttgaccctctaccaattttctgaatttgcttttaaagcaaatttaaagagaaaagttggtacaatttttcagtt

SEQ ID NO: 118588 - DNA, 1088 bp, Homo sapiens
gaactcctaaaccccacagaacaaacagtacattctggaatgatacgccggccaatccggctggcagccgattgacctgacccaggcgagggttgctgcaccgagtatttagtttggccccctactgaatgaagacactttgttaaattctccaatgagagacgcttagaggtaggggcgtggaagggggccggggaatttgaggccagataacgggaagtgtgagccgattggccggacttctcactccacggcccagccgtttacggatcgcggaggccatccatcaaaagaattacaccaatcagcggcgaaaatgcccccttctcgcgagaaagccccgccctccaatatattcctcgttagggcaggcgcggccccttcggctccgagctgaccctgatcagggccgagttgtctcggcggcgctgccgaggcctccacccaggacagtccccctccccgggcctctctcctcttgcctacgagtcccctctcctcgtaggcctctcggatctgatatcgtggggtgaggtgagcaggcccggggagggtggttaccgctgaggagctgcagtctctgtcaaggtgagtgggactgcgcgggagttgaccgccaggtgcgggtggggagctgggttgggggcgcggggcgaggagtaggtctggcccgcgcccttttccacactaaactctaccgctgttgtgagcacaagcccaggctagtccgaggctggaggggcggagccggatccggcctcctgaggtgcctttcgtgtctgccgacccagtcccagggactagcctggggaggaagaatggaacccctgcagttagaggttcctcacatgactagctctgaagacctcctgccttcctgtctttagttggtgtgggagggaccttccatgtatccagggcttagcttgtgcccgggacatggttgtgttatgcacacttaaatcaatggaattcccaggttcatctttcagactaggttagcaacaacccaccgcacccccccgccccaatacgtgctcctaatgtcaccttttaagtttcctttcctaacaacaataaaagttaag

SEQ ID NO: 118589 - DNA, 1264 bp, Homo sapiens
gtggctcacgcctgtaatcccggcactttggaaggccgaggcgggcagatcacaaggccaggagaccgagaccatcctggccaacatggtgaaaccccgtctctactaaaaatataaaaattagctgggcgcggtggcgcatgcctgtaatcccagctcctcgggaggctgaggcaggagaatcgcttgaaccagggagtcggaggttgcagtgagccaagatcgtgccactgtactccagcctggcaacagagcgagactccttctcaaaaaaaaaaaaaaaaagcatggttccttccctctaggaactcaatttaggatgtgaccaacttgtagaagggaaataaataacagatggcactttgcaatgacttagatgcactagccgcattgggggatgggaggcttataaatcatttcttggcccagtgcaaagatggccaaggaaagcaggaaggactactcttacactccttgctggtctttttttctatatatagatgatagaggtactgacaacaactgactctcagaaactgctacaccagctgaatgccctgttggaacaggagtctagatgtcagccaaaggtctgtggtttgagactaattgagtctgcacacgataatggcctcagaatgactgcaagactaagggactttgaagtaaaagatcttcttagtctaactcagttctttggctttgacacagagacattttctctagctgtgaatttactggacagattcctgtctaaaatgaaggtatgtttgaagctacatttttgtaattttgctcagtgtgttttggagatggaattgttaccttttggctggtattcataaacttgaccttttttttttcagcacgtagccaaaacattaattttgtctactacagcattaatatttcttatcataatcaagagtagtacatcaggtattagacttaaattctgaaatgaaaaatagtctaatatcaagtaacaaattgcagtttcctagtaagaaaattggctgtttttaaaaaacccttcttgataggttggatttgtccatttatttactatttttagatataaacaaatttattagtggcagaaatttattagaggctacattgtggctaagaattaagatatatttgttaatcactacccatatataaaattgtaaatgttttagccttagacctagtcaagacttgcttatgcttggcatttccagcttcagtgtacatgcagtagggaggagagtgtgtctga

SEQ ID NO: 118590 - DNA, 4630 bp, Homo sapiens
gattagtagtggatagaactcttagaggcagagtaaacagtatatgccatagtattttaaaactgttttatatgtgttcccacaaagacaagagcctggaaaaaatacaacatcctgcaaagaaatggcttattttgtaaataagccataaagtatttcagtcctcatatatctttgactagttaacttatttgatcaaactagaacaatgtttacttatagttctacagtgattaataaaaacacactttttctatgctgagccaaacattatactgaaactcagtccagttactcaaaaattggttctaagtggggtccatagtgttgacaggctatagtttaggtatgagtggattgtgttaagtccatcacagctgagaaataaacctcaaatatacattttcaaaatgttgggtcggagttctagattatcctttatgttttaattgaaataaggtagagtcatgggcttactggttttgtttttgattttttaggtacagcccaagcaccttgggtgtgttggactgagctgcttttatttggctgtaaaatcaatagaagaggaaaggaatgtcccattggcaactgacttgatccgaataagtcaatataggtttacggtttcagacttgatgagaatggaaaagattgtattggagaaggtgtgttggaaagtcaaagctactactgcctttcaatttctgcaactgtattattcactccttcaagagaacttgccacttgaaaggtaagtgacctttgttttgaacaagagacatttggaaatcagaatggtattgtatggatattgcataaaatcagtatcctcatagaattctaataaaaataagtaaaatgacagctgtggctccttgaactttaatgtccatcataagtgagaaaatgttccattgtcaatagcttcgttaaagctaattcttgggattaaagtacattttgactttatagaacctagtaggaaagcatctaacacaaatttatggaaaaaaaggaccttcagtggatgttgaaatatttattaaaactaaaagaaaataaatcttgtatttgtggcatagtactattcattttaattttttggcccaaatcatctaaaactcccatatggtgcctttagaagttagtatctctgatggaaggggaattcctttcaatagttcatttgctatgttaagtgtgcataagctttactttaaaaattgacttcaatgtttttctaaaaacatcttttgactagatgtagtattacctaataaaagtaataccattttctttttaaaggagaaatagcattaattttgaaagactagaagctcaactgaaggcatgtcattgcaggatcatattttctaaagcaaaggtaaatattttataaagattatgcctattgatatgatctgtttttatatttggcatttactttaaatttatctcttttagccttctgtgttggcattgtctatcattgcattagagatccaagcacagaagtgtgtagagttaacagaaggaatagaatgtcttcagaaacattccaaggtatgtgaaggacatagcctaaatcctattaacagctgtaaaagaaactaaaccccttctatctcctgaagtaaaatgagatgtcatatgtttatttgaaacttaagtagctatcctcaaatgtttttaatgagcaaagacacatgttcataggattgcatttattaatgtagttaaataaggtgggacttacttggagtaataattttttaaaatttatgtatgtacagataaatggcagagatctgaccttctggcaagagcttgtatccaaatgtttaactgaatattcatcaaataagtgttccaaaccaaatgttcagaagttgaaatggattgtttctgggcgtactgcacggcaattgaagcatagctactacagaataactcaccttccaacaattcctgaaatggtcccttaactggtaaatttggtccgttattattctccagatagagaacattttccaatgccataattttcaactaaagaagagtaattatcttcaaaataaacaaaatggagttggaatagtaaagggggagatgacatcactgatctagtcagctaatatttgaaggcctttactatatacaaggtacaacatcttaggagtaaggaattatccaacctctgatacatacgttagccatttcattaaattttcagcttagagaacagcatcctccttgtagcactaaaatcatgcttttttttaattgcacatgatcttgctgtatgtatctgactgatttaaaattacataagctgagcaggacaacagcaccaaaagtctgaaccaagtatgaactaatttgagactgttagcttataagcaaaatcaatatgaacttggatattgtacttaaaagaaaaaaaagtaggccggatgcagtggctcacgcctgtaatcccagcactttgggaggccaaggcgggcggatcacgaggtcaggagatcgagaccatcctggccaacatggtgaaaccccgtctctgctaaaaaatacaaaaaaatttagccagtcgcggtggcgggcgcctgtagtcccagctactcgggaggctgaggcaggagaatggcgggaacccgggaggcggagtttgcagtgagctgagatcgcgccactacactccagcctgggcgacagagcaagactccgccacaaaaaaaaaaaaaaaaagaaaaaaagtaggatatgatagatggtctctacattgggtatctggaaactgccagagtgtgtcaacactatactaacctatcattgctatagcagctggactactgcaaagtagttatatgcataaaaaatgtaaacttgctttctgcatatgtgatatacattcttgccatataaatttcctaactcagtgatgatttattctactcaaaactaaatgttaacatttaatacatctacatgtgattatgaatattagatatgaacatttcaattttcttagtagtatttaggcagactggcttctgttaagttggattttgtttgttttctttatttaaataggattattacagcaccaaaaaacttctctgaagcctttctccacaaccttgttctatggattccataatgttacaatggatttaagctatgaagcctcaaaacatcacgagataagcatgatggtctcagacttgggaaaactgcctaatattatgctgtagtggaattatgtttagatttgaattcatctgtgaagcattcaaatcaaagctaaaagcctaaatgtgaaatgctaatgacaagcctgagaaggtaaactgtgaatcttcatttctatcattgatctaactttagatattggatcaatatatttaggtggtattgaaaatgctattggaggagtcacactaatactatcaactatcagtcttcccacagcttcaatcactgtcattattctaatcctactcctacttaaattttaagttatgaggtttatgtcaaaagcaacatttcacaaatgtacttttaaggcataataagggttaacattctaggcagtataaacacaccccataatgcaagtaataggtaatctagagatgtggactttattgctatatgggaattacatttaaatttgagggcattttatataaagaaaaatacagacctataaagtttggcatattcattaagttatcttttaatatttttttctagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccattatgttttagtactaagggatatacctttcaataaagttaatgaaattcaatcctttgctgggtggcttttttctcctctgatttaattaactcttttagcaatgtgttaacagaacattataaaaagctatctctactcagtatatttaaatttagtactaaagttagatgcatagtaccagaaacaataaaatccctattaataatatgactattagatgacactttactttgttttttc

SEQ ID NO: 118591 - DNA, 1098 bp, Homo sapiens
caaagtagagttaggaacaaccaaaattgccaaggataattagggacattatataatgataaaattcaccaagacagtgctaaaagtgtaagcacttattatcagatcttaaaaatacatgaagagaccaggtacagagactcattcattcctgtaattccaatgctttgggaagccaaggtgggaggattgcttgaggccaagagttcaagaccagcctactcaacatagggagaccctatctctacaaaaaatcaaaaattagctaggcatagtgatatacatctgtagtcctaggtactgaggagcctgaggtgggaagactgtctgagcccaggagtttgaggctgcagtgaagcatgacagagttgctatgctccagcctgagtgacagggtaagactcaaaaaaaaaaaaaaaaacatgaagcaaaaagtggtagcattaaaaggaggactggacaaatcttcatttacagttggaaacttaaacattcctctctcagtagtccatagaattaatagaaaattagcaaagatgtaggaaaatggaataatactaataaccagctagatttaattgacataaaacccttctacctaaaacagcagaataagcattcttttcaagtacacatggaacactcaccaagataaaccacatcatgggtcttaaaccttaacaaatttaaaagagatgaaatcatataaaatatgttttttgaccataatctagaaatcagtaacagcaagaaaatctccaaacacttggaaattaaacaacacatttctaaataactcatgatactacagggaagtcttaaaaaatattttaaaataaatgaaaatatcaccgtgcttggaatgcagccatgctggtgctgcaatttataacaatcgactgctttttactaaacaagaaaaagttctcaaattaacactctaagctcccactttaagaaagtaggaaaatctaactgggtgtggtggcacaccactatagtcccagccactcagaaggctgaggtaggaggatcatgaccccacgagtttgaggctgcagtgagctatgatcataacactactccagtctgggtgat

SEQ ID NO: 118592 - DNA, 1051 bp, Homo sapiens
gaacagttttattttattctttttagtctatgatttttcttgcctgattgcagtggccagaacaataacatggagaaagtggccatctcagtcttgttctggatcttaggattttgaaagcattgtttttgaccattatgtatgcaagctgtaggcttttcttaaattccctttgtcatgttgagcaagttcccatctattaatttgttgttagcagagtttcatgagtggatgctgaattttctatgctctttctgtatcagtttggtcattctttttgtttagactgttaaaatcatggattttactgattccagaattttgaaacagcttatatttcctcccaaccccaaacttggtcatggtacattattcagcttatgtatctagatttttattttttgaggatttttatgtctgtgttcattttggatattgtgcaattgtttttgtttgttttttccttgtgttatctttatcttggtatggtatcatgttaattctggtcttgtaaaatgaattgcaaagtgattattctttctggaagagatttgtagaatttgttatatctttaaatgttttatgaatttgctagtaaggttttaaacaatggttcaatttttaaaaatagagaatttattgaggtttatttaagtttgggtactgtatgcctttcaaggaattggttcatctaatcctatgtgcatagagttgttcatggtattttctttgtgtcgttctaatgaggatctatactgttatcttttctttgattcctaagattggaatcaaagattggaattccttctctttttttgtcaattttgccagaggtttatcaattttactgctcttttcaaaaattagttttttgattgttttctattaatttgtttacaattgcatttattttctgcctcttttttttttttcttctttctgcttgctttaggtttagtttgggcttcttttttttgtagacaggtctcacttcatcacccagactggagtagtgttatgatcatagctcactgcagcctcaaactcgtgg

SEQ ID NO: 118593 - DNA, 1047 bp, Homo sapiens
gcatactttgatcatcccatttaaatataattttatttcccttatcctgttttttttttttttctgtgtcacttaccaacttttaacacgacatcagcggttggcaaactacagcccttgggccaaatttggcccactacctgttttatagcttttctaggatacgtatatgctcatttgtttgtatattgtctttcagacagttgagtatttgtgacagagactatgtggactgcaaagcctaacatatttactacctagtttttaaaaagtctgccagcccctgtactggttgatttatggtttgtctcctcctgctagaatgttaagttccactagagcagggatttttgttttttttcactcttgaattctacatacctctaatggtctcccaaacagtaggagctcaacaaatgtttgttggataaacgaaatagcccaccaaaaagactaaggcctgacatagtacttcacaggactgttgtgagggttaaatatcttatatatgtatagctcttagaaatttgtgtggcatatagaaagctctcaaaaaatgctagctataggctgggcgccatggctcacgcctgtaatcccagcactttgggaggctgaggcaggcggatcaccggaggttgggagttcaagacaagcctgaccaacatggagaaaccccgtgtctactaaaaatacaaaattagccaggcatggtggtacatgcctgtaatcgcagctactcgggaggcttaggcaggagaatcgcttgaacctgggaggcagagattatggtgagctgaggtcgcaccattgcactcccgcctgggcaacaagagcgaaactccgtctcaaaaaaaataataataaataaaataaaaatgctagctattaaatataactacagacttttattgaagtatatgtttccccatacacttgccaacattgtagtgtacatatgatgtctaaatatttgtaactgggagagttgaaaaatgcctcataattttaaatattactttggtggtaacagtgaagtctgttata

SEQ ID NO: 118594 - DNA, 1018 bp, Homo sapiens
caacattttgccgggtgcggtagctcatgcctgtaatcctggcactttggaaggcctaggcgggcggatcacaaggtcaggagttcgagaccagcctggctaacacggggaaaccccatctctactaaaaatacaaaaattagccgggcgtggtggcgggcgcctgtagtcctagctacttgggaggttgaggcaggagaatcgcttgaaccctggaggtggaggttgcagtgagccagatcgtgccactgcagcctgggcgacagagcgaaactctgtctcaaaaaaaaaaaaaaaaaaaaaaaaaaagacaacattttttagttttagcaggagatcccttcttgtggttaatttaaattggtagaattaaagcatttcagatattaatttcacatttggccagtggtcagtattactgtatcttctaaaaattaaggagccctgatctttctttagagagctctgtgttctttgccatagtaaatatcccttgcagtgtaaactagtttccattttacctgctgggagaaaatttagggttgtgcacctataaatgtcatggtgaagtggtggtataagatgtggattaggtaggaaagtaggtaaatcttaatcatgaaaactttataaaaattaaattctgtatttttagcaccttatatgtttatttttcagggcaaactctttgattctacaatagctgatgagggaacatggactttgggtaagggtaattactataattcatcaaattaaaataattttgtcttgatatcttttcctcttttgtattaggtcttttttgtctttgcagctttgaaagataaagcaatagaaatgtgttgaaaaccgttgtatgtcaaagttacctagtggggggagaaaaaattagttagttgtttttggaaatataaaatttaatgaagaacttcttgagaccaccctggccaacatggcaaaaccccgtttatactaaaaatacaaaagttagccgggcatggtggcgcatgcctgt

SEQ ID NO: 118595 - DNA, 1021 bp, Homo sapiens
ttctggatttcagttctttcatccggggcctgccggtgccgtaaacggccattcaaagggaaaaacgaacacgcacaccaaagcgctagcttgcgttcctgcgcatgcgcagtgacccgagcggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaaggtagcggcagctcggggcttgtgttcagtttcctcttcccagacgcccccagccccgtttccctgaacgactgttgggtgtcccgacggctcctgtggctggcagaaagagaaagaggataacactgaccaggtttgggtctggtcagagcccccgcctcttcagggcaggtgctgagttgtggaaatttgaggagcctattttcgtgtttagttttcaaactaagactgctgcttctgcttctctgacgggcttcagctgggaacagattaactaggttgctaaaggaacaaatatttcttccgtgcactgaagacaggcaggaagacaacagataacgtacctgcagtggagaggttaagctcctgtacggaagcgtaattcataaatagataaatataggaaaggacaacaaagaaaatagggatagaataacgggcagagaatttagagatgatgtcaggtgattagttttctcatctaaaagcttgaaaatcctgcatgtttgtggagtggtcaagcaggtggtgaagaggtgtgtgcataaaataagtagtactccttttatttcttttcaccaatgctctttggatctggacccgctttttctttgttaagtgtat

SEQ ID NO: 118596 - DNA, 1679 bp, Homo sapiens
tgtcgtttgctcagttgcctgtgttcctttgacccggttgatataaagggcaagatgatattgttcttcatagagaggccttctttgtaatatcaaatggatgcaattttttacatttaaaaaaagcagtttgttaatgacatttttacatttatattcactttattatgacatgttttaacttaagatcataagtaacattagataatatattaatgttttctatttcctctaggttgtgcaccatctccaggtgcttatgatgttaaaactttagaagtattgaaaggaccagtatcctttcagaaatcacaaagatttaaacagcaaaaaggtaatatagatcaccaaagaacaatggttatgtgatcttataagttttaaagttatgaataacaatatttaaagatgttatagcattttttaaaatgtgaagctagaactatatttaaattttatttgatggatttatgaaagggtcaagtacagaataatgctgtcatcattacattgttatataaccaggaaaattaagcaagatacttatattgatatgtagcttcccttttggtaattaccttgacttgtcagggaatattaggaaaatcagaaaggtgttagatgtgtaaaaaaattgtatgagtaattatttgaaaatgtacaactaaggaaagaatatattgtttcatcaaaagttgtaattagaaatttggggccgggcaaggtggctcgtgctcgtaatcctggcactctgtgaggccaaggtgggtggatcacatgagttcaggatttcgagacaagcctggccaacatggtgaaaccccatctctactaaaaatacagaaattagccaggtgtggtggggtgcgcctgtggttccagctactagggaggaaagtgggagagttgcttgaaactgggaggcagaggttgcagtgggctgagatgacaccactgcagtccaggctgggtgacagtgagactgtctcaaaaaacaaaaacaaacaaaaagagaaagacaaaaaaatttggaaattgtgttttgtgtgtagttaaaacacattgacatcaaccatgatctgtacaattcatttttccgcagaatctaaacaaaatcttaatgttgacaaagatactaccttgcctgcttcagctagaaaagttaagtcttcggaatcaaaggtgaggagcttttatatgccagctggtttatcaagtgtatcatcaaaaacatctgaaagtattgtatttgattagaatgggttaagtgtatgaatcaaggttataagtaaatctgtaaattaatgaaatgagttatcattagaactctagcaagttttacatttctgcctaggtcattatgtttaaatgtgcccttagttcacaattataatggtcttcaattctcaatcacttctatgtttaaattgttcattacctagtaaacatttcaaaattatgtgatgctttgatttattaagtaccaccatttgagttgttttgtttttgtgtatttgtttgtggggaagggtaagtgtttttgaagaaaagtgggaaaaaatgccaatatctaagagaggtttgctactgagaaactgttaaggagtggtgagagattaaattcttaatagtcttgtggcttgtgcaagagctactattactcttttcataagtttata

SEQ ID NO: 118597 - DNA, 1334 bp, Homo sapiens
ttaaatttcttgaagaaactgttctgtaattttgtaatttataaagccccttagaaaactaaattacatacaagtttgtatggagccccaaaataatagtccttccccataaaaaatttcatggagtgtgaaattaataaacatgacactgatgtcacccccacctcctgccccacttagaaacatctgaaacagatttcattcaagatgttgatgcctttcttccatttttagatggaaaagatattctttttctagccattgtgtcagaaagtctgttggatataaaaagatatagtgtgaaaattatatgtcttatttagaataaagccaatgagaaaattagaatcagagcttatgctgtttcagtttttatttctttgcatctgtatattttcctcttcgggtatcaaagtttaagtcgatttctctttgtaagattctttctgagatagcataattaaatattcaagatgtgttgctatttaacattagagggaggcagtcagtagctttattcataaagttccacctgttcttttcactgggctgattaggaaaatcctgatttattgggttgaaaatttctaaacctaaaatgtcttgagatttttagaatattttatttatcagatgagtggcctacacaatgtttaacagtgtaatgtttaaaatagaaactaactgattggatcccttcatcttttctgataactgaaaaacaaatttggctgtcatatctgtgacatctaaatttgcttataagtttttttggcttttaaacagaaggaatctcaaaagaatgataaagatttgaagatattagagaaagaggtaagcagtgctttaaacttagtgaaaagtacacatgatagaaagagagttacacagatttaagagataaggattctgttgcagtgtgaggagtcctgcagtgaggcaaacatgccatccagaacagtgcctacaggaaaacagttcttacagtatttcacagatctatccgggctatgttaatgtggtatgctggcaacgccgagattaaagatagcccacttaatgaaaaactgataactgaaaaatcattatgtcagttgattacaattatatatgtggatcaaatatttatatctatccatcgttcacagtcttcctgtatgctaacttatgttaacacaacatagctagaggatttcttagtgagcatgcaatcctagctggttagactgtgatgaagttaggctaactcgatgcattgctctgcacaataggtataggccttcctcatgggtgaaataacatagagctgtgctgtttgatatggtagctactca

SEQ ID NO: 118598 - DNA, 1184 bp, Homo sapiens
gatcacgaggtcaggagatcgagaccatcctggctaatatggtgaaaccccgtctctattaaaaatacaaaaaattagccgggtgtggtggcccgtgctggtagtcccagctattcgggaggctgaggcaggagaatcgcttgaacccaggaggcggagcttgcagtgagccgagatcgtgccactgcactccagcctgggcaacagagcacagagcaagactccatctcaaaaaaaaaaaaaaaaaagtgaatagatagcttaattgtacttggaacttatggcaactaaagttcttatgttcttaaaatgcattaagacttttaagatgtatcataggtaaatatgattattcaaatagctagtaacattagaatatctacaagcataatgtcaaaatcagagatttttccagaaactttaggggtgattattggtagcatctccttatgttggcattctatcagtgaatcatttattatcaccttgtttttgtccagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaaggtatctgagcctcatgataatatttacaattgaataaatataaacacgttttttagggccgggcacggtggctcacgcctgtgttcccagcattttgggaggccaaggcaggcggatcacctgaggtcgggagttcgagaccagcctgaccaacatggagaaaccctgtctctactaaaaatacaaaaattagctaggcctattggcgggcgcctgtaatctcagctactcgggaggctgaggcagaagaatcacttgaacccaggaggtggaggttgcagtgagctgacatggcgccattgcacttcagcctaggcaagagagtgcgactccatctcaaaaaacaaaacaaaacaaaacaacatacaccaggcgattcagattcattttgttaagcaaacatgtttcaagaaatcctttctcagggacttgctttagagtcttgcaatggactttccagcatatagaggtaagtgaccacccaaacaacctttc

SEQ ID NO: 118599 - DNA, 1050 bp, Homo sapiens
ggaaaagagggataagaacagtagactggtacagtggctcatgcctgtatttccagcattttggaaggctgagggctggagaattgcttgaggccaggagtttgagaccagcctgggcaacatatcaagaccccatctctataaacaaattgaaaaattagctaggcatggtggtggtgcacaccggtaatcccagctactcaggaagatgaggcaggaggattgattgagcccaggagtttgagattatagcgagctatgatcatgccactccactctagcctggacagcggagcgagacttgatctcttaaaaagaaaagaaaaaaaaattaaatcaatcagtaattatggtgtaggtcaaagactgttctctctaccaaagtatattaaagtcaaaaacataaccccagtgataggtagaaaaatcaatatttgtgtattttaaatatgtcttagcagaaaatatttctgaattttttacgtgtttgttgtatttagttttctgaaaatggtaaccagaagaatttgagaattctaagcttggagttgatgaaacttagaaacaaaagagaaacaaagatgagggtgagtgctgcccttggcaggtttgctgtgtctggatctggggatcagtacaactttctcatttcctaaaacaggtatctttgttgtgtagggtatgatggctaagcaagaaggcatggagatgaagctgcaggtcacccaaaggagtctcgaagagtctcaagggaaaatagcccaactggagggaaaactgtaagtgagtgaatgtgaagagaaattgttaagtggaagcaattcttgatttgagtctcttcacaaattattgtttactgagacttcaaccttctgttagtacttatctcattgcctccctccagttgccctatttctctttttaaactagaatgagccctaatcattctcaaacatgttgtgctacaaagttgtatgagtgcattacttttgtacatcttctgtattattaatgatgaggaaagatttcatgatcttatgaaagtggtca

SEQ ID NO: 118600 - DNA, 1799 bp, Homo sapiens
ccccctggcaatgtatgatagtttcagttgttccagattctcaccaacatttaatgttgtcagtctgtttgattttagcctttctactaggtaggaagtggtatctcctttgtgattttaatttgttaccatgaatgttgaccttatttttatgtgcttattgaccattttatgtgcatatcaccttttgcaaggtgtctattgaagtcttttgtccatttcttgcattggacagtttggtggaggtaaacagataagtaattgaagaccaggtagtctgggacaaaagctttatgggcacacaaaatgctatttagtatgttggatgggtggggaaaccaggaagaccacaaaaagaatattatttctaacacttgggatactgtaatgatggttcttgtcatcataggtttttttgtcagtatatattcagaaaactttctcacttaaataaaaattttagtcttctattttgatgtaaattgtgaatttgagaaattacataaaataatagttaagagttagggctctgtagtcagcctgcctgatacaggagtatctggtacataagcattatgtaagattattaaataacgaaactagaatgtattaacatatgcaatttttgttttagtgtttcaatagagaaagaaaagattgatgaaaaatctgaaacagaaaaactcttggaatacatcgaagaaattaggtaatatgagcagtagctttaaattgaaccttatttttttaatactcagtcattttcatcatttttctgttattttccctgtgcctaaatagatgtgctttttaagataatttgttttaatgcagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaaggtattacagtgttttatagttactttgtttagataagtgttacatacaacatttaggaaaaatactactatgctaaaacaaccttttaaatataattagctatactaacattttaaatataattagctatatagctatacaacagcaaaaacctgtactgcattttagaatattttactcttataatgtttgttttctgtttatttcaatacagcatattacctgtcttgattgaaatatatacagtcatataattcttgacttttccactaggtggctgtgtaacaatcagtagataacacagaacaagatttgtgggttttattatttagcacatagtatatattacatggagtaatgatacaaagttcacagttttgttttcttctttggaaataccatgctaaaagcagtgtaatggaatattatgggagtccaggtttctcagtcttaatgttcttatctaattccagtattcttgatgttttgcgttttctagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagtaatttaccaccatatttttttaaactgttcattttgtgtcatacatttccctatgtctctgaacacctttaaattgtgtatatcctttgatctaccaattctatctttagagtcttatcctgaggacataatcatg

SEQ ID NO: 118601 - DNA, 1032 bp, Homo sapiens
tccctccccaaatgtatatgtatatataagtgtaaagaaaaataccagaaggcatatatattccaaactagtagctatctctgcaatgggaaaactaaaattagggggggaagtcgtcaaagataatattaacatcatttgtaatgttagaattatttcacaatggtgatgtatttgtatattgtatagcttaaaaaataattttatgtaatatggaaatcaccacacactttttacataatatgtgaaaaataatgttaatatcaaagccagttgtaaaacagatatatatatataaaatataattttagattaagaagtttctgcatgtgcgttgcatagaaaaaagcctaagatgatatttgccacaatgttaacaaggtataggaaataatctatgaaaacaaatatgctatttctatattgttttaagtttccttgaatctgttgaatttaggtttcatccttctttatctgtacttttttttgtctcctagtacaacctcacaatgccattccaaattattttggtggttttctgtttggatataggaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggtttgtattaataggatctcatgtttatgtatgacttcagatgtatttattttgagtactttttttagtattctcttatcaatcatgtgagcgtgttaggttggaattattttataattaagtagtaattattaattattttacaattaagtagtagacacagaatgtgaacacaaaatgtacatgcaaacaagtaagacagccccctcttttaagttaaaagttaaaggttttgccccctttttttaaggccaaagagagttta

SEQ ID NO: 118602 - DNA, 1539 bp, Homo sapiens
cccgtctcggcctcccagagtgctgggattacaggcatgagccaccacgcccagcctacttggacacctttaatggttcccgtctgtccgccaggtaagcccactgtgccctgcggtgatgaccctcatgccaccagcttctgctccagcctttcttactcattaggctctagtctcacttcttattttttaaattgtgagtaattttcatgcttggtagttgatttcttttccatctctgtatgcatacttcctgcacctagtaggcacttgatttttttttctttgaatacacagcagatgccatgtaaactcattagtacttgcctcagaacactgaattcttacctgtgttaaatgcatgaatacattaaaaactttttagttttacttagaagtatataaagtgtaaactaatcagttatgattgtcatacgcaatagttagaaaactactttgacttttttttctttttaataagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggtatatagagcaaataatggccttagaaccattaagacaatttaatgttgaaagccagctagtaactgtcccttggcttgcttttggccatcttatactgcaaattaagaatttactcagttaaaaaatgacacttcttgaagagttccttgaggtttaaagaaaaaaaaaggaaaaattaatgaaagtggctataaaatgtttagtgacctcttctctctcaaaccaaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaaggtaatctatgattagaacctgagtgccttgttaactcagttacgatgtgattttttaaataactatgtttttctcaatttaattcttccatgcagaaaagctgaaaaagaaaatacaacagcagaattaactgaagaaattaacaagtggcgtctcctctatgaagaactatataataaaacaaaaccttttcaggtttgtcagttaggagtaaacttacttgtgtttattttagggactcactttgttccctattatagtgaggacagtgactcgggttttctgcaagatcattttgctctgcacttacagtgccaatttagctcactattaaaggtttatacattttattaaattatgcataattttttcccacattattgaagtataattgacaaatttaattgacataattttttcaatggaccctttgtggtttaaaaaaaaactttgtaatgtggaacttaaaagtttggctcagagggcttgcctggtatgagcttttgataattaacctattttaattt

SEQ ID NO: 118603 - DNA, 2459 bp, Homo sapiens
tttttgcagattttcttgaatagatgtttcttcatttgctatttttcccttaggtcaattttcagaggctttaactggttaatattttataacttttagtttcactagggagcaggtcagcagaactttcatgctgtcatgccagaagtccatctcagcaattacttttgagttgaacttttatcagaaaaatagctttgtagctgaggaggggcaaggagatttaaaagactgtatctcctttgtcacagctgtttcatgtcattttgtaattcagtcttaaagcctgtgtctagtagtgatttttgctgttgagtgtgataatacataaacaactttggaatttgcccgcaacattggtaacacatttcactgacatactctttaataattgtttattacctattatttctttttacctaggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggtaagacatgaataaatgtataaaagtgtcctcttcctttggatttgcttttatagcatttagcaagtcatccattttatgaactgtgaaaatttgttgacaccttctgataaaagcagttcttactgagattgttgtgtacaatgactgttttcttcctccttctacgctttcttttctgtatacctggattctgcctgttcttcaaggcaaatctcaaatcttccttgaagctttgcatgactattttgtccctgtccacacaccccaaattactccctctataatacccttagcattttaacctaaatgtctcttaggtccttaatcattttctgatttgtagttttagagaagtaaatttcttatttcttgactgtgaatgtttgtctttcacgataaattaaagttggttgaaatgataaatctaaaaattatcttacagaatatattgcttcatctgccttaaagaagatacaaggcctgtttttagtttataatgatggataaattcgttttaatctagattactaatccttcttttcaataattcttctaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaattaatttttcagcttgtattttatgaagttacattcatgcttctatgtaagatgtatttatcatctctaccctacccacaccaccttgtccccagaatcacaaaagatactgtttggaaagtggtaaatctctctctaaaatgcctgttttgcacatatcattggtatgatatttataagctaccttttttataatgtgttctcactgatggctcaacagggactatcagtcagaattgcttttcattattattttattagatcttaatacatggttgaattttaaaatacagttttttaaattaagttcagaagaaacgtagaaattagaaaaattgtctaataaaataaaatggtttaatgggctgggcccagtggctcacgcctataatcccaacactttgggaggctgaggcaggtggaattcaagaccagcctgagcaacatagtgatacctcatctctaaaaaatatataaataaata

SEQ ID NO: 118604 - DNA, 2177 bp, Homo sapiens
accaaatagttttgcaaatagacccaggcttgactggcaattaaacatgaaacttctcattgggtattttcgagactactacggggaatcagctaccagcttactgccatgtggagaactgcacgagattccgggattggaatcaaaatgctaatttaaaaggtcaagtgaagctgctcctcacgttttggcgtgcctgcgctctctgcaggcagaagcgaacaaagacccagcaagagaaggcagaggctaagacccatcccgtatctgctctcctgaaataattctggagtcatgcctgaaatgccagaggacatggagcaggtaagaactagcaattcaagaaatgaagcattctagagtaagagatgctttaaaagcattccagtgaacgcctgctaaaaccagaattgttgtgtaaagaaaatagaaacgggtgtcattcatttccttaaaacataacctcgggacatggaagaataagccaactttagttactgacccggagaaccaggttatgaagggctcagctaagtctcactagctgacaatacagaattgcactttcatttaccattttaaatgcaattatgtatataaagtttctacataaataaggattttatctgtagtgtgttcctttccagatgttctttgtctttgtatgaattgaatctgctaacataacttttagtttcaggctgctctctttaaatgtatagacttagccaccacacgaagttgtatattgtctatgttaagaatggcgtttgattcgcatagaccctaccatcattaaagaaaatgattaaaaaccatatccaaacatatgcccctagaactgtacccaacttttacggggaaagtatcaagtcagattttcaaaagcagccaagttaaattctttctgttcctcaagactaggctgctctgagaatcagaatgctaattgcatatgcttgcccttaaacctgcttcacgttgaagaatgaagaattaattttcttttctcccatagaaaggtaagattacatcacgtgttgcgactagaaactttaaaccgaattcccagttaagagaaaaagtagtaagatgatcttggctgctcccccggccctcttcccgccctcttctttgttgtcccctgattatgcttgtttagcgctggggcagtcctcaaggattccctaaataaagccaaactaatgaacagtaatagcctgtgtttaaaaaaaaaaaaaatcggaacataagaaacctcaggctgtcttcgattactgttctagagaaactttatgtttacacgaataaggaaatgagtttttgttgggggttgaggaggaaggaaagtcatggtgttctgacgtggaaaacttctttaaaaggctgcttagtctttagtttgaaaataaaccaaaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctgaggattttttgcggtttttaactggaagggaaataagtcggcatcagcacttagggctgcttaacttttaaaaggtggtagaacgcccagccttacacgctgctgcttaaattctcggtgctcaccaaggctgggctcgtgtggcccaatcctgcaatccccgaggcggtgtttcttaaagagtgggcttgattctggttaaacccattaagaagtcggaccccgggctcgtttcttgttctgtaattatgggtaaagtccaaggatctgcgttttgaagaggtacctaagtagttcatcttccttccccctacaactttttatttttaattagttaaaaatagttttacatttttgatatctcacacacaggttttttctttttttaagcatcccaggaagacaaatggctcagacgccaacccttttatttttattccttgtctttttctaaatctttcaaaacccccacctagagctctagagatgtgtccattatgctctacccacctccgcccccgcccccatgactttaaaatgctttttattccactttttatattgctcagt

SEQ ID NO: 118605 - DNA, 1059 bp, Homo sapiens
tcagagcctccggccgggagtggtctcaccgccaccctcccagccccggatccgaggggggcgccaccgagtttgtttatctcagcgcacacgggtcagtgtttttttcttccagccactgcggcaggaagcaagtaggtggaggttttactttcgagttctgtctctgctcctgaggacgaagaggtttttcagaattgtttgttttgattttggttttccccgtttattcatctttggttcgtatttctcgatcttacaagttcgtaggtttgagaaagaacaggaaaaggtgacttctcacaaataacagtgctggagatgacaacttattgaactcttaagttctcagcactatgttatgcacttgacgggcattactttaatcctccactgtgagatacttgttattgcctcattttgtagacgagaaaacgggcatagagggtgagacattggcccaggttcattccgtaaggttggagcctggaattcagatacaggtttgtgtgactgtcttgggctttgaaccactacggagtttccctgaaggaagattatggtgatgattggaagatccatctctggtgcccccctcgcccccgtcccatcctgctccattccacttaagggcctccagcattaatctgtccacagaacatatccaaccctggggataagaacactactaatgcccagaccatgtcttttggagagagtagagaatataggagatggctgtttctgttattgcaaagttttcatgcttccaaatttacttagggttttcaaatcactttggttctttgagggtaaagttaggataaatggtctattaaacctctatgttcctaggtcctccagaccgtgctgagtgcatgttacatacgtttacatttatatgtatgcatttgtatgtgtacgtgtgcatataaagcttaatctactttcacaaaaagaagttcagtataaaaatgaaaatagcttttcgtgttttccttcattaaaaatgaaacaacgaagagcttggcacagacttactgctctcaaaacctgtag

SEQ ID NO: 118606 - DNA, 1020 bp, Homo sapiens
tttttactgtttttttgtattgagatgggtctcattatgttacccaggctggtctcaagttcctgggctcagcggagctgcctgcctcgcattcccaaagtgttggaattacaggcatgagcctgatgcccgaccctaacttaactttagaattggcttgcagatatgggacatgagtcaaaatacgtagaattaagacatttagggaacaacgatggtgcctaatatatttgagagaactgttttcaaagttagtaactctttctatccgccttcaccttttaggaggaagttaacatccctaataggagggttctggttactggtgccactgggcttcttggcagagctgtacacaaagaatttcagcagaataattggcatgcagttggctgtggtttcagaagagcaagaccaaaatttgaacaggttaatctgttggattctaatgcagttcatcacatcattcatgattttcaggtatgatttaggttattttaagatatacatgaacaatattaagagttgtctggatgatacagaaactatccttgctctcaaggaaattactatgtttgaaagctctaaagttgtattatgcagtagcatttttttcatttagcatgacatggtatatgtaaaccttaaagttaaattttgacacgctgacaaagacaaatatgagacattttataaaatgcttatgtttatagagtgccttctaagtaatactttctctgcaaatggttttcaaatgttactgtaaacctcacaacactgcaaaatagttattttcattttagggctgagggagcaggctcagagaggttttcggtatcattgatactattctccctttgacatggatttattagatatttaaatcatgttaattgcataaatgatagctctttccttttgtccaaattgggggataaaacttgttttgatttagaaagacttctgttttgttcttgtttttgtgacgtaatcttggtttgttgcccaggctggagtgca

SEQ ID NO: 118607 - DNA, 1041 bp, Homo sapiens
tttcagacagggtctcactctgtagcccagggtgaagtacggtagatcgatcacagcccactgtagccttgaattccttggctcaagtgatccttctgcctcggcctccacaacagttagaactacaggctcatgccaccacgactggctgatttttaaatttttttgtagagattgagtaccaaccactatgttgcctagtcttatcttgaactcctggcctcaagcattgtctcacctcagcctcccaaagtgttgggattacatgcatgaaccgtcacaccagagtagaaatacagttgttgacagtttttttcctggtttgtgtctgcatattatgaaatactcttttcagtgcctataaatattttaagtttgaaccttgcggggaaaagaagcagcatgacaaaactacattagaaattacaatgatttattcttagttgaaagaatgttgacttactgcacatttttctctgaattaactttaagaaggctgtaatacctctttcattttattttgagttaaaaatacgtcaatgcttaacttctagccccatgttatagtacattgtgcagcagagagaagaccagatgttgtagaaaatcagccagatgctgcctctcaacttaatgtggatgcttctgggaatttagcaaaggaagcaggtaatgatgactttataaaattttcataaaatattaagtgattgctgagtttttagaaattaaggttttgtagatggttatttgtttttatatatcatgaaaaaccattctaaattccatgaaagagtaatgtcatgtaaacatttaatagatttgtcttctttttttgtagctgctgttggagcatttctcatctacattagctcagattatgtatttgatggaacaaatccaccttacagagaggaagacataccagctcccctaaatttgtatggcaaaacaaaattagatggagaaaaggctgtcctggagaacaatctaggtaagacctaatctatttagcccctgattgtttttgaagactttaaa

SEQ ID NO: 118608 - DNA, 1059 bp, Homo sapiens
gttatatgtatgttgtatgtattaacattctattatggtgtttcttttttcctgtatgtgagtttgtgtataacacacatctccatatataaaaagtatacactccttagaaaaaatgtaaaattactaagaacaaaagttctcataaatgctgcctcagggagataaacaccaaatatggttaagtgtggaagcatttttatatattttcaaaaaatgtatgcatgttgtttcacaacctgttttttttccctcaacatctttgcattttagtacacatggaacctactctgggatatcttactcctatcagtggctgcgtagtacttaatttaatggtcccctgcactaaaactactgccttagactgtactatggccttgagaagcagccctagtgtagaataccttactaatggacatttagttttttaaaaagttttcttgtattataaattattctgttgaaatcatccttgaatacatttgtcttagtttatttcgtgctgctataacagaataccaacaactcagtaatttataaagaacagaaatttatttcacacagttctagaggctgagaagtccaagatcaaggtgagggtctttctggtcctctggaggggaggaatgctgtgttctcacggcagaagagcagaaagggatgtgcttcttccttcaagtccttttataatggcattaatccattcataagagcagagtgctgatgaccacctaaacacctcccaaaatgccccacctcccagcactgttgcttcgtggattaagtttcaacatgaatttttggagaggacaaaaacattcaaaccatagcagtatctaagttctcttgtcatgtaatttaaaagaaaatgtttgatttgcagttaaagtgttaactattgtataccatcagcagggaccattataaaatctaaatattaatgagtggttgtaaaactaatgtgaacactcatatacccttcacatagattcacaaattgttgatgttttgtcacatttgttttatatgtttgcttttgccagacccattgataat

SEQ ID NO: 118609 - DNA, 1398 bp, Homo sapiens
tgcctgtaatcccaacactttgggaggctgacgcaggaggatcccttgagcccaggaatttgagactagcctgggcaatggagggagatctcatctctgtttaaaaatatatacatatttaaaaaaaggtcagggggaacaaagccctcaaaatatagcctttcacttacttttgatttttttgtgtttatctttctttaaagattactgacagccctgtcctaggagcacaacgtccgagaaatgctcagcttgactgctccaaattggagaccttgggcattggccaacgaacaccatttcgaattggaatcaaagaatcactttggcctttcctcattgacaagagatggagacaaacggtctttcattagtttatttgtgttgggttcttttttttttttaaatgaaaagtatagtatgtggcactttttaaagaacaaaggaaatagttttgtatgagtactttaattgtgactcttaggatctttcaggtaaatgatgctcttgcactagtgaaattgtctaaagaaactaaagggcagtcatgccctgtttgcagtaatttttctttttatcattttgtttgtcctggctaaacttggagtttgagtatagtaaattatgatccttaaatatttgagagtcaggatgaagcagatctgctgtagacttttcagatgaaattgttcattctcgtaacctccatattttcaggatttttgaagctgttgaccttttcatgttgattattttaaattgtgtgaaatagtataaaaatcattggtgttcattatttgctttgcctgagctcagatcaaaatgtttgaagaaaggaactttatttttgcaagttacgtacagtttttatgcttgagatatttcaacatgttatgtatattggaacttctacagcttgatgcctcctgcttttatagcagtttatggggagcacttgaaagagcgtgtgtacatgtattttttttctaggcaaacattgaatgcaaacgtgtatttttttaatataaatatataactgtccttttcatcccatgttgccgctaagtgatatttcatatgtgtggttatactcataataatgggccttgtaagtcttttcaccattcatgaataataataaatatgtactgctggcatgtaatgcttagttttcttgtatttacttctttttttaaatgtaaggaccaaacttctaaactaattgttcttttgttgctttaatttttaaaaattacattcttctgatgtaacatgtgatacatacaaaagaatatagtttaatatgtattgaaataaaacacaataaaattaacacttgatccagaatgttaacttaccaccccatcctagaatgttacagttactgtatctatttgt

SEQ ID NO: 118610 - DNA, 1025 bp, Homo sapiens
ccgccttactaggcatttctcttgggattcagaaacttgactaggtctttttagacattcttataatatccccattaggtagatagaggcaaggtggatgaggagaagaggcaaactcaaacattgccaaataataatgagaaaggaaaggcaacaaaggttaggagttttgaatcacgtaggccatgctgtagcacagtctgggaatgaagagaaagggccctacagctagaaccaaggggagtgagagagtcagattttcccctgcagctatgtctgtttctcatactatatctggcattaagaagaggtattggcatttctagggtatttatgtattatttattacattattacttgaaaaaaaatcctcttaattctatgtctgaaatctaacaccataaacttctgggctcttattttaaagccacaaaagaaactcaggccatcaaataaggagaagtaaagagagatcgtaacatttgaatggagacagatacaatttggcacaatcgatcaaaattcaaaatgcacattatacataccctttgatctagtaatttcacttccaggaatttaacttttgaatataattatataagtatgcaaagaaagatatatacacaagatgtttcattacagatttgtttttaatagcaaaattctgaaagcgatctaaatgtccatcaagaagagactggttaaataaattagagcattatggaatattacacggactttaaacaagaatgaggtaagtctacataaaattacctgaaaatgcttccacaatatctgattaagtgataaaaaggaagttgccaaatgatatgtatatgattccatttatattaaacttaaaatatacatgctcagacatccacaagcatttttgaaagcctaaaataatcaaccttcaaatgaaatttccttgaaaatggaaattgaaaagcagggaatattcctttccattttctgtctatgtgttgaatattttaccaagagaatgtgtacattctacaata

SEQ ID NO: 118611 - DNA, 1244 bp, Homo sapiens
agggtggccggcggctgggactgtcccacgagggggcgcgtctcgggccctaggacccgccctcgaggcgctgcgcgcggggaggggacccgggaacccaggcgcccggcgctccgcctcccgtttccggggcagcgcggttacctgcaccgcccgagccgcacctggcggaggcagaagtcacaaacccggcgagctcagagcggtggagcggagaggagggacggcacccggctgcagggaggagggaggcggcagcggcagcggcggcgtggagggcgcagcgcgccgcgcggcggaggagggcagacggcggcggcggcggcgctcggctcgctctgcccggccggctgggcgcgcacccgggctcgcaccgcgccgctgcggacgcacatggcagcgtgagaggccggcggcgggaggagcgggcggcgccgggtcggggctgcagggccgcatggacagcggcgccaccccggccggcccctactagggccccccatctgcgggcgccaccccccggatcatggtgcctcggcggccgcccgggctaagagcggccggctggagccgctgagcccccgctgcggccgggagctgcatgggggagcgccggcagcgcttgggaagatgccccggccggagctgcccctgccggagggctgggaggaggcgcgcgacttcgacggcaaggtctactacatagaccacacgaaccgcaccaccagctggatcgacccgcgggacaggtaggaccctggaaccctcctccgtgcccccacacccccgcctgggcccccacctgcccctggagccgccggccgggactgggagggggcaggggagctctgcgtgcctcttgagctctcttcagttcgccaccccctgctccccccaaccttctggagcgctgctcccgcctcagtgggccaccgagaggaggcgcctgccggggagctggcccaggctgccccaccgccatccccagttggaggacttaggccccagccggcacctgcccggagttttgaccttaagctctagccccgcccgccccctttaggaagagaggtcgggcgggggcgggggttgggggagcgacctagccgggtgaagccgggtcttcccggggaggcttccacccagcgtggggggtgggcggatggggatggggaagtgtccggttagagggggtggtcaagaccccaggattccgtgggagaccactggagagagggcactcg

SEQ ID NO: 118612 - DNA, 1271 bp, Homo sapiens
ctgaatgtctcatgaatgtaatctggaaggtaaatatttagtgctagagagcatctcttaggcaagctgcttcaacctctgagcctcagtttccctgtttgtcagatgggggagcccaccatttccctgaatttaaaaagtttgcttggaagggaatattgggatgcttaaaacttggaagggacgtacatcagcgcccaactcccatttgaaacataagagaaaatttgaagcccagaggtgtgatttgctcaagtattttgatttttctgccattctgcgtaccagttcttcaccagctctgaagttctaacctgcaaacttgtcaccctgacacactgcttccccacccttactcgggtcagttgccagctctgctactgtgttggtgaacttggcagcaccttttctcttgtccttttctcagaacagacacaagttcaaacatatgtgacctgccccaatttaggtccctgtagtttacggaggcctgtgtgctgttagcaggtggacgtcctgttggagggaaaggaccgcccctgccaacactgataatcatgcatctggggacttctaatacagcaataggaggcccctctcaacagtaattctttacccttggaaaagggtaagtaagtagcttctatgaagaactgattggctggagcacaatctcccaaattttagtgttacatggaccacctccatgatttttttttgctatatccacctgtgctattgcttacttactccttgactttagatcaactcactttaaaaatatgtgtaccattttcacaaatgggaaactagttatatctattgtcatacaggggaaacaaaaaagataggcaaacaaaaaaaacaaaaaaccagggttagtatattttagctaggtactgtggccagcctaaggccacagcacctcacctgcccagcctttgtttttaagcagattggcaagccatggagaggcggcagaaacatagtggcacttaggtgagcagctcaccttcttcatcttgtgtcattggtttttttgtttgcttttggtttttttgtttatttgtttttgttttttggagacagagtctcgctctgtcgcccaggctggagtccagtggtgcgatcttggctcactgcaagtctgcctcctgggttcaagcgattctcctgcctcaacctcccgagtagctgggactacaggtgcacgccaccacatccagccaattttttgtattttagtagagatggggtttcactgtgttgcc

SEQ ID NO: 118613 - DNA, 2010 bp, Homo sapiens
gctgcacggttccctcagtggcagaagccttgatcaggcttcagtggcacttgcagggaatgccgacctaatgtcaggtggctgtccatgacgtgtatcaggagctctctccagccacatgtggtgctaggtgatgaggctctgcagcctccagttcagcaaggggccctggataagaggaatccacttcacttggagaagtggcctggtgacatccctatcaccagctcctcgctatttgctaagggaagcacctccacttggacagggctgagggctagatctgggcaaaaaactcccgtcttgcctctcccagcatggagatggccagctggctgcacacctttaggtagaacagcaaaggttcagttgctgctgcctcgaatccgtttcagagtgagataaagaaagagaaaactaagaaactggatacagtgacattttgttattagaccttccccagcaggccatttagcctttagttcctgagcagaaaaataataatggggtggcgggaggagggggcaggcgttcactgttgtgtgcggagaatattctctaaagatgcaggatggggaagagggggtggagcagagagtggggaggagggaaagaaaaaggacaagtgtggtgggtcacatgcccattctccccaccccccaccccttgccagttgcctgctcaatgcttctacccatgacatctcactgttgggaagaaatgagatctttcagtttcaaatgtctgccaaagaaaagggacggaggcttaagttctcactcaatggtcagccagaaaaaaaaaaaaaaatgaagctgcatcaagattagggacacctttgttggctttttttttcttctcttgctccattcatcactctctggcagcgaggacaccaggccaactgcagctgctgactttccccagtcggctgcctgctgttgcccaggcctgttttggtagcaacccccacactggcttcctccccgcccagtggtggttacttgttggattcgtccctggggtagcccctgggatccactgacgggtaacagacttggaaggataaaatgtcaagatgcaggcatcaggtggctgctaggatgagatgaccctgggacagccttccagtcctacatctgtcgtggcttttcttggagagtcgggctgtgagcatttcactgtattccaggaatttcttctaagtgcattgtttgtctttgtatcactaacagtgagaacaataactggcacctggtgataatggtgataaataatcatgattgtctttaaagatccttatccattgtctgtcacgtgccaaacactattgctcatcatatttttatggcattttgcaaatgaggaaactgaggccgagagacaagtcaagtgacaagctcatttttccactatggaaaaaaatgtgtatgtgtttgttgttccacccaaacatgggattgcataccacacgattcacgattccctgtagtagataagctctccataaagatcattagaggacactgagtcaagtctggctttgtcactttaaaatagtaagtgggactgggtgcagtggctgacacctgtaattccagcactttgggaggccaaggtgggtggatcacctgaggtcagaagttcaagaccaccctggtcaacatggtgaaacaccatctctactaaatatacaaaaaaattagccaggcgtggtagcaggcgcctgtaatcccagctactcgggaggctgaggcaggagagtcgcttgaacctgggagacggaggttgcagtgagtcgagattgtgctattgcactccagcctgggcaacaagagcaaaacttcgtctcaaaaaaaaaaaaaaaaagtaagtgaccttgaaccagttccttctcagctataaaacaaggataagaatagaacctacctacccctgagagtcatggtgaggatatgacatccaacatagaaagtcttagcgcctatcatgccttcatatgggagccct

SEQ ID NO: 118614 - DNA, 1005 bp, Homo sapiens
tttttgagacagagtcttgctctgtggcccaggctggagtgcagtggcacaatctcagctgactgcaacctctgcctcctgggttcaagtacttttcttgcctcaacctcctgagtagctgggattataggcatgcaccaccacacccagctaatttttgtatttttagtagagatggggtttcgccatgttggccaggctggtctggaactcctgacctcaggtgatccacccatcttggcctcccaaagtgctgggattataggcgtaagccaccacgcccagccagtctaagctactttagagttgtaagcctgggggctaggccttcctttcatttgctgaacctggtttggattttatgcacataatctacatcttcgagactccaagaaaatgggttgcagacactaccaccatatagatcgcagcctgtggacaggaactaataattgctaatatttattacaactctaggttgtgccaagctctgggctgtgtgctttgaatgcatcgcccagtttaattctcatagcaaccctatgaggtaagaaccatctccattctgcagatgaggaaattgaagcttagaaagttgaaaacttgcccaaggttgcgtagctaataagtggcagaactgacatgcaaaaccagtctgtctgcccccacagatgcatgttctttaccatcacgtaggtcaggccaggatgtcaaggagagcaaccccgaactagtcctggtgatttagactagagcgtctttcactgctgtgattccttcattggcactttcttccagttgtacagtgtctgtctttgcttggtctttgcttgttctacccttagtttagcagatatccctctctccatgaacaaggtgagtgagctctttttctgagtacatttggtttttcaaaatccctccaaggaatcatttccttgaccaaatgccctcatctgtggtggcgatcaacatctttgattttaccctttttttttttttttt

SEQ ID NO: 118615 - DNA, 1035 bp, Homo sapiens
ttcttcctgctacagaaaaacagatgaaagaacagttttccagtcccagggctgaccccaaacccaggacagctagaatgctcaggcctcccccctcttttcaggcaggagaagctgaagaatagaactattggaccatgaaactcccaagagtccttccccctcagcgtttctcagaatttgcgaccacgattttctctgtgaggctcgcaattgctatttgccaaactggtaactgttgacccaacagaaatcaaacaaagataccagcagccccagacaggctgtcttcatcgcatcagtgaagggagagcaggtgcctgggatcgaaaggacattgtccatcacctggctctgaaaaacaaaatgcatttccttattcttaacaagctgagcaccagaaacctgctttaccagtccagggtgcctcctggaagctggctcgcttatctgcatgtatgtgagggctgggggtgtttttgtggggctggctccgggcagggtggctttggaaaggagaggcctgacctagcgagactctagggtcagcccagactgctgtgacctcaggggactcagcccaggaggtccaggtgagggcagcctgccctctacgtctgcagtaggtgaagaaccccttggttacttgaagagaaagaaaggactggctgggttgtaggcagcagggccgagcagctgagggctaagtgcacagcaggccctagcaaatgcttctggaattgaattggtccaaggggagactccagctttagttcaacatgggctgtatccgaatccttctgaaatttgctgggattccatgagggagtcaggtattacaaggttttggcaattactgagtttcttttgtgcttttttctttatgagaatgttgtttctgaacccattccctttctcttcccttctcaccaaattacacttgatttgcctccaggaagaaaatagtacattgttatcatttggtcaagatttcatattcaaaaaagagtaaagtgacaatatagttcaaaaatc

SEQ ID NO: 118616 - DNA, 1025 bp, Homo sapiens
tcttaggatatacagctattgagaaatgtgaacacagaggccttttcagagagaaagaagtcctgctcctcagtattcccaggatcctagcttactggagagattaaaaggctggattatgtgggaaggagaggcaagtggactgggacagtttagatctaattgcctaatgactcctagaatatgtccttccagatgtcctcattttcattcagagtcactgcctgcctttgtgagaggtcatacagtgttgaatgatgcgttatcagtgtaatgcaatagcccagtgacgtcatgaaaatcctggctttctgagaacacgttcacagataggaatgcagtgctggagagacccgagggtcttggtatactgcacaattcagcttctattgtgtaactcctgggtttattggccctttgttgctgctctctttgataaagtatgattttttttttttaactttctgattagaaatcagtagtttaagcctgctaatcacctctttggcttggcctgcagatcatggaaagtccacaacacttaatctgtttgcaaatgttctcttggttccagaagttcagaaatgttaccagctcccaattttttataagattgtataatttttaccttaattacaataataaaggttctgagatctattacacagataccttttcttagtttactttttaaaaatttatttttaattgtggcaaaatatatgtaatataaaatttaccattttaaccatttccgatgtacagctctgtggtgttaactacattcatattgtgcaaccatcaccaccatccatctttagaacgctcttcatcttgcaaaactgaaactctgaaaacttctactttctgtctctatgaatttgacttctctgactgcctcatataagtgaaatcttagagtatttgtcattttttgtgactggctattttttttttttttttgagatggagtttcgctcttgttgcccaggctggagttcaatggcgtggtctcagctcactgc

SEQ ID NO: 118617 - DNA, 1041 bp, Homo sapiens
ttcaccatgttggccaggttggtttcaaactcctgacctcaggtgatctgcctggcttggcctccaaaagtgctgggattataggcgttaaccactgaacctggcccatatgctttttaaaaagccaactcctcatgccacttcaaagctagaaaggcagtagagtgtaacattcaaggaactgatcttagaagccaaactcccaggttttaatcctgtctgctctccttactaacttggtgactttgagtcagttacaagacctctctgtgcttcagtttcccgtctgtgaaatgggataagtgacctaatctcatcaggttaccaggataactcagtgaattaatagagataagtcccataacatgtgtaagactctgtgtgtttggtaggtgctgggcatcagtgctgtcagtgaacagagcagaatctgctgccttcatcctcccgggatggctttcttctctgctgaggctttttcaagtagagcaaaggccttgggaggctgaaatgagatggtggctggaactggtgggttttcacaccccaaaggtgggtgtgtcaaggggcagaagaacaggggcagtttctgtccgatgtccctcctggaacttggcatgtctggtttcaagaatgagtgagtgcagaactggcaaccagaagacaggaacaaggcctgggaatggagcggaaaggtagctgctatatatagttccttcagccagtaacgattagagccaatagccatctggatgatgaatggctcctaattgccttaaattacggcagttagctaagggtttctgttgctacatgggttaccgtaggccgctgcaccctgcataactgtcctcaggcctgcgtcccctgagtctcagcacttgggcctccatacagtgccgtatttggtaggacatccccctcatcccagagatacctgggcttttgtgccaccgggattaattccatgagcatcagaaggaccctaagttatagcttccccttttcttcccagagcggatttccaacttggtctgggaa

SEQ ID NO: 118618 - DNA, 1062 bp, Homo sapiens
ttaatacctcgtgttatttctgcataatgtcagctcaggaggtttttcttttctcttttaagcctcttctgttctaggaagcctagaacttttctagagcagcagttcttgaagtgtgatccctggaaatatttgagatcctctcaggagatctgcgaggtcaaagcttcataataatactaagaaattacttgcctttttaactttcaacctcttacaagaatacagtggagttttctgtaggcaacatgacatgtgattttgtaacagattgatgcaaatgcagctcttaggagtcactgtctgctattaaaccatacattacattgaggagacttgcaaaaatgtaaaatataccactcttctcaccaattttgaagggagattggaaaatacaaaaaaaaaaaaaagtttaagaactgctatcctagagaagggttggaaacccttctgggactaggcaggctttgtggaccataccatctctgtcttaactactctgtggaaggaaagcagccatagataatatatcgacaaacaggtgtggctgtgtctcagtagaaaccttatttgcagaaacaggcaatggatagatttgacctgtgggtcatggttctctatccttgctctagactaaaagctttaagagggcaggagccacatttatcttgtaaactgctttatcctcagcacctagcacaaggcctgctacttagtaaatacttgttaattttaatagaaatagtgtttagctgctggtagtagagatcaataataacagtggcttcaagatagatgttatctctttgttacataagagaaaaagaatcaagagacaggtcggtctggaccagggtggtttggtgccacattgtcatcagggacccagattctgtatgcttttctaccccaccattttttgcatgtggtttccatccttaaaatcacttcatagcctaacaatgcttcaaaacaattctcaagaagattaagctgatcggccaataaattaggcatcaaaacaaaactcaacattcttgaaagaaagaaaacaaagttcag

SEQ ID NO: 118619 - DNA, 1063 bp, Homo sapiens
tggatgaagagttggccacacctctcccctaaagctgcagaatcttctgactataaaaagagctggtgcattcagaatcctctacaaccagtccttcccctgaccttcccagaagcttcgaaccctcagtgctgagctgccaagacgagctgggtgactaacatagccattctccagtttggggatgtcagaatgtccaccccttccccacttctcgagggggtcatgcttcagaactgcagccctgccacttcctcacttcagccttgtatgtaagagtagcaagcccagcaaacagcccaaatctctctccctgggggctgtgtggatacattttggggcacccatgcaatggagtaccttgtggacactgacaagtctaaggtagagctacaggtgctcatagggaaaggagtccaagatacatgatggagcattcagcaagattcaaaacagtagtttatatgtttaaagaatggagttaaaagtatacactcccatcaactagagttttacagatgggcttcaaggaattatctgttccatagaaatgtttggcccacatggttttgaaatagctgcttctccaggaccaccctttgaaagcttgtgttcactgcagtccacccttcccacttcactgggttacctgcctgggtcatgctggaatttgagtttgcaaccccaagacaactgagagtgagttaagggaaattgtgtatgtcctacagtgtgattgatcagttttaagatgaacttgtttgttttgcacgttaatatcttcgaatgtgaggtactcttatcaatgctgttggccattgctatcgttgcttgcaccatgcacaaataatgtcgtttctgttaaggtaacgtgatagctgtggcccctctgtgttttcattgaaaaccgtggaaaaaccatttgcaaacaggtctttgttcttattgaaaaactttctttgacatcttctggtgaagtcaagaaagtgctagaatcaaaattcaaagtaattgtcagcggcttggaagagaatcacggaattctctttcaagaaatgctgct

SEQ ID NO: 118620 - DNA, 1092 bp, Homo sapiens
agaagtttgagaccagcctggccaacatgagggaaccccatctctactaaacatacaaaaattagccgggcgtggtggtacgtgcctataatcccagttacttaggaggctaaggcaggagaatcacttgaacccaggaggtggaggttgcagagagctgagatcatgccactgtactccagcccaggtgacagagtgagattctgtctcaaaaaaaaaaaaaagataaaaaataaatgccttaacattcagtagcacaaaagaatgacactgtgaatgagaaacacacaggtgctgatgactcagagctgagaaggggctcaatcttataccatagttcattcatttcatttaacttccttgtcatacatggaaaagagagtcatataataaaggccatatctaaaaaaagtctgagctttttcagtacatataaatattctaaggtaaggaaagctttgggtcataacttattggtagtgttttccttttctggttgcatctaataattctgtttataagtgatactttcttagtaatgaagtagaatatgtgtatgtatttgatcagcatgtatatgtgtttttgtgtgcacatgcatgtgtgctgggttagtgtacctgctgatatgtctgtgaaaacatttctggaagggcacactggaaatattaacttccctgtaacttaagggtttgcatagtaggtgaggagggaaaagtttcttgttacttgtatttgtgggttacttctgtatgtttttggttttttctttttctttttcttttttttttgtgacagggtctcactctgccgcccaggctggagtgcagtggcacaatctcagctcactgtaacctctgcttcccagactcaagccatcctcctgtctcagtcccccaagtggctgggactgaaggcatgagccaccacaccaggataatttttgtattttttgtagagacagggtttcaccctgttggccatggtggtctcaaactcctgggctcaagcaatctaccctcctcagcctcccaaagtactgggattacaggcatgagccactgtgcctggccatttttcacttttattaaa

SEQ ID NO: 118621 - DNA, 1046 bp, Homo sapiens
tatctagtggctcccaagcctctgttctgagcactgtgtcacctccaagtaggcctagcagccagcacttgactatttccagtcttcttagcatgttccattcatttgctaatttaattgtttataaaacttgatgaggaagatatgattactttcatttctgaaattactaaactgaggcttagagaaattaattagcagaaccaggatacagacacagctccctctacccagaaagcccttgctttcctccccctaaggggagaggggagtctgtgtcacttagagcaaatcgcttgtcctctctggtcctcgtttcctcatctataaaagcaggacattggacgttgtcagaggttttcaaatgttgttttagcaatggaaccatttcttgaaatggaatcttctcattgaaccctggtatgcaaacccctcccttaaccgcccacttactgctgccctcagcccacctggatatgtgggccccacaaaacccaatttgagaaactcagctgtaggtgatttccaaaggcctttccagtttgatcagccatctttgcttctgtaattttgggtccagcagaagagccaaggcacgttctcctttttaaaaacaatacccggccagccacggtggctcacgcctgtaatcccagcaccttgggaggccgaggcgggtggatcacatgaggtaaggagttcaagaccaccctggtcaatgtggtgaaaccccgtctctactaaaaatacaaaaaattagctgggcatggtggcaggcatctgtaatcccagctactagggaggctgaggcaggagaatcgcttaaacccaggaggcggaggttgcagtgagctgagatcatgccattgcactccagcctgggcaacagagccagactctgtctcaaaaaaaaaaaaaaaaaaaaaaaacaataccttgtgatctccatcctcctcaggaccccggccaggaggatctgagcctgtgccccagaactccttgttgtatgtttaacactgactccaccgtagggaagaaagacgaaa

SEQ ID NO: 118622 - DNA, 2959 bp, Homo sapiens
ggagtttcctcacgttggccaggctggtcttgaactcctgacctcaggttatccacctatctcagcctcccaaagtgctgcgattacaattcaaccatttaaagcttacaattaagtggctcttagtatactcagagttgtgcaaccatcaccacaatcacttttataatattttcatcacctccccacaaaaaactctgcaccacttagcagtcatcccccaatcttcacttccccccagccctagacaaccactaatatactttctgcctctataattttgcctatcctggacatttcatataaacagagtcatacaatatgtgaccttttgtgtctggcttctttcagtgagcatgatgttttcagctttcatccatgttgaggcatgtagcagtacttcattgcttttcattgccaaataatattccattgtatggatatgccacattttgtttatccattcatcagtttgtggatatttgggttattctcactttttggctattatgaatgaatgctgctatgaacattcacgtacaaacttttgcatgtacatacatttttctttcttttggatatctggtagggactatttttctccttgttttacaaataaggacattgaggcacagaaagtttaagttatttgcctgggtcacacagcaaataagtaacagagtcataattagaactcaggtagtctgcctccaaagtctgtgctgttcatcagtacctctcctgaacgcttccttatagcagctactgtgccaggagccagagagactggggagagcaaagcagacatgtccctgtccttgtgaaacttacagggagaccatggcgcaataatcgaagacacgggaaataactaccatgacagctgcgttaaggattacagtcgagagttgcaaggttctggcaggtagaccaatgggctatgggacttgtcatcatcagagtggccagggaaggaaagcttccctggagaggaggtgcttgctctaagatctgtaggacatgtaagtgctaaccaggcagagatggaggaaagcagcagctttaaaggatgcaagactcgagggtgcggccagtatagtatgcaggcttctgaagtcaagcatttactcatctattactcagcaccccataggcacaaggctccatggataatgggtcctagggacactgctaactgagaaaaatctctccagccccaggcaggaacacatcttgctgtcagagatcactgatgtcccagtctgagagacccaaattcccatccctgcctctcattttcaacatcaaaaggctgctatgctttagatctaaaacccaggatggcatttttcatctcctctcctctaggtagctggcctttcaaatgggggagaatatcattcctcttcaaagcggtgcaggtgtcatttgctgatttaaaaaaaaaaaaaagattttggaaaaagtaaggcctgggtcaccagatacacacctgccaggtgttcagatgctggtccttccctggccccttaagtgagccatgaaaaggacctggtgattcacccacagataacggaagaaagttctgttacctcttgatagcagcttttgtgtccaccccatttccccaggtgggccgagagcattggtagctaattgtaatcactccacacaattagagctgtgctgccccttcccctagccagtggacttcggtacccagagtgaagcctgcagcctgtgtcagacaccagcatgtgtaatgggaggaaacagcttccatgtccagagcgctggttccaagggcatcttcaggcactgaaattggcactgaataggcatggggaagtttcagtggaagtgaatggggagcactggggggacttactgaaagactttcagatacagggagtatttgacacagctcacctccaactggcctggttttattctgaattgtttggagcagaggaagggagagggaaaacataaagatcagggtaataggttctaggagctgacggagctgatggagctgaacagggtagggaccatggaaggtagagctattgcgcaaaaattaggcagcctctaggcaggcaggcacttggctggatccaagtggcagtgttaggtgctgtgggtgaatgcacacccacaagtatatgcacattccctgcctcctggaagctcacagttcagccagtgatacatgtatagaagtttgaagcagtaacattagatatgaggttgaattcatgctgaccggatttctgtggacttcgtggaggccctgaaggctttgtaggatctagaaaggcagaaacagatgtggtgggggataggttgaagagtcgtggatgactcactaagacattgaggtgggaaggtatgcagggactataccacactgtgtggaggagggggttcatggaaagggtaagaactcccaaagggtagatgaagagccatgaagacccagctaaggaaacccatgaatgactgggatccactggaaagtcttgagcaaagaaccggaggatgcaagtgctgcagagaacagaccccatactgtggacggattgagagcacagtgggggcccctcaagctgttccacactctgggcagtagggtttatccaagtgcccaccaccaagtatctgggcactaggcagggagcaaggggtgtttccagttccagtgttaaaaaattccatccaatttgtaggttccaaggaaggattgggctcccagaagcttggagttcttgttttatgaccaccatccagccctaagagcctggggggtttgtatgcattttcattgcgcagatggacctcccaattttctcaactttacttccctttcacatttgcacagaccatataatcatggttttaaaggtcataaagttcactgtgctaggagatacagaaatactttcttgatgacggggcc

SEQ ID NO: 118623 - DNA, 2228 bp, Homo sapiens
agtgagctgagatcatgccactgcagcctgggcgacacagtgagactatgtctcaaaaaaaaaaaaaaaaaagttgaacttttgcttctgggatgtttatgttttttcctagtcttcaggggttcagggctctcagatgtctcccccaccatacctccactcagtcttccactgatgacatttcttaataattcacgtgcttccccctcggctcagttacacattggagaacactgctgcatctgaaccactgtagctgacaagctatcatgcagctcacccaaacagcagcttgcaaggcctatccattctgaacatttggaatggaactcttctgatccttattttccacctagaacagtcataatggggcaatgggaatgtattgattgtcactgttttgcttgtataccttggactgtttctgcaaaaggagatatgtttgagtgttttaaggcagccttgcagatagcttctaaaaagaattcactggcctgaaaaaatgattcctagcctgcagaactttcatttgtcttccctgtgcttgagagagttgggtagcccacaggaaagaacaagtggtgaaaacctggcttctaatcctaaagcttccaacagcgagttatggggtcttgggcacattctttacatttcaggctcggttttctcatctgtagaatgtgagtgttacttttctcctccagaattgtcctgtgggtcaagatgagatagcagatgtcataagagctttgtaagctacaaagtagatgtatatgtgtgggataatagtacacagtttcctgaactaactcatggagttcttgaagacatcagatgaaacagtagatgggaaaattctgtgaagggaagaaactctgagcatctctgaagcaggtgctcttgctcaagccttagcattgcgtctgtcacagcaggaagcaggggctgcttgacaaagcagtgcagggggttcatattccaaggggaggttttatttagaagagaaattacttaaaatagaagtcaaacatttatagtaaatattggggggaaaagatttgatcaggccttcattttgagaaatgaaactaaaaattttaaagtatatttatactgtatttaacaacatactgcaaccatgccccagttcttagtttgaacaaagtgttgatttattttttgtgtaattatttggagacaatgagaatagcagaaaaggacatttttctcttctcgtttgactttcccaccaggctcataaggaaggtcatttttacaaaatattgaaggttttatctgttttcctgtggccttgtttaaccccttggtatcactgaaatccttctcttttattattttatttttagaggttcactctgttgcccaggctggagggcagtggtgcaatcttggctcactgcagtctccacctcctgggttcaagctgttctcctgcctcaacctcccaagtagctgggattacaggcatgcaccaccatgcctggctaatttttgtatttttaatagagacagggttttgccatattggccaggctggtttcgaactctcgacctcaagtgatcctcacctcccaaagtgctgggattacaggggtgagctaccatgccaggcctgaaatccttcccttttaaagggcctgttgtctcttcttctttatcttaatggattttctccttttcagttgttacctgagtaactcagccattccttgggtgtgattgagtagttattcaacatgacattcacaaacttcatgaaatcctgcctcttttagaatattagtgatttcccttgcagttgacttggattgtacttgcattgctttgtcagatgctaagacatccagcagacccataaagatgttgacagtaaatactgatggcatggactagacactaatgttaagtggggagcaatatttgtataggcattgattttattataagtactcaattcatgggttaattttttaactcagctcatagtttttatattttgatgactcttatttctctaagtgatcatctaagtgcaggaatcaagatacatatccagtcattgactttcccctgattaagagagcaagctgtggagtcagagtggctgggttagaatcccagcttctacttgtacaatctgtgtgacccttgataagataattaaattattggagtctcagtcttccccagtgcgagcctgcggggac

SEQ ID NO: 118624 - DNA, 1034 bp, Homo sapiens
agcacctgttgtatgcaagcactgtgcaaacacctggcatacctgagctcctttattcccgagatgggtgttactggcagccccatttgacaggttgggggatgtgatgtgcaccgtttcctgaaggtggccaagagaagtgatgtgcaccggccacacagctggcaagtggcagagctggttcctgagctcaggggacgtgactgtgatgtgtgtgcacgggtgtgtgcacaggctcaggtagggtgaagctcagggagacccaagccctcaccctcaccctctctactgttttcctgccaaggaggggcacatcctcaggatgtttgcaggctttattctgcctgggcagtgacccaggctcctttaatccacagccggatgggaagagctgctggcagagggaagggccacacatcattgtccctctccctgaagcatacctctcaagaagttccggggtggggtggaagcttggctgtgagcacaggcctccctttatcccaccttgacctcaggtgggccagaggagagccacacacatttgccagctgggggtgcggccatcacaaacaaggacttctccaaggaggaaatacaaaggtgccatccggaaaagatcaaggagtagttgtccaggcagggtctgctggagaaatacaaagaaagaaattatcagcctaggaaagggccctagcagagccatcctgaaggtagcccagaaggaatttgattggggtggggccaggggtatccagcccccacactgcagcctgggatctttgcttgagggtgtgagaagaaaggggtttcccttctgatggaaaagttcctgagtggtctgaaaattccaaagctaacacatgtcagctgctttcaatatgctagacataatgcctactgctgtacacacgtcatcctataaacctccccacagctctgtgaggtggggatgattgttatccccattttacataggaggaaactgaggcacagcaaggttaatacgcccgagattcaagagctggcaggtg

SEQ ID NO: 118625 - DNA, 1124 bp, Homo sapiens
cgtgtttattgtaaggcttcattctggagagaaagtagcaggaagcaaaggaatgcacacttcttgagtcctgttcagttccagggaacatgccgatgcggccggaggcccatggaggcaaggtgtctggcccaagctctcacggctgtgaacctgggtccctggggttccaaaggctttgcccgctcccctggcctccaggctcttatgtgttggtgtccataggaaaaaaggtgtcatacatcggtgtcaggcaagagtcttccaagtcagctgagctgggagaattccccggcccacaccctgctctgatctgggaatcgaatgtgataatggagtcaaccttgtctctcaaatcactgaaacctgtagacaatccacaaggatcctttctaccttagtgtcaccttcttcccccaggactttcgagtagagctatccaagggctgcagaatgcacatgccagagagagctggcttcttcatgatgatgattatactaattaaaatgaaacaggagtaggagacagaggccttgtttgctacccagtgggttatgcattcccaggggaagggaattggctcttgtcgcgcttctccagttaccagctgggaataagggaagcccatggagacggttcctggtggaggagatggagcagtgggccaaggctcaggtggctcatatccaataatcctggccctacctagggccctgggagccctgtcagttgtgggaagtctctgagtgtcatctgtaaaacagggaaataatcatgatggtcatgatgccactgttgtgacggttatttgagtatcaaataaggtcaagaatccaaaagcaccttgaggaccttaaatgtttcttcaatcacaagtttctctttgttgggacaagcaaaatttggaaagtagagggcctagctgtgaaccctgctgggaattccaatgagatctttctttctttgttcttttgtgagttcatttattcattcagtgaacattcatttggtgcccactcataagatgctgaggttacaactgttaataagatattaagatactgtctttttcttcctctttctctcttacacacacacacacacacacacacacacacttttt

SEQ ID NO: 118626 - DNA, 1181 bp, Homo sapiens
gagctaatgagtgacagtgcctgcattgggacccagatggctgactccagacttgtgagttttaaccaccaccgtgtatctcttagggtgaagactgataatggtgggtgtggtgatggtggtgatgatagctcacgtgttaaggatttgagataaagggtgatgtgattcttcacaacgcgcagaactctctgattatgtttgcaacccacatttatcaagggcttgtcttgtgccagtcccggcactagatactgtataggttatctcatttaatccccacaacacccttatgagagtgggccttcctgtgtaagtttcacagagaagaaaactcctctcaagcaggttacataacccacctacagttctggaagaggtggagcctgggtttcagcctcgcatcccattcctgagcctttgtgggtaacatctaccctgcctcctccttaaccatggagctgaccacagctctttcctcctcccctccccagccctccctgactacaccccattgctgcattctctccctgcccatggcccgttggcctttcgcgtctatactgctgacgtagcaccttattaaatatccctgcatcctctaattacctgtggctcaggccgcgggtagcgttacagccacatacactcccatggaatgttgtggggatgactccctgcctgtttggagtgtgagtcttgttccccggccagaccctctgcccctggaagcagaaacatggcttcttcaagcgtctgagccctcgtagtgcctagcatgggcctggagtgccatactcacttgataaatgcttgttgcttggtggattgattgaaatgagggtggaaggatgagagtggagggtgaggcagagagtgtctctgggtcaccctccagctcaacacaagggcagtggtcagaggaataatccaaagtgcatacccaggccccagagccgccaaagctgacctccgcctccacttcacctgaatagcatggatctctctgaaatggccctcttgatttgcttctggctggggtgcatctcgccctctagactgtaagggcagggccctatctgtctctttcctctgtagctggtgttaacgaaggctctgctgtgtgtcatgtgctcagctctcctaacaaacttgagagatggttatttttatcatgccca

SEQ ID NO: 118627 - DNA, 1028 bp, Homo sapiens
tgggacttgcttgggaaacactaggaacatgaaagatagggtatgcattcttcagtcccgagagaatcaccacccagtattaaacttggcagaaggctttcctctcctcctctgagctgcctccttagaaaaggcacattgtcagaatgccgaatgcccaccgtggtctcatgtcctcacagcccgtaggaaagtaactaccagttacccactggtggttgcccctgagaggagggtaagggaggcttccagcccccggggtggctctccccgacaggtgtgcctgtgtgctgtttgtagggtgctcctggcagaacctacctgtctccacagcgacacatctggccgtttttccaggagggcctgttgagaaacattcaggaatgtttgtgctcctttagagatttgtaattaagaagaggcagaactcgttcttgtctggcaccctcccttcttgcccctccagcatctgggtcatttgatttcacaattggggttttcggcagcccgagttgtggaggctggaagcagggaccgactgaaccaggctggatggtggtgaattgcttcacccgagggtgggggctgggagttccaggcaggcccccaagtcctggccacatctgaaagtggacatttcttcccaggttgcatccttagcacttgcccaaggtgaaacatttcaggccagtggagcacccacagttcctgggggacggggggtggctggtttaaatggacaattcctctccttaactgccaggaagagtgagtgtgtgcatgtatgtatgtgtgagtgtgtctgtttaaatctttgtgcagccaaaaacacatctcttcatcctgaatgacacatctctacacactgaataattcatctccctcttggcatttgttccggagagaatcttgctgtccagatttcttgtaagttgcatagccttccataggcacttccttgtttcccatggaagagctctgggagtcaggatatcagtcagtcagccctctggcatttcccctgtgat

SEQ ID NO: 118628 - DNA, 1001 bp, Homo sapiens
ggaaagtaagttgcctaactcacacagccagtaagtgatgcttactgaacccttatttgttttgttgttgttgttggtggtggtggtggtgttttagagtcagggtctggctctgttgcccagcttgtaatgcagtggtgccatcacagctaactgcagcctccaactcctgggctcaagcagttcttccacctcagcctcccaagtagctgggactacaggtgtgtaccaccatacccggctaatttagcacatagtgtattgcacatcacatacctctggcctcatcctcatggaaccagcagccttccacagtgcagcagtaaattactatcagaagcttttgggtattcattcaaccaaaaggtatttttcatagcctgccagaccctgggtatatagtggtacgtgaacacaccaggtcctatccagctggggctctttcagcatccctttcttcatgtatttttctgtaagttggatttggagtgagttttagagggcaggagagtgtaagcctctttttttggtttttcctatgtattcattacattattcactcattgtgcaatttttttttttttttttttttttgagacagagtttcacattgtcacccaggctggagtgcagtagtgtgatctcggctcagtgcaccctccacttcccaggttcaagcaattctcctgcctcagcctcctgagtagctgggattacaggcaccagccaccatgcccagctaatttttgcatttttagtagagagagtttcaccacattgagcaggctggtctcaaactcctgacctcaagtgatccacccacctcagcctcccaaagtgctgggattataggcatgaatcactgcgctgggccccgttgcacaaatacttattgagcgccaattgtgctggacacaggattctgtagcttggttgcaccattgattaaaatcatttaattaatccccaagaaggaatttaaaaggtgatgatccatatgc

SEQ ID NO: 118629 - DNA, 1144 bp, Homo sapiens
tgtttgtgatagttttctagcactgacaagcctttgttagtttagttgagtgatttgtttatttgatttagccattgagacttggtgattactaccactttgatccccacaagatggggacatagagagcggttattgctaaaagatcagtttggcctggattgtctaaggaagcgccattgtgggtgcaagcatttgggaatcagctcaagaggaaaataaatactgctcattggccaaactcacagggatggaacatctgctattcttgatgttgcggcaagccagccttccaaagggcaagtgagcatgacaggcgtgagacagagccaggataaggattagaggtggggtggctgagtgcgttgcaggtgaagaagccaaggagggctggagtccaactcaagaagcaagacttgaccttagaccctttgcctgcaaaccctcaatcagagttgcagaaacagaggcccaaagaaggaagttgacttgctccagtcacttctgaaggagtggcaaagttgggaccagaacacagattccctgcctcccacacagggtgatcttatcctgctgctgcagctatgtgttcaccttcccgggaacaaaggggacaacagagctggtgctgctgtggtgtaaaacttttggatctgttgagccagcccagaaaagcaggaggcacagggaagcagcaggttgcaggcatttggggactgtaggctgatggagtctgtttctcctctcccttgccaggtacaccaaaccgctcacctttgctgactgcattagtgatgagttgccgctaggatgggaagaggcatatgacccacaggttggagattacttcatagaccacaacaccagtaagttcccgacggtcctcccttccctgtgccctcttcatccctccacctccaagcccatcctccctccaagtctggaagaaccacttgcagactcttggagccagattgtattttgttttatatagatttagatagaaatgtcgatgtagatatagatagataatgtatgcttgtgtaaaaataacagtttagaagggtttttaatagaatctaaaactcctctcacaatccatctccccaattttatgggggcagccactgtgaacagtttcttg

SEQ ID NO: 118630 - DNA, 1065 bp, Homo sapiens
caggcaagaagaaaatagaatgaaatgggatgtgcctggcaaagtctgaaggctgagactagggcatcaaatcctaatagcctctgtttactgagcacacagtctgtgccgtgtcctgtgctgaggacttgataggcattatctcttttaatcctcccaattcctggtgggatgttcagatgatcatccccatgtcataaatgggatttagagtcaattgactacttaagactcacagctaaaatgtggcagggctgggattggaactggccctggagaatgaagttgtacttctccacctacttcctcttctgggtttcagtagcaccctggccacacctgtcttgtgcccttcatcaccctgtattataatcatttgcctgttgttgcaggtctcctagagcagagactgtgtctaattcatctctctagtcccaggcctttgcctggtaaggcacatagtaggtgtgaacttaacctgtgctaaatagaaaagggcatacgtgcatgaatgcatgaataaatgggtgaatgagtggactgttgttggcaccaaagtgtagaagagcttctgagagacagctaatggcattaattgcattgttgggggtagcaaaggtttttattagcactcatgattgcgtactggataatgagaagtaaatatgcctaattgagtgtgtatggggaatgaggttaatgcttggagggctgcatgggatgctgggttaaacactgatgtgcaggagacctaatcagtcttttcctgtttctaattgctgagtgcatccccctcattaaaatctcatggtgggagtgggatttcaaggtgcttctgggagctgttggaaaaatggaagaaagtagtagcaggccgtggcagagtttattcttgagggaatgaaggcagaaatggggtgtatgggggtgattaaatggggccatagcaggaagaattctatctggtagtttcacaagctgtcaggctactggtttcctcttggtttgaggtggtctggttggatgtgggggaccacctcagtagatggagccattgatagcaat

SEQ ID NO: 118631 - DNA, 1474 bp, Homo sapiens
accttgccagggtacttactgtcccagccctccctttttccttagcagctcaggaaaaccctcaggatctcagaggttatagaaaagaactgtgttacattcattagctattctgtgtcaagtaatgttctggagacttttagaaggttttagcacttaatctgtcttagtcgactcgagctgccataataaaataccatagattgggtggcttaaacgttacacatttatcttcttacagttctagagcctggacgtctgagattcgggtactagcatggtcgagttctggtgagggctgtcttcccggcttgcagacaactgccttctctagtgcctctttctattagggcactaatcccatcgtgaggagcctaccctcaagacctcatttaagcctgactatttccccaaagcctcatcttcaaatactatcactttggggattaggacatcaatgtattatatttatttgggagagacacaattcagtccgtaccatttttgttaagacggtcctggaagggagatgttattgtccctgttgaacctcaggtttaaaggggcaaagtgatttctctctctctctctctaaagtcccacagtttgaaaaagtgtcaggtgtatataaaaacaaaaacaaacctttgtattttgggggacaggatatttacatggacccataatcacatgtcaggtaatgagaattaccctacaaatcactcactaatttcagaaagatgtacttttacattggagagatgggcagccaccactttacgtagtggtaaaattagcatgaccaataatgagaccaggtgatatcaatgccttctgacgtgatgcaataaagatatcatgaaggatccctcacaagaatatttcatctgaatctaatcaagagcacagccagacaaatccataatatggattattctataagacaattagactaggttttttttttaaagcctaaagaggcacaccaccaaatgaaatgtttgtaccttgaattagagcctgaaatgggggaaaagcagccataaaagacattctcagacaattggagactttcctgagttgtgataatggagttatgaatatgtaggagaatgtctacatagattttatgaagatgcatgtggcaacatatctgcagcttattccaaaaaaggtccaagaaaaaaaggaaaggaaagaaaataggaaaaactcagtcgggcacagtggctcacacctgtaatcccagcaatttgggaggccgaggtaggtggatcaattgaggtcaggagtttgagaccagcctggccaacatggtaaaatcttctctcttctaaaaatacaaaaattagctgggcgtggtggcacgtgcctgtaatcccagctactcaggaggctgaggcaggagaattgcctgaacctgggaggcggaggttgcagtgagccaagattgcaccactgtactccagcctgg

SEQ ID NO: 118632 - DNA, 1394 bp, Homo sapiens
ctcacgcctgtaatcccagcacttcgggaggccgaggcaggcagatcacgaggtcaggagatcgagaccatcctggctaacacagtaaactccatctctactaaaagtacaaaaaagtagctgggcgtggtggtgggtgcctgtagtcccagctactcgggaggctgaggcaggagaatagtgtgaacccaggaggtggagctttcagcgagctgagatccagccacttcactccagcctgggcaacagagcaacactccgtctcaaaaaaaaaaaaacaaaaaaactaaaaaatgccagttgaatcactcacttgattttactcactgcaaaactaggagtatcagataaaatatatttttaaggcatatatatatatatatatatatatatatatatatgattagggaaaattggagaagaaagaacagcaataaaatttggaagctggaaagcagacagacaggtggcaacctacgtagcagacctgagaaaagagaaaatgggctgatagtgaggaaggctcacaacactgttctatagggcacttgcaaaaactgtagatgttggtggcagcagctatttctgcaagtaagactgaagggaagagggtctcaaagaggaatgggtaaaggttgtttctaagacaattagaccatcagatcttttccttaaatcgatacagtcaggcaaccaccatcttcagtctggcaaatgactggaagtttattttttggagagggtaaaatagagtctctggactctaggacacaagcaaattcagagccagagtgtactatcctgaaagcacgagtaagtgaagggttttgagaccttagccctcatataccacttggtgcccagaacagtgccaggtcattaccctctaggctggacagtagagaactctactggaaatctgaccagggaagagatataaagagaaaagctggaaagacactgacattgaggattcctggatgaaaccaaatcaagtccagccaaatcatatgctgtggccaggcgctcatgcctgtaataccagcactttgagaggccgagatgggaggatcacttgaagccaagagtttaagaccagcctgggcaacatagtaagaccccaactctacaaaaaatttaaagaagaaaattatccgagtgtggtggcaagcacctgtagtcccagctattcagtaggctgaggcaggaggattccctgagtccaggagttcaaggttacagtgagctatgattgtgtacattgcacttcagcctgggcaacagacacctgtctcttaaataataaaataaattttaaagatagaaaacaaataacgtactgtgcaactcacagtccacaaaccacactctagtcagcattttgggctcccatc

SEQ ID NO: 118633 - DNA, 1081 bp, Homo sapiens
cttcaaacactgggacaattcaagatcctaaaagctttcagagagaaaaaaatcaggtcacacagaaatgatcaggactcagaatagctccagacttctcaccaatagcactggaaacctaaaagaccatggtgcaatgccctcagggatttaaggaaaattatttctgacctagaattctatatccagcaaaactacctttaatcaagtgtagggccgaataaggctattttcagacgtgtgagattttagaaagctcatttccttcatggtttctttctcaagaagctactggagatgatgttctaccaaaatgaggtgggtagaccatgaaaaggaagacgcggtatacagagaggtgaggagacacacagaggaacacaaaggcggatctcaggaagccagccgaacacagagagcagctcgctcacactgaagcagggcagaagccctggcaggacagatcccaaaatagaaaactcaccagattcacattggtctggactctatgagaggagatttagataaccagcagaatgtgaggttgaattagtggtaagtttgtagaaactaagcaaacgtaaaaatgacaataattaactcaaggggaaaaaaagtgctgaaaagtaaaagtaagcaaagtcagctagctgattgcaccctgaatagtgtttgcagagtaaaaataatgcaaacactgaacatcgctttcaccaaaagtatgctattgcttttaggatgacggggagatgggagaggttcaagtgcatgctgtaggggctggggaagggaaggaagggaggctaagtccccaccctcctgagaggtaagtaaataagtaatgccgaaaacagaaaagatcaagaagcagtaatgcatgcatataactagacacatagaggtagccacccaagaaattgaaaatgattttcttttaggttgtgagttatggggataggggttgtggaatgctcttttttatagcaaacctcaaactatgttggactgttaaactgtgttcatatataactttaataaaaactaaaaattaagaactattaaactttggggcaagatagta

SEQ ID NO: 118634 - DNA, 1054 bp, Homo sapiens
tattactgttgatcagtgagtgagaaatggtgttaactgtcttaatattttgttgaaaggacctatttgggaaatacagcaggtcctcaaataacatcattttgttcaaggtcattttattataacattataatattataacctccccacactgtatgcttaaggtgatacctccagctaaatatccaaccaggtctatccctgaaatccccaagtctagcaaagaccaaaggaattagacaccaggagatgaaaactttaaattggcaataaaacatctctgtacatggattccctgttccatgcttgagacaaaggctacaaggcccttgccaccccaagtgttgtccccactcatctcttctggtaaacctcggtcttctttttctccatcatcattatcattgtaaattcagcagaaatgcaacacttcttgtggtgccaaatatcttttatgttattatgcagagcagttttctcatcccccaaacttccaagtattacattttaatgccttatgcataaccaaaaggcctattaaaatatttttaaacaaagccaaacagtagcattcccctcatgactgtcatgcctacctccagacactgacaattgccagcaatcaccaaataagcttctctatcctcagaaaaacccagatctcagcaggtgatctggctacatgtgaacattaaagagtgttcagatgatagccaggtgcggtggctcacgcctgtaatcccagcactttgggaggcccaggcaggcagatcacctgcagtcaggagttcaagaccagcctggtcaatatggtgaaactttgtctctgctaaaaatacaaaattatccgggcatggtggagcgtacctgtaatcccagctactcaggaggctgagacaggagaacagcttgaacccaggaggcagaggttgtagtgagccaagactgtgccactgcactgcagcctgggcaatagagtaagacttcgtctcaaaaaataaaaaagaaaagaaaagaaaaacccagatctcagcaggtgatttggctacatgtg

SEQ ID NO: 118635 - DNA, 1484 bp, Homo sapiens
taaaagttgaataatacagtgtaggccacacaaaccagcagaccgagtctagctcctaaggcatgtcttgccactaaagttactaagttgcctcttgcctccacgtgaagcactctcatagcctttgccagctttaagtgatccatggctctggaaattgccattgtcctcatccatcagaacaggaaagggaggctcaggatggcaagacagcttgagagagttcacacagcgaggaagtgggaaggcccactctatcccaggtcagctcctgtccacctgtttccctggagcaaggactggctaggaatgacctacagaaacactgcctgggatgctgactgaatgggcatctgcagagaccaaggccaacatcggtgacaggagggggctctgaccagtgtggcgcaaggggtgctgacctgagtcattatgcaggcgcagtgggaggctctgggttccctttccagggagaaggcagcctgcaccttggtgtcagcctctgacccagccctgtgtgtggtctgctgccctccaggtcaacaagctgaagagagagatggttcacctccagcacgagctgcagttcaaagagcgtggctttcagaccctgaagaagtaagtacaccctgcatcccagagcatgggggctgctccccaccctggttcccctcctgtcctctctgtctctctctccttcagtccctttcctcccttctcaaaatgtggctctctcatcattcaattcaagttctgttccactggcatttcctgaagatactgccacccaagggtggggtttggaaagaggaaaggggagtcatttcagaccacagaacactcattgtcccgtggactcctgaagccattaagatttgttccactcagccgagtgttactatccagtcacagaaacaagtattgcccagcatttctgtgcacacgcctcatctctagtcaatccagtagggtctcatatgcacacaaacaaaatacacttcttttttccatatcccctaaaagcagtcactaagtgcttcagtgaaggattaatgatctcttctagcaaaaaccaattactagaaaagtatgcacaatgccatatgcattgtgctctatgggtgacttaaggagtttccaggataactttcaccaaatgtaattttcacccttagaagctgagctgtggccaggtaaaatacagctccgttgtgtcttcttcttcttcttttttttaacttttatttgaagttcggggtacatgtgcaggtttgttacacaggtaaacttgtgtcatgggggtttgttgtacaggttatttcatcacccaggtattaagcctagtacccattagttattcttcctgatcctctccctcctctcaccctccaccctcccagaggcctcagtctgtgtttttcccctctatgtgtccatgtattctcatcatttagctcccacttataagtgagaacacgcagtag

SEQ ID NO: 118636 - DNA, 1058 bp, Homo sapiens
gctgtttctcgctttttgtccctccctgactgctataccttttcctcattccatgaatttcaaatccaccctcatcattctgtggccatagccccaagcctttggctgtctatctccaagccctattagttgagggaactgtggtcatccgttgagggaccagttggttctttttcacgtcttcccaccccacaagtccccaccgcctggggtgagccacacaaattcagcacaacacatgctgtaagaaagtatggctttgtattattacaaattgtatgtaatttttgtgtcttacaaagtattataaattatggctttctgtatgtttacatctacgttatatacgtgttatttatatatgtgtgtatacatataccaatcttgtctctcaaaccggattctgaactttttaaggcctggaaccatgctttatgcttcttggtaatcttcagtagcaccattgacagtttggggcaatagtataagcttagaaaatgcctatttttgacctattgaagcaatagcctgattcctccactttgcagcaaaatggcttctgagcacacagtttaagggctactcactcccacatcattttactgaatgggttctctctgcttcctggctactgcagtccaagagcttctggttagaacacttcccattattctctgagccactgcaaacctgttttaccactttgtcaccctgtagcagcattgaaaactcttgttgtttggtaagctgatgctgaaaccccaaagacaagcctcctttcttcccctccctctgccccatgtttgatatcaggacagataagactccatggcagctccagccgcccacactccttagccggaagctgggctctgcgtccagtgtggaggaagatgcgtcctttaatgtacaccttggcagagagggtcaggaatgtagtcttgagaggcaggtggtcagggttcaaatcccagttccctgggtccttggaaaagtgacttaacccctgtgagctttgacttcatttgaaaaactagggattgtaaagattgaattgg

SEQ ID NO: 118637 - DNA, 1612 bp, Homo sapiens
caaagctcagtccagtcctagttatgaatagtgaaagcactgtccagatgtggctcaggaaagagttagagtagggctgaaccatggtgcctcgtaacttttggagagcttttgttttactagagccagcaacattgaacgaatctgccttccagcctctgtggcggacagcctctatatgctgttcctatctaagttccatagctgtcttcccacttgtccaagggtgaccggtgagccttgtagcttcttgctgctcttaacagactagcacagaaaaagaggctgtcccttccttccccataccaccatgtgtccagctactagccatctgcaggccaaagtatttgtaaaggaactgtacccctctttgtgagtgcaggggtcttctccccaactacccagtgtttcactcctgactgcagcctctgagttttctatggatcccctcaccagtgcccctagaatgagtttcttgatattggctatccctgtttcctcctcaccaactgtcctccatgcttctgtggcttgaatgggcaccaagccaagccatttggggctgcaagatgatattctgggcttttggcttctattttcaaagtgatcgatgtctgagcgtacggttcttcccgtggcctgaagggaggaaagtgtttttgcttaaccagcttccctgcgatctgcaccgccagcccagtcaccgggggctattcttggctactgcccacgcaagctgtcaagtctctcatgagccctcgaaacccaactcagcaccggccacaacagccacataattcctgactttgttcttctcctccagttcggcatcaacagcaacaatcagttggcagagaaggtcagattgcgccttcgatatgaagaggctaagagaaggtaattgggctggggctaggggcgggatggttccaaaaataataactactattgtagaatgcctgctctgtgcttagcttttcacacacttcgtcttctttaatcctcacaaagattatgaagatagttattatactttttatattttcatcctctctgaaattcagagaggaaatgactcacccaggacacttcacaagacagagagtgaaactatgctttgaacccagatctgtttaacctcaaagccgagttatcttcccacttgcctgtcttgatttctgcaaccgaggctttcccatgatcctgtaagcattttggtttgaaggagtacaactggaatttcagcaacaggctaaaaagattatggacactacccacttcagtgtctcctgcacagctgggagcaagctgggcttttaagcagtgtagacctctgggatttagatgttctgtggcttcacagaatcctaagcaatcaggttccactaccacaagtaaaatcaaaataataatcaaagctgacatttttagagcatctgttataggcctaaagagatttttatttttaattactttgttttcttttttagggacagggtctcgctatgttactcaggctggtcttgaactcctggccttaattgatcctcccacctcagcctcctgagtagctgggattacaggcacgcaccactacccttggctgagattg

SEQ ID NO: 118638 - DNA, 1025 bp, Homo sapiens
cttccggccctcaggctgcatcaccaccatccacgaggatgaggtggccaagacccagaaggcagagggaggtggccgcctgcaggctctgcgttccctgtctggcaccccaaagtccatgacctccctatccccacgttcctctctctcctccccctccccaccctgttcccctctcatggctgaccccctcctggctggtgatgccttcctcaactccttggagtttgaagacccggagctgagtgccactctttgtgaactgagccttggtaacagcgcccaggaaagataccggctggaggaaccaggaacggagggcaagcagctgggccaaggtagagagcaccatacccagagggtgggaaccaggaggagggaaagagatactctgtgctcagaaccccccagtgatcattctagtcgatatttactgactgcttctgtgtgctgggtctttgtatggcaagtatatttattcagtggatgtttattaactcagtatttttgaggtcctgtgtgaagggttttcagtagtagattctgtcctccaacagacatttagcacctcataaaactaaatgtcaggtcatcctgtgctaatggatatacatggattcatctattcatgattatagatatgctgggtgccaggcactgggttggtcactaaggattctgtgttgaagacagacagggtccctgttctcatgaagcttatgttcaaatggaggcacagggaataaacctgcaaccaaacaagcactacaaagaaaataaaacagggaatgtgatccagcctttctggttagaggtgggactgccagggcaggttgggttgtgaaagaagatgacatttgagggtgtcttgaatggtgagatggagccagccttgggaaaagcaagagcaaaatctctgaggtcagagcaagggactagaaggggagccaggaagccatgagtcagaggtagggggttaccagtgaggctggagaactaggcaagagtccagatcctgaaaggcc

SEQ ID NO: 118639 - DNA, 1056 bp, Homo sapiens
tgcaggagttcgaaagcagcctgggcaacacagcaagaccccatctctacaaaaaataaaattagccaggcatagtggtgcatgcttgtagtcctagctactctggaggttgagatgggaggatcccttgagctgcaatgagctgatcatgccgcagcattctggcctgggcaacagcagaaccctgtgtcaaaaaaaaaaaaaaaaaaagcacagagtaatgaaagcaaacacataggcattcacatcccacctttaccacttgctgtatagctggatgaccttgggcaaggtacttaacatctctgatcctcatttttcttatccctaaaatgcaaatgataatgcctccatcatgcccactggaagaatctttataaggattgagatagcacccgtaaaacacctattcaagtgtctgatccacagtgggttctcgtttagtggggccattgccagcctcctccctgaaactgaccttctccggcttccatctctcactgcattggcaggagtcaggactggggatgaagtagcccaagtacattttgtcctaagagacaggcagacccaagtgcagacagatactcagctttcccatctgtagaagggggatttatataatagctaactcgggcttgtgatgtacaagtgaattagaagaagtaaagggctttgttaaccctgatgccatttagtgttagaatattttaatgataactcaactgtgggcacaaaggagcccaagtgtgggcattatacctagaaggtcgctccactcatgctcagatctgtactgggagcttgttgtgtccccacccctgtgtctggggctggggattcaatggggaaccaaacagacaaggtgccagcattgatggctaagatgtaaacaaactgtgaggagggccgtgttggaaatggatgggttgaagtgatggaggaaaatgtggggtatgtgcaaaggggaaaaacaagatgtatacacctctccgagcctctcctgcctccatttctggaagctggaatgtagagcctctcactgccttcttggag

SEQ ID NO: 118640 - DNA, 1063 bp, Homo sapiens
gtttaataccactgaactgtgcacttaaaagcggcaaagatggtaaactaaaggtttttttatcacagtttttttaattaaaaaaattcataggataagtcttcaataaagatttggcaaatgattaaaccaatcaatcaatgaatgaatgaacaaatgagctaattggaaatgttaacaacttggcctctcttcctgccgggatgcctacctctcatctggagtggtgttttttccatactgtcctcttgaaccaaattccctgacacctggtgtcccccccaccgccacttatgttctccttgtttccatccccaacagggaggcgcccagatcagcctggcggaggtctgccggtctggggagaggtcgactcgctggtacaaccttctcagctacaaatacttgaagaaacagagcagggagctcaagccagtgggagtcatggcccctgcctcagggcctgccagcacggtgagctgggaccaggtgtgccaccttcccacaaggccgcacccggatgttggaagggaaagcctctcccagaactggaggtgatcaggcgtcatgagaggagaacaatggggtggaggaagtaggagaagaagacagggaaggagagatctccactaaggggcaggcggctccctttctgcaacttgttcccttccacatctgtgtttcctccttctgtcctttgccctacctaataccacttggctaacgaaaaccttaattcatgattttttacaaatgaagtggagaagaaggtaaaaaactgtggaaggaaaaagattaacctttcttgggcccctactttgttcaaggtccatactggaggctttgtataagaggcagctagaaatcatgggaagagaatcagagggctaggtcagtcatatcacctctctgagctttcaatttttaatgtctaatatgagccttaaaaggttgttatgaggatgggcacggagcctcatgcctataatcccagccctttgggaggctgaggcaggaggatctcttgaggccaggaattcaagacaagcctgggcaacatggt

SEQ ID NO: 118641 - DNA, 2003 bp, Homo sapiens
ctctttctcctcctcctctcctttccctcccatccccaccttctttttcatcgtcatcatcatcatcatcattttctgtacttccttttgcatcaggcactgttctgtttattatgtgcagtttaccaaggctcagagagataaccaaattacattaagatgtacatctcatcagcaaagctaggtctcaaacccaggtctctcactccaaaaggagactgtgagctgataaaggtctcgaaaacaaactcctctcctttctagagcatgaccttgagtaagtaacatcaaccctagacacactagttctctccttcccatttctcaagtgagtcataataattcccacctgtcaggatggttgtaaagattaaataagatgctacacataaaccatctttcacagtgcctgctatataccaggccttcagttgattttagttccctctttcccttcttacaagaaaatgtcaggaatttttcaggctctggcccacactaccaagggtaaccacaaattaaccatgtgctcagaaaactacaggatccagtttttgctttggtattagctaccatttactgggtgccaattatgtgccaggtattcttctgtgttcctcatgtagagtctcaattaatcttcataacaaccctttctagcagttattagaggaaacagtctcagagagtttaaataatttcctcaagtcacatgggctttttcactgtagataccattcagtataaatgttcctctttcaggaagccctccctgaatgcaacttcccaagctttatcactgttccgctgttcccaaacagccagtacttatctcctttcacctctcttctatgtcatatccttactgtgttatgttactgatggttcacacattggtctgatgacactgtggtctgcttacagtcagagaccttaattctctctcacttcactgctaaacttggctatcttccatcacgatgctgagtaagttcatacatacaggagctattctctggagaactgctagttgaaggaattaaggacaatttttccagtttatcagtgaccttgggcaagacacttgaccactctggtctttggtttcaccatcaattcactgggagggtcacagctctgagatgctctgattcctggcaggtagggtggcacctacattgtacccaatgacccagcaacctttgtctctataggacgctgtgtctgctctgttggaacagacagcagtggagctggagaagaggcaggagggcaggagcagcacacagacactggaagacagctggtgagtgagcccgcccttgggccccaggagctgccctgcctggacctaggcccagcaatgagatcccccaatgccagtgcaactaagagaagggttccactgggaaggctgagaacccctctcctcatgggttctctacaggcaaaaaggcaatgtaacctagtacgatggttcccagaattcctttcgaatttgccatttcgtttcccatgaatcacctatgctagttcacacctaatgttattctttatcttgatatagtgacatttattttgctaaaaaaaaaaaaaagtaaagaaactttatgttactctaaatggaaaatttgtgtagtttgccataaattaaagagttcttgggaattgcatttgactttcaggaatggagagcagaaatattagacagaaataaattagaagtttacttcttcttcacttaagaagaagagggccaggcacggtggctcatgcctgtagtcccagcactttgggaagccgaggtgggtggatcacgacgtcaggagctcgagaccagcctgaccaacatgttgaaaccctgtctctactaaagatacaaaaattagctgggcatggtggggcacgcctgtaatcccagctactcaggagggtgaggcaggaaaatcacttgaacccaggatggggaggttgcagtgagccgagattgcaccactgcactc

SEQ ID NO: 118642 - DNA, 1033 bp, Homo sapiens
caggtgcaaagcacatagtagaccctcaatacatggttgaaatcattgttaggaaaaagagaaggaacgttcctcactactggctggaaacagggtaaatcccatgtaggaaatggccacagcctatgagtcttgccatttggaaggaaaaataagttggtcttaagtgcatgtgctttaaattcagacagatatggatctggagtctagctcagccaacttccttctgggatcctgtttctgaccggtaagaccttactgagcattagtaagatttaaaagctccctgggtgattctaatgtgcagcctgggctgaatatcacagctgtaaacttccgtctcctcgtctgtgaaatagagatttagaaaacagccactatgtcatggggtattttgcaaaattcagtaaaattatgcatgataagcacttaacacagaccctgacctggaggaaacattcaataactcttccgtattattattctcttagagcctcaaattatatatttagtctcaggcggcgccctcccgtaatatctgttactccacaggtcagcagatgatttctggagagggccagatggtaaatattctttgccttgtgagtcgtaagaattctgttgcatcccctcacctctgctgttgcagtgtgaaagcagccgtagacagtatgtaaaccaatgacactgtctgtgttccactgaaacgtcatttatggacactgaaatttgcattttatataatttgcaccttttcaccaagtattccccttttgatttttttttcagccattttaaaatataaaaaccattcatggcttagactgtccaaaacaaagcagcagacaggattgggcccactggctgtagtttgctggttcttgttttactcttctctcttactatttttttcatgtgataaagcagatggcaaggttcctggaatttttgtatgttcctttgttagtttagggttctctctaaattgtctcaatctctctctccccctccttttctctctctttctttctct

SEQ ID NO: 118643 - DNA, 1033 bp, Homo sapiens
ttggtctattttctctctccattctaaaatgtgtctgccgtgagaggggagatcgtgtctgttttgttttctttgtgcccccagagcctagaatactgtctggcattttaaagtacacaataaatgtttgttgaataaatgaatggatttgttagttttgtgcccatttcacaaaggggcaaagtgaggcctttgagagccagaagctctaggtcagtgactgtcctagtctatccaagcacagagcagctctggttagtgtctgctcaattcctctcccctcgcccaaacgtccctgagttgcggcctcgctcctgaccgaaatccccgcgggttctcctcgcagtgtctactggatcccgccaggaggcagcagaggcgccagcacccagtccgacgggacagcggaccggagggggtttccgcttccgggagaggctgaccgtttccgcttccgtccacttggcgagtgagacgctgatgggaggatggacgtactggtgtctgagtgctccgcgcggctgctgcagcaggtttggacgcaggagaccggcgggaaggcctgaaagagatggagcaggctctgactcctgcccaagcggcttcgggggcgggacagctaggcgaggaccatcctggtcctctcagagtggagcggcacggtccctgtgggaacaggaagggttgagagaggaagcacccatcatttcaaagcccgtgtgactgtgattttcagcggaatggagggtccccaccctctcccaggcctcccccaaaccagcgtcttcggtgggctggagcctggcatgttcagaacagttctctccctacaatccacctcctcttctgcatacacacgcgatttaggggatgcggggagatagacaaggggggaatacattcagagctctgggtcttggtttgcagctcagccgcagttcttcccgggttactgagcgagaggattcctaataagcccatggggtgattcattatcagaccagcggagcttgctctgtgccctcagcattcg

SEQ ID NO: 118644 - DNA, 1049 bp, Homo sapiens
atgtatgtgtggttaatatattctttttctttttctttttttttgaaacagagtctcgctctgtcaagcagactggagtgcagtggcacgatctcgactcaccgcaacctcagcctctgggattcaggcaattctcctgcctcagcctcccaagtagctaggattacaggcatgcgccaccatgcctagctaatttttgtatttttagtagagacagcgtttcgctatgtttgccatgctggtcttgaactcttggcctcaagtcatccacctgcctaggcctcccaaagtgctgggattacaggcgtgagccaccatgcctggccaatattttcttattaaggataatatgctaacgtcagcaaaaatctcagaggagaaagaaacacagctcatcaaagggaacattaatgattcccatggtctatgccacgccttggtagagaggggaaatgtggaagtaagtttatggactgaaaaaagtgctttttttcccacaggaagaagagattaaatctctgactgctgaaattgaccggttgaaaaactgtggctgtttaggagcttctccaaatttggagcagttacaagaagaaaatttaaaattaaagtatcgactgaatattcttcgaaaggtgagtactttgggttccagttttattctccagtttgaatcattatagcttttttaaagcctttgttaccaaagattctggaagtatatcctatggaatttggaaaagaagcatagaaaccctattcttttccctgcattagacaacttaggactgaggtagttggtgcaaatagtgacaagttggtgttgtcctgtccttcaggactctttgaaatgtttcatcctgctaactgtttggctaacttaaagtaggatttaggtagggttgaggcatttctttttaaaaatttatttattattttttgagacagggtgtctgtcactcaggccagagtgtggtggcatcatcacggctcagtacagcctcaaccttcaggctcaagcagtcatcccaccacagcctcctgagtgg

SEQ ID NO: 118645 - DNA, 1022 bp, Homo sapiens
gaattacctggagtcaggagttcgagaccagcccagccaacatggcaaaaccctgtctctactaaaaatacaaaaattagccagggatggtggcatgggcctgtaatcccagctacttgggaggctgaggcatgagaatcacttaaacccaggaggcagaggttgcagtgagccaaaatcgtgccactgcactccagcctgggcaacagagcaagacccggtcccaaaaaaataaatacataaaaataaacaaaaaattgacatttattatagcaggttttgggtataagatcataatctaggccaagtgtggtggctcatgcctgtaatctcaatgctttgggaggccaaggcaggaggatgtcttgaacccaggagttcaaggttacagtgagctgtcatgccactgcactttagcctcagcagagtgcacagtgagatcttgtctgttacccccaacaaagaagagaaaaggatcatatccaagtaaatttggcatttgctgttggaaatctttagattgggaaaaatgtatcttccttgttttaagtatgttaccacagagaggagtcaattattgattagctacaaacttgaaatcaggttttttagtgaatttaagaatataatttcttcatatgatagagagggctgatgaggggagcataaaacttggactgtccattccaatagacctgagtttgaatctggccttttccacttattctgtcttgtctttgacaagtgacttatctgtagcccacatagaaatagtgataatagtaacaagctcgattttattatgtagatggaataagataatgcatataaataaagcatttggttcaaatctttgcatactcaagtattaacttttgttattgtcattattttatactgttgacattttgatgaatataaatttgtgatgaacataaaattgtgatgaacatgttgatgaacataaaattgacaaacataaaggtgtataggcagcatgtttatcttctattaaaagcata

SEQ ID NO: 118646 - DNA, 1002 bp, Homo sapiens
aagtacgttttcccttttggttcttaagatatttggaggtttatactcaaaatatttggagacatcttgtatgatgatggttttacgtacattattgacatgtttccattcttttcctacagagtcttcaggcagaaaggaacaaaccaactaaaaatatgattaacattattagccgcctacaagaggtctttggtcatgcaattaaggctgcatatccagatttggaaaatcctcctctgctagtgacaccaagtcagcaggccaagtttggggactatcagtgtaatagtgctatgggtatttctcaggtgatgtattgtcatgactcttggctgtttgatttttttaagtattattatcatcattgccatttacagaaataatactattacaagttgtatccttagtgaaaaggacatttgccacagtttgaaaaacttgagaaaggagttgggggggtatatgttttaacttttttaggcacaatttttaaggtttggttaaattttatatgtattctcaatatttaagggcaatcattggtactcttttgtttaggtatttccctcctgctgtgtccaggattgctgtgtggtggtgatgagtgctgggaggtgaaaaattaaaataagccatttaccagtcagcatcccaattaaatatttgatgtaactgtgatctttgagccaggcttatatattcattttcaagcagaggagttccccattttaaatagaggcattgtctgatgtgtttatggttaactgcatctggcttgggtctttctgttttcctttctttgctgaattggaaggggttactctgaagagtccaggtcttacagtgtggtttatttctcaagtgtgaatattgcacaccttcatggcttgaaaattagaaatgtaaatatgctggaaccagacttcataactgtagactttgttatgtcatcattaaaaagttcgaggtgttgtaatcccagctactagggaggctgag

SEQ ID NO: 118647 - DNA, 1448 bp, Homo sapiens
tcaactacctgctctgggagagaataaaaaggtatatgtacactcttctattaatatattagtatcttagaactgcgtggaaccaagcatggtggtatgtgcctatagtctcagctacttgggaggctgaagcaggaggattgcttgagcctagaagttcaaggctgaggtgtgctgtgatcgcacctgtgaatagctactgcacttcaacctgggcagtatcatgagacttcatctctaaaaaagaaaaagaaaaacgaactgcatggaaagtgctgaaaccgggaatggatttcacttttatactgaaatttaatcattcacatttgagattatgaacatttatgaagtagcctttcccctgggtctagcatgttgtgtgattttttttttttttcacttaattccacaaggcatttgaggtagccaattgatacacagatatcactgaaatagaatggataatttgtatacatgaatttgattctttttcagttaaaaatatacaagcagatccatcataaaatcaaacatggttgaattacggcccaaattaatgtttaagtctgagtttgttattaaatgtgttattaatgaatgcattggaacaaaatgtttatgctcctcttaaaaaaatctttctctctttatgtttatgcccctcttaacagcctttctctttttgtctaccccaggttatagttgacttttcctcccctaatatagctaaagagatgcatgtaggccacctgaggtcaactatcataggagagagtataagccgcctctttgaatttgcagggtatgacgtgctcaggtatgtgctcttgccttgcgtactattctctttccttattttcttgtttggaaaattctatagaacatggaatatctcactcaagaaagaacattcgactaaatcagtggttcatcagcttagttcttctttacaaccacccagtaagcttttaaaatatgtcctgagcctttcctctgaaccttttttactattttatttttttagactcttagtggaaccaaggacaaaactccttcattctacacatgtttcttgaggacctcttgtatgcaatgggtttatatcctagcagggagagaagtagtaaagaaacaggttgttttgggccttgtaagctgtgagaggcaattgagattttattctaagtgtactgggaagctattagagagttttagtttgtgaagcagggtgatcaaattaaagattagcctgggtaccatggctcacacctataattccagcactttggtaggccaaggtgggaggatcactagaggccaggagttctaggccagcttgggcaacatagcaagaacctgtctctattttttatatttttaaagaaataaaaatttttaaataatacaaattaaagattactctggttacttactgtgaagaagctaga

SEQ ID NO: 118648 - DNA, 1041 bp, Homo sapiens
cacggaggttgcagtgagccgaaatcatgccactccagccactccagtccactccagcctgggagacagagtgagactctgtctcaaaaaaaaaaaaaaaaaaaaaacgaaaaaaaaattcattcaggaccacatccaaaatggagattggaacacagaaaattcagtcctacctgttagctattctgtactaacccttgaacacaaaagtattagctgaagtagacttttgtgaattggaaaagtgtaaagaaaactgtggtgagatttttgtattttttaagagaaatgatttcaaagttctttggcatgttcatttgtaacagtattctcaactattgagggagagcacttgttctcgtgtttgtactttctcactgtgtttgtgtgtgtagaaatgtgtaagttctttttctagaaatacaggattagatctttttacacaccttactttttaaaatatatatatatacaggaatctaagaagaggtttgatactgaggaggaatttaagaagcgagcatatcagtgtgtagttctgctccagggtaaaaacccagatattacaaaagcttggaagcttatctgtgatgtctcccgccaaggtgagtttctgggctttgttccttcgtccagcaaatactatgtatatcatttcctggagtcttcattttgatttgactttgagtgatattttaaccttctaaggacaggcaaatagattttttcttaaatgtatttctgaaacaaccaataaattttgaacctgccataagacaggcaggttcaaatcttaactttcttagaagtcagcaaaaattaattagaaaataaagtggaaaataaaaagaaatcttattcacagtagcaacaaaacctataaaacacttaggaatgaatttattcagaaatgtgtaggaccaaaatgatgagaagtgtacaatgagatgtaatagaatgtttggatagagtgccagacccagttccctagttctccaaatttatttatgattttaaggcgatttcaagttttctaacttg

SEQ ID NO: 118649 - DNA, 1054 bp, Homo sapiens
gtaatcccagtacttggggaggcccagacaggagaatcacttgagcccaggagtttgagaccggcctgggcaacgtagcaagactgtgtatcaaaaaagaaaaaaaaaaaaaaaaaaaaagcagttgggaaccaagtttagtgtttaagtgtggaaaactgccagaacatctgacctgtgctctgatagcaccctgagtatccaggcaaccttgatggttaacattttccaaggtttctaatagatcatggtgaggaaaaaattatgtgctttctttagctctctaataaatatatttcaaaatattcttagaataactaaatatttacatagtagaatgagtaagcattcattttccttcagggttcttttaactttattaatgaagtgttttttaccccctaggatttgtgcaggtggatgatggcagaaagattgtatttgtcccagggtgttccataccattaaccatagtaaaatcagatggaggttatacctatgatacatctgacctggctgctattaaacaaagactatttgaggaaaaagcagatatgattatctatgttgtggacaatggacaagtgagtttgtaaatttgtatgtgttttacattgactgattagaggtaagacagtatggtgaggttggtgacatctgacactggatgactgtaaattttccccaaagactaagattcaggacatcagtatagcatagaagaaagaagagggtttggacccagccaaactggacacttcctagttttccagcttgcctccacaaactggaacctctgaacttcagcaattgttcctatcagtagggttattgtgagacctaaaatgtaattgaagtttttgcatgtgaccctgcccttaattcagttgctttaaaaacgtttgaacatagtagaaaatgtaacagtgttgctcttagtgtttctcatatatagggaataaaagaagaggttttataatagcacttgtctcacaagatttatgagcgatttgaattttacagatctattcctaagcaaaagagccttaagtct

SEQ ID NO: 118650 - DNA, 1006 bp, Homo sapiens
attctagaaacatatattttgattagtaatttttctaaaaaggtgaaacatctaagccaaacttagtattccaagaaagcaaacaaattaacaaatatcttctttctctgttaggaaacttattaaaggtaaatatgtagagagtgcttttgagggctagagcataggatgctttgagttgagggctagagatgaaagacacttgaaagcacagtgtttcatgtagtactctccttgcttgatgactggcataaggcattgttaccattggcatcaaccctctcttaatagttctcaggggcaatatgtaccttagagatttaaaacatatgttgcagttttgtggtcaggtctctcaaaccttcattttcaaagatttctaagttgaaaagtctgtttcaaaatctgattgggggttttacattttttaggaaaaagtttaaaacacgttcgggtgaaacagtgcgcctcatggatcttctgggagaaggactaaaacgatccatggacaagttgaaggaaaaagaaagagacaaggtaattcaaagccttataggcataatgtgtatcaagcattgtgatttttcatttttgtttttattgagagaactgaggagaagtgtgaggagtcagtcccacctaggacaaggcttatattgctctgactttattgcacagtaagtttattttgtgaattgctgagcatttatttagaaaatatagttcttggcaattaaaaaagaccttggctttttcctcctttgttaatgtagcttagtatccgtgctgcttaacagcagttcccaaagatgggagaatattgcagactgaaggggtttgattcgtcagctcacatcagagtctacatgtgccatgctccttcttgggagcatttgtagagtggtcatagcagtcagttcttgccacccaaggccattgatgaaccttcagagcaggcaacatgatggcctttcatggcacccttagaaaagactatggttcagtt

SEQ ID NO: 118651 - DNA, 1024 bp, Homo sapiens
aagttatcccagaatccctaaacctggccttaactgcacttgccgatactcttctagatgctctatgtttaaatacctagaaagtgtcacctgatcccctaaaagaattatatttccatttttagtattatgaaatgctttagatctggctattagttttgcctaatagtatatcgtataataaaatacttcattttataggaacttctttttaatcggtgataatttcgagtggagaatgagtgtgcctaaaaaaagggaacagtggtgattgcctgatgatttttttgttttttttaaggtctattgcacgtctggccaatattgatgaagaaatgctccaaaaagctgctcgagaaaccaagattcttttggatcatgagaaggaatggaaactaggccggtgcattttacggttccctgagattctgcaaaagattttagatgacttatttctccacactctctgtgattatatatatgagctggcaactgctttcacagagttctatgatagctgctactgtgtggagaaagatagacagactggtgagtgtcttttttttttttttttttttttttagtgagagacacggatcttgctctgtcccttgggctggagtacggtggtgaaatcataggtcactgaagcctcaaacttctggcctcaagtgattctcccacttgagcctcccgaatggctggacttacacacgtgtgagccactgcacccagctccaagtgtctcatttagtagccatattagggatggggtgccattaaagcatttgaattgtgtgggagtggttttcagatttattttattcatggaaacttccactttttccctaacagttgcacagtgaaccatatcatatataaaagacaaaatgtgaagtagcactttaaaccagaaatggaactctgcccaatcagtctacttttctacaattaggcacatgagatggaaccttaggactccaaagaaaacaattggaagatgactgagagtaggatttttcca

SEQ ID NO: 118652 - DNA, 2143 bp, Homo sapiens
atcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttactatgtgtgcctttttattatttaacttacatattcccacattttcactgtgattaaatgcaaggttgtggttagttctgtgagagcaagaactttgtaaagtcttgttcacctctagatccccagtacctggcacagagaaggcattgatgaaattcagggcttgcatttattaagatgtgaaaacttgcccccctgagaccatgttatcctgcatcagaaatgaatgttgttggctttttggttttgggtttgtttttgtttttgtttttatatatagtctctttgttgactgagctggcgtgtagtagtgcagtcatagctcactgcagcctcagcctcccaactagctgagactacaggcatgcaccaccatgcctggctatggttttgtttgttggttaggtgttt

SEQ ID NO: 118653 - DNA, 1678 bp, Homo sapiens
acaaatcagaatggtgtgcccttgtgcaattccacatggcatgcagtgagagtgtcaggcacagccacaggaagttagtttgttttattaagtaaaggggagagggtgcagaattgctgttacagtcctggaagctttagtgtctaaaggccacacttttagaatacgtatttcagtgtgagcctatagtcccagctattcaagaggctgagatgggaggaccatgtgagcccaggaattcaaggccagcctgggcaaaatagtgagaccatgtctctaaaaataataataataaataaaaatacatatttcaaaggtgtgtagacatcaagaatacagattcagaaaattttttataatagctaacaacgcagaaattggtaggtttccaaatattattaaacaaatagattgtgcatagttgtgtgttctcaagtggttaatattatatgctaacttaaaagctgtactacataacagttatttttaaattacacagggttactttggagcagttggtgcacttcttgggctgccaaatttcagctaaagcatcaggtctctctctctgctaataaatgtcatccaagaggaactaaaaccagaggcattattactgcattgtttgtcactgggaaccaaaggataaaagagtagcataagctgctgaatgttgccatattaaaggagagaacttggtaacgtgaagtatttctcattgaaatgctttcccttttgtatatagccagtgttaaatccttaaatgcaatacagcctctgattattgagcttcctcttaaaaagatttttttattttatgtagccaacattgcagtactgtatgctcaaacacaaatcttaaagtatcggaactgtttagcttatgaaaataatcgactctgaatatttgttacaagtctgttttatgtgttttgattactagtgagcagaaaataacataccctgtattcaaaattactgaaatggcaatcaaagatgatcatttttatgtgattttagaaatgttaaggcaatactactaattattgtaggtttttttaacgtatcacccaaagcatgtatgtgatctttccccattagtatctttttctcaaatgccataattaactgaaatactattattaaattttcatgagaattctaaaatgaatcctgggaaatgcacgtttggtgatgttgcactttctgtattttacaggaattagtcaatacatgttgaaatgtttaacattttaagattggaggcttaattactgggagtctgtctaatgaagtcctgggactattgtaatggaatatgatttgagttcactgtgctctttttgtttgtttgttttggtcatatatacattcagaacttttattttaaaacaaccacaataacattaataatagaaaattcatctgtaaatattcacagtctagtcactgaaaaatgggaaaacctctaccatgccttattattaccctttgctgtttgaggagccagaaatagaggtgcagttagaggacggtcactttttccaacaaaacccactccatagccatgtggatttttatccaaaggctcaacaaccagagggaatggtgagacctgataactaaaatactgttattggcaagggtttgaaatgtgtaagaacctaggagggaaagg

SEQ ID NO: 118654 - DNA, 1099 bp, Homo sapiens
aatgaatgaatggagtgactgaatccataggacgaatacttttgtatttgtatacacagacagataggtaaaataactttgttattctctagcctcagataattataaataattttcctactgccactataaaaatgactggcagaacactcaaagataatgcatagatgggataattttttggtctgcagaaatgtcacacccattaaagatgtctggcatcacaagtccctgcccactaaatgtcagtttggtccttccttcctccccatcatttagaaaactagcagtgaggtgataccaccctcactgaggaccagtggactagatgaaatcccgaaagagattctgacatgaaacaaaatgaaaatgtgggggtcatagaccatttttaatttttgtaaagtaatacaggaaaatcatatagttgagtgtttttgaatgtcatccttttttgtttttgtttgtttgttttaacagattggaaacctccacctgcacaaactggatgaacttgactgccttgtaaagggcttgctgtatatagactctgtcagtttcaatggacaagccgagtgctattattttgctaatgcctcagaacctgagcgatgccaaaagatgccttttaacctggatgatccctatccactgcttgtagtgaacattggctcaggagtcagtattttagcagtccattccaaagacaactataaacgagtgactgggacaaggtagtgacctttttggttgtattgctgcattcacattgttttatacacagaagttatgaaatcagtataataatgtcattttcaccagtaaaagagcatgtatttgcacaacagcaaaaaaaaaaaatatatatatatatatattttttttttttaagtgaaagagggtgccatgttgcccaggctgctcttgaacttctgagctcaagcaatctgcctgtctcggcctcccaaagtactgggattacaggcatgagccactgctcccagccaacagataatgtatttttataagatgtgtatgtcaagactcaaactgaaattattaaatgtttattagtcagcatcagttgggatcaaaattt

SEQ ID NO: 118655 - DNA, 1167 bp, Homo sapiens
gaggcagaggcaggcggatcacaaggtcaggagatcgagaccatcctggctaacacggtgaaaccccgtctctactaaaaatacaaaaaaaaaaaaaattaggcaggcgtggtggtgggcacctgtagtcccagctactcgggaggctgaggcaggagaatggcgtgaacccgggaggcggagtttgcagtgagccaagatcgcgccactgcactccagcctgggcaacagagcgagactccatctcaaaaaaaaaaaaaaaaaaaaaactttgaagggaaaaaggtaagttccacatggaacatgtgtcttacccaatacatattattgcctgaatgcatgattcagagtaaatgaagtttgtggctaactggtttttaatttgtgtttctaaaatggatatatatatatatatatatttttttttttttttttttttttcctcccatagctttcccatggtttggcatggacattgggggaactctagtaaagctctcgtactttgaacctattgatatcacagcagaggaagagcaagaagaagttgagagtttaaaaagtattcggaaatatttgacttctaacgtggcatatggatccaccggcattcgggatgtacaccttgaactgaaagatttaacactttttggccgaagagggaacttgcactttatcaggtttccaacccaggacctgcctacttttatccaaatgggaagagataaaaacttctcaacattgcagacggtgctatgtgctacaggaggtggtgcttacaagtttgaaaaagattttcgcacagtaggtatcttttactcaaaactgaaaattgatacctgtttttaaatatgagagtaggtttccatctagcatgttccttaattctccctgcacatgcagtgggaaatatgtatccatggttgcctttcacttggggcgttttaaacacgtttatgagatgagtaaaaattgcccggatttggtcatgttgttgcacataatatttggtaaaacttgtttagggctgtactacaaagctacaataaaaaggggatttggggactttaatgaatttggcagtgtacaaagccagatataaatgaagcttgaattattttcactattgtcctacatttacatggtttttggaatattacttattca

SEQ ID NO: 118656 - DNA, 1064 bp, Homo sapiens
gcatggtgaatgcctgccgccccctagcctttcctcccactttctcttcgagatctgggaggtgccagagggaatttctgattctgatttttgtcaaaccagactagtctcctctcccagctccccctgaattcaggttgaaaagaggcggtcgcggctgtcaggttgcgctggcggcttttagcacctgtttttagggatttccgggcttcctgcttgtgtccttgaaatgccggtgggttcctgggagttgtcactgttgttacagttggagctttcaaacgtacgtgcatgcagtctgccagtgtgtaattgctttggcttgtttttgtttagaatatcaactagttcatgtttgttttagaaaacgcagataaacaagaaagataaagtcacccgtattccccgcacccggagcgaaccgctattaatattatggtgaatacccgtagatatttttctatgcatgtacttaaattctgactatgcttttagaaaggtcgactttcatttgcttccttttatgtttagtcttttaaaaaccttttattccagtaattgacttatttaatcacccagccattgtgattgtcactctttttaagtatagcctcccagaaggactaggaacgtggggattcatgctcatcttagagtcgtattgatacttttgctgtttttacagtgtttcatgtgatctctttaactgttaagaaatccacaactataaaacagggcgctgacaccttccctgcccgcctatcggggttcctgtaaaactcacctgagaggcaacaagccaaaaccctgtgaaaactacaaattcctatataactgtaaggtaatttggtcttaacttcacaggtgaggaaattgaacttagccccagagtaacttttccaagcatgtaccaaccatgtgctatgtggttcataactctaaggggactgactcataatacagtgttctttctcttgcacccatagagcattgtctaagtactttatctggtagtttcatctgttaattaaaatttttaaaaaattatttataactgaatagat

SEQ ID NO: 118657 - DNA, 1015 bp, Homo sapiens
cagcctccatccaaccctcttgcccttactgggtcagcagaagccagttctttggtctgacctaaacaaaggaaattatattaatattaaaatggttgtcttaccttgggggatctttctcctgcatggacactgagaagtcttgctccctgccaccaggatcccaggcagtccaccccgtgccttgaggacttttccacattttatacctacacgaaatactattcttaaccaaaactcatttttaaaatgttattaaatagcttattctgaaataatttcagacttacagaaaaactgtcaggacagtataaacagcttaatcccttcaccccagtcattagcatgttgccccatctgcactccctgtctctccccatgttatacacatgcacatgcacacattgtcattaacctctttctaatccttttaacaatctcataattttaaagacttttaacaacacctgaagctttaaaatgcataaagccctttctccttcacaatcgcctctggtgcccgtaacagcctgggagttgctggaaggacaggtaaatgtgttaccactttgcagacacggaaactgtgacttgcttgtcaagggtcaagggtcatggctcccttcctcaagtgccttgctgcagacattctcccactgtagtgaggacagtagaggggtggaaatgaaaagctgggtcagggtccagagtgtttaagcagatacaggggtgccctttcccagcctgcagttatttctaggccttctggaaaagctcatcgcaacacctgcttcttattcagatatcaactccagctcatttcccagagaagcctccctggcccctgggccaggtcaaatgccttttgaatacaaatgtcttatagcatacaaaaacatatactgtatgttcttgtatgaacatcttccctttctttatagcatctacctcagtttctttattaaatatattcacttaaatagtatctagactctaggccaagagagacagacta

SEQ ID NO: 118658 - DNA, 1051 bp, Homo sapiens
ctctctttatttgcaaaagagattgtgcctcagaagagccaaagggagggcagtttggaggacagctggaggaatttaagccatatccaggaaaccacttccagctgggggaatgatgacaccggccttgttggtggacattagccccagagcgaggcagccagcatgggccaggggagatagaacattgcctggagatggggttggatgaaatgaccttttaggttcctaagggtcttcctgctcaggaccccaaggcctcatgtgtccaaagtgctttctcagacctccatctggaggaaaaactaattgtatttcccacccgtgtcttcctctctgccatcccaacccacctctctccctgacccctgactcccctgctctccacccctcacatcccaaagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtaaggatctcatgactgtatgtatggtggggtggaggggtgtcgctagaataccattttcttaacttcctccagggactctcttcctctctccctgaggacagagactaagaccccaagactgtgatatgccaagaggggctccccaaaggcctgtttgcttctccgtgtcctccaccaccagccaccagcaaatcactgctccttcccacttgaaacagagtcccaggctctttagctgctgttcatctcattgctggccattacatcctttagggcccctgtagacctagtggtgtttgaggctggcagagaggcgcttgcattgtgtttatgcttccttcaggtctagtcaaccgtctcttgaaatccacattttccagacacttagctaggagctagggatacaaaaatgaccaagacagagttccttctcataagaagtttatagtcaggtggacagaggcgtggattcattagaaagagaacataacatctataagccct

SEQ ID NO: 118659 - DNA, 1048 bp, Homo sapiens
atatccaagccttcattgctcttaatttgtcaatcccttagaatgttgtcaggcaaggaggtcccacattatgacagtggattggagaatgtgggagggcctcatgtggaacaaaggcaaagaacaaagcctccctctcagttactttgagactttttctccaaacagtggagggtaaaggacctctggttctctttggagcctttttgagtttctccctgtgagtggcctacaagctgaggatggagtctggcccggctttcagcaaatgctgactccgcctgcactttggaaacatgaccccggctaggctgcgagctggctgccatctgtcccgggccagtttaatccacacatcttgtagagagaaggaaaaagtgaaaaagctgtcttgaaaaagagatgcaaagagtcacagagcttcctcaaattgggttactctaccatagttgggtagatgggaaggtcaagctgcttaggaatgagaatacagtttgagataaggaattaaaccattaaaaaatctaaccaatatattattagtattttgtttaacaaagcagattatcaaatcatatattccaatttaattaaataaaatggaaggtacatttaaaagtttgaatatgattttatatatgtatatatttgcatggggaaaaaagcctgaaggacataaaccaaatgatagcaattgtcaactataagtgataggaatttggatgattttattttttaagtcaactttattgagatttaatctacctaaaaaatgcatccatttcatctgtatgattctatttatcttgaccagtgaatagccatgtaaccaccaccaaaatgtccttctgtcttcagccagtcctctctcccatgcatggatcctggcgaacaccaatctgctttctgtcactgtagttttgcctgtagaactatttcatataaatggaatcacacagtatgttaccttatgtagctaacatctttcacttagcgtagtattttgaaattcaccctgtgttgtattgtcagtaatgtgttctttgtt

SEQ ID NO: 118660 - DNA, 1038 bp, Homo sapiens
gatgggattacaggcgcctgccactgtagagacagggttttaccacgttggccaggctggtctcgaactcctgaccttacgtgatccacctgcctcggcctcccaaagtgctggtactacaggcatgagccactatgcccagccagattattttttaaatcatgggcatatattctttaatattaaatttatcaacaagtttgagtgtttgaataaatcagctgggttacggaaaagctaatggtacctttctttttaatctggtgttgtggtcacttaatatgagggcgttagtaatgcttctcaaaccaatggcagccagttgccttactaggcgcatctgttgaactccgtatgtattgattggtgcaaaactaattgcagtttttgccattagaaataatggcaaaccctaaccctgaccctaaccctttgccattggaagtaatggcaaaaactgcaattagttttgcaccaacctagtaagttctgagcacttagccaggtgcgatgggcagtacaggcaagtggtaaggagcttgcagtcaagttttggagaaaaggccaaaaataactcatcagtagcaggggtctggaattcaaggctgatggggacttctagactttcagtgcctcagaatacaaaagaaaatctatcaggaaaccagccagacagggtggaatacctaagccgaatgagctgtaacaagtgaatccaggctggatggcacaaaggggagggagagcagtgtgggagaaggatgaacaggaccagagcagtgggagagagaaggacaaagtaagggagccgtgcagaaagtttgaggatggtgatgtggggaggagatgggtttatagcccagcctggccacttgtggagggaccatgggcaaaccctagtttcttcataaaatgcataaaatacatcatagagacatagtaaagattcaagtgtataatgcatgatcagtgttcagtatgtttgtaatatacacccaaactttgctggctctatgtaagtatgtaggggaggaaaca

SEQ ID NO: 118661 - DNA, 1024 bp, Homo sapiens
ggttttagagagaaggctgacagggaaccccagaagcagggggaagggctgtggccatctttctttaatacagagtcttgtaaaaaattgttattactatctgcatcaagatgtgtcttgtttggagtactggttggaattcctcagcatggaatatcaataaaaaacaagggatttgactgagatttatgtcaggggaccagttctttccatgcctgtagtgccacacacagattcagaggtaggcaagaacacaagctggggctgagacacaatgcccaggaccacagcagagcaggaagggttcagagccgttaaaatccaactcgtaagtctcaaggtatagtaagactaggacttggctaggaattgctgttgattctggtctgggaaccaaagctcacctccacttgatcttaggtagggtattgatttctgattcttttcaagtctctcagattctaaacctgatgattattatgcaatgatgttgggtcgctgtctattcctagttactcatcatcccactagagggatagaaaaactcctatttagcaatcccttcatttatttccgtctcctttgtacctctgaagctgaacatattagtcatgttgtatgacaaggaattcccagctgttcagaaggagagagggagaaatgacagggagagacgccgctatcaataaaacaaagcaccgtgggtgaggtgtgcagcattttggtgttgtcagcaatctagccagccccgagtcaatctacctgtataaggcttccccagtggagctggaagaaaagttgcctggagaaagaaggagaaaaaaagaagaagaatctccttaagactgagaaatacattattttttaaattggcaatcctttttgatgagttaaatggaagcaagttgtgatctaaatcaatggaattgatagtgtttttatcttgaaaggttaactgtatttttgccactctcctaactcccaagcaacttggcttttaagaaaaaagaaataatcctctggg

SEQ ID NO: 118662 - DNA, 1130 bp, Homo sapiens
agagtccacttacctgctcgttggtttcttgaagaaaacaactttgccaattagaaacaaggctcaaaactcaaatgcagctgggtgcggtggctcacgcctgtaatcctaatactttgagatgccaaagcgagcagattgcttgagctcagaagttcaagaccagcctgggcaacatggcaaaaccccatctctacaaaaagtacaaaaaaaattagtagggtgtggtggcatgtatctctaatcccagctacttgggattttgaggtgggaggattgcttgagcctgggagttcaagattgcagtgaactgtgattgtgctgctgcactccagcctgggtggcagaggcagagtgagctacacacacacacacacacacatacacacacacacacccttacacacccttaaatgttccttattaattatactggcttgcattgaactgaggtgtaagtggtcgatttggactcctttcctaaaagaagggtttgagaggggaggagtgagagagatggagggtactgggtcccaacccgcaggaaggagagaagcaggacatgggaagaggaagccaggcaaagactgggggctaggagtgccctggatcccaaaagtctgtgccccagaaacacatggtccagtccaggccgacacatgaccacttagctccatgtctatggctcctgtgagtggccaaaagtctgccaccatgactgaaatgacagagcagaagggtcagaggtgtgaagagagactggagaagcagacgggtcagatcatgcagggccttgtggacccgggtacagacttctatctagtccagtggttggcaaacccattctgtaaaggaccagatattattttaggctttgcaggccagacagtctctgtgaccctattccattctgctgttgtggtgcaaaagcagccgtagacaacatgtaaatgattgagcgtggctgtgttccggtaacctttatttcaggcagcaggctggatttggcccacaggccatagtttgccaatgcctggcttagtctaaggacactgagaagcctttaaaagatattggcaggacgtgatggctcatgcctgtaatcccagcactttgagaggctaagttgg

SEQ ID NO: 118663 - DNA, 1047 bp, Homo sapiens
taaaactgtcccgaaaagcccagatttaatatctggaagattcatttcaggactgatttaatgcaacctgcatagtggtttatttcacatctccaagttgggactaaatcatccttgtcttgttgatacccataatacaatggttggtatttgcaaaatagaccaggctataaaagaatctgaagactctagttgctctaaatgttttttacttaaaaaaaaagataaagatactttataattttatgtgtctaggagatttagttttttttcttctttgctctcagcgatgtcatttaaatagaaataataggaagtatgttcagagatgtggttcttcttaactgttgatttgcagctatggggaatcaccttctttctctggaatcaccacactgcacaaagaactagtgacatctggcattcaatatgacaaactatagaagcaccatccagaaacaattcatcgtttcagtatacttgttcttaagccctgggctgctatcatactttttcaagatgaagacttgaacagagcaaacctgttattaccaaaccagctaatggcacttaccaagggctattaccctctgttagcatttatcacccgcatctcatttgacacttatcatttattgcctgacagttttatttatcttttcttttatcctccccgactgtattaccatctgctgaaagcctgggccctagagttagcccagttcaattcaatcccatctctgctacttactacctaggtaaccacagctgtagaacttaaccgctaatctcagttggctcatttttaaaacaggcataaaaataggataataggattaaattaagtaatatatacaaaatctttaacacagtgccaggcacgtggaaagtgttcaataacatgatagccactggcattaagattaagacaaggataataacactgatagcataaaatgtggtcttaaatgttgctttccatttcatgtaccaaagtcccttgcataaaagtagataatgtgcatctgtggaaagtcttgattatag

SEQ ID NO: 118664 - DNA, 1035 bp, Homo sapiens
gcatttgggaggttggggcccaatgtctccagcccaatgctgctgccccatggtagcatctgtgggtgatactaaggctctctggtcctgtaggtcctgcagcaggactgattctctattacaaagaggctggggaggctgagaggactggggtcaactgagtcccctcccttggtctctcaggcccttggataggttctcaaatcagcagccataagaaagagctaaagggtcaacgtgtatagtgattgcaagcacagacacaagtcccaatcccagcctcattgaaaaccagccaggtaaactcagggaaattgtttcatctcagagcctcactgctaccacctacatttgatgtgactcccccctagcattgtcgtaagaattaaataagaatacagcacataaaacttagtacatagagtgcggctattattgtaacaaggaatttagaaacagtacgcgagaaactttccaagttcatagcctgggaggaaaatcttgtttctaatccaatcatgacattaagcacaagcccaaagattagaacaaatcaagagatatttggcccaggcctagtggaaccactgccctctttctttgtacatggttttgggtttccctaagacgctggctgcctcttcacagagccacatatgcatgcgttttgttgcacgtgttgggaggaggaaacacccgagtttagccctaaagcagtcgggattgttttctctctctcagtgttgatatatttggaataactgaaagcagacctagaacatattaaaagtatagcatgtggagagggttccaggcggagacacagaacctctgtggagaggccaggccagaatgtgtgatcatctctcttgcctaagaccggatactgggccgggcgtggtggctcatgcctgtaatcccggcactttgggaggctgaggtaggcagatcataaggtcaggagttcaagacaagcctggccaacatggtgaaaccctgtctctactaaaaatacaaaaattagccaggcatggt

SEQ ID NO: 118665 - DNA, 1048 bp, Homo sapiens
aaaaatcttgattgtgctacagaagtgttttcccaaatgctttattaagacttgcacaaatgctcaccatttatcagcaggaagtgtttgcctgcttggaggaaaatcaaactagtaaattattttattttatttgcttttatgtagccccctgcatttctgtccatttgggctgccttctttgagcttgctattataactagggacaactcctcgtggcctcataaatcataatcgttgatatttattgctcagtaggtcttttaaaatccagttggaggggttccctcctcccttaaaactctgccttttattttgcttaaggcactatggtaggaaactgaaacatattttcctggtttttacttaaactaaatgtaaggcaagccttatataaagccaacaaaagagagcctgaggtttgaagatgaaggtcagcctcttggtcattgattcgacaagttccaacctggcatttgcaagggtttgtctcgcagcaactgcctatcagacgcctatgatggtccagactctgaatcaggtacctaacacactgctagacaagcaaggcttagtctctgccctcgtagagttgacagtctaatccaggggtcactgatctttttctgtaacacagcagatagtaaatattttaggcttagaatagtccctgtcacaaccactcacctttgccttgtgtggtgaaagcagccatagacactctgtaaagaaatgagcatgaggttaggcacagtgcctcatgcctgtaatcccagcactttgggaggccaaggcaggcagaatgcttgaagtcaggagttcaagaccagcctggccaacgtggagaaaccttgtctctactaaaaatacaaaaatcagctgggtgtgatggtgcatgcctgtaatcccagctactcaggaggctgaggcaggagaattgcttgaacccaggagatggaggttgcagtaggccaggattgcaccattgcactccagcctggccaaacagtgagtgagactccatttcgaaaagaaaagaaataagcat

SEQ ID NO: 118666 - DNA, 1049 bp, Homo sapiens
aatcgcttgaacccgggaggcagaggttgcagtgagccgagatagcaccactgcactccagcctgggcaaaaagagtgaaactctgtctccaaaataataataataataattaaaattttcaatgaaaaagagggaaaaaaagttatttctagatggttttgcttctgtgcatgggtcagaagccagcagttagaaaactgtagttatattcatggctgtcatggaaacaaggcatgggggactggtctttgtcccattattgcctttgggctcttcaaggacaagctggagcttaacatactgaagttggaaagaatttcagaggtcatctaaggaaagactgtgccagctactctcagcattttgcttagccaaacacttcatctctgcttttaccaggaacttacacctaaagaggaaaagaatccatgtgggggatatctgtggcacggcctggggggacggaaggactggggaaagaatgcatttgacctgcgaacagaaggagagagtagagtgacaacagctgccttgaagtgtggatgaaatgttacatgcttctcacacccaatgtgaggcaacaagcaaactctgagttaaaacaggcaaagacaggtatgagtctagagaagacagcaagaggaaggaaggaaaggaatctgacaggcatggaaccttcatcaggatttcattccacactgagtgcttcccagtggccatctcgtgtcatccctgcctcggccctacctcaaaggtaatatgccattttcacagataagaaaaccaaggctcagaggtgtgatgtaacttttcagagccactcagttgacaagtggggaaactgagattcaagcataagatctagggagtcctcaccaaggtggccctaaagcaatcctaggaaaagggtccgccataatccacccagttgctccagccaaaaacctaagactctttcttttctgatttctctcttcacacacacacacacacacacacacacacacacacacacatgttgtcctgcagctagccatcaacaagccag

SEQ ID NO: 118667 - DNA, 1018 bp, Homo sapiens
gttactgctgataccgttgtaaatctatctttgtctgccttcataagtatttcttgggttaagttcttagccttgtagccctggatcaaagggcatgcaatattctggggccttcctgaagccttgccatattgcccaagttgaaatatcatgtgggaggtggaaagagcttgaagtgtggagaaagacaggccttgatcctaatctttgctctgccacttaccaagctgggtgacctttgccaaaaactgatattctctgagcctcaatttccttgtatagcaaaaggatgaaagtaaaagcatttacttcgtaggacggttttgggactcagataaaatcatgcattttgagccttctgtgggaagcagccttccccttggtcattttggaatggtgtacaagcaaggatgcatttttaattcagtctgccttctccatcaacttttacacgcatctcagaacccgggcaccactccatagaacattttagccagggaggagagggcgtgggggctggaatttcaaaggcatgtagaactggtctagctctcttataatgtgaacaaaatttccacaaacaaatggttactagataaaaagggtttgggattggagtcttttgagggctgtgtcccctgctctaaagtgtggggcctcggagttgtgtgtttttgctgcttggtgaacaggatgacaatgtctggttctgaaatcccaggagctgagggaagcccctttttgcccagttcctgttctccgagggttttttgtgaagtgagcctaggagctaagaagagagagagaaatgaggtctgctgatccccagcaaaactacatgcacctccctttcatctgttttggttgaaaacctacgaaggttaaaatagagaaaaccttcagggcaggcaagctatatgtggttagctttgtgtgggaacctgagtcctggagactgccctgacttttgcagcaggcacatttgtatgtttggattttccagaagggataaatcaca

SEQ ID NO: 118668 - DNA, 1043 bp, Homo sapiens
caataagccaagactctaagaataatgtgctttacattaattcaaaccatttatcagaggaatatgagagcagatgctgtattttagaattcagacatggagttattgatcaaagaagaaattaagacttatggttattatagtaaagggcaggagggatgggggcagcagtgcttggagtcctggataacccattcagctctatctacaataatggaagtcagggagtgttggcaggatcagtgtctgctgattaggtctactcttggctcctctggtgaggatttgttttattttgatgggcataagggaggctctgcgcatggaacctccaccacatgcattggtgctactgcttaggaagagggagtgatcctcctgcctcagtccttgaggcccccaagcctcattgcaatcccgggaatctgtcatcttcacctgtctattcagatccaatccccaccctctttctcccctacccccatttaccaaaatctgaactgttgcgtagtcagtccctattggcatgcaccccacagtgagccaaatgcatattaatgaataaactgacacgtggtccaaattacatgctacacaaattgtagcaactttgcttgtgtctaatatcagcattgcgcacataatgacaaaatcatacattgagatagtttctaaatagcgccttgcatgtgaatgttgaatattttcaatgcttttattcttatttaaaaaaatatctttttgggaaaaatataaattagcaaaaagaagaaattcatctaagtcagtacttgtatagaactaaatcattcttttccatagcttcatggtatttcattgtatagatttaccaaaatgatggtaaccattgcttttgatggacatttggttacatattcaaatttttttcactttacatcgtaaacattttcccacatcactaaatattcttctaccctagtgtctttaatgactgaatacttgcatggtattctattgtatggatataatgctaaattcaatcagtaccatataattacttt

SEQ ID NO: 118669 - DNA, 1043 bp, Homo sapiens
accattctactctccccatcatgcaggatctgagtgttgtctgtgttcccttccaaatataaaattatggaattgtaggactttgggaaattgcatgtccacaatttctttttccatgggaaaaaaagggaaaccatatctatggagttacagtggagatgtagcagagatgccctagagcgagcaaccatctgtgtttgcctagcacggaaggattttccaggacacagggcttcccgttttaaaacccagaaagtctcagacaaaatggtcaccataggtgcacatatggtccattcaccagactccctgacaccttaatacaggtgcaggatggcgaagcccagcctagggaggtttctaaaccccgcaggctttctgatggagtgtggctgaaagaaagggggagacaggtgccagccacattccctagaagagaacaccttaatgtgcagttgacttgtttgatctgcttcagctgtgacacagtggtcccatgtgtacaggtagtgcactcacagaaaatggaaccaggggcctatgaggatattcagtccccccacctacctaacaccgaaaaagaagtcatctatatattccataagaaatcatttcgttctttcccgttctggaaataaaagcttcctccataatgggtgggctgccaccttgtggccatgagtgggaatgtgggaaagtacaggtaaccacagaggactaaatgcctctgggtttaaatcaattcggttcctatagggtacgaggcagtgagctagatgcttgtgtggctaagactatcattatgttaccaagggtagagctttactgtgtgcatgtgataaatacgcttagcagtttgcatgtagtatctcctatagtgtgcttaacaaccctgacaggcaggaatcatcaccattttacagatgaggaaactgacactcagaggttaagtacatttttaaggtgacacagcaaagagctaggatttgaaaccaggattggctggccctaaagctcatggtctggaccactaggctatactg

SEQ ID NO: 118670 - DNA, 1434 bp, Homo sapiens
cgggagaatcacttgaacctgggaggtggaggttgcagtgagctgagatcacatcattgcactccagcctgggtgacagagcaagactcagtctcaaaaaaaaaaaaaaaaaaaaaaaaaaaaaaaaaaaaaaaagtagaatgccagacactggtacatgttagtagcattagatattattattctgtttgtaaccactttgaccagcgaatggcaaagctgttagccttggaggtaagatgggatttatgtgggtgtgaaaacagataatttggttgggagtaagaggggattgagatggacagataactaaattctgggatggtacctttcgcctttatggggtatgagcaagttccaggtaggaaaagtgtggaaaataaatgtataggacaatgtcaaccttagggctggttttctgtaggattccagaggatgcctttgattctcagtaaaccccagaaagccctgagagaggctcttcaccagctccagcagcagaggctcctcccctatcccagcactgaggattccattcaccttgtttttctttagggtcatgactcttaccaaggggttgtggagtcttccgaggagccacccagctgtcccactccagggcctctaggacaagggtgtctgcagacagcctggtaaagtctttttcttctccaccgtctcctcctacagccacacaatgagccaatcaggggcaaggttgcagctggaaccctggctcccgatgtcttgtctgcatccctcatacccatcctgggcatcctgcaattcccactgactctagaagccctcagtcagctgctgtgagaaactgacattctgtaaattctgtgttttgcctttgttttgtttgtattatgttataacatcaagagaaacccaagggctttccccagaatggggaaaaagcgggatgattttgatcacgtggctctaccatttactcagtggggaagagaaggtggcccctgaccaggaacaaggtgatagatttctgtgcccgtcttcactttgtgtcttgtttcttttctgcctatcatcatttagtcaggagtttttttttttttcctgtgtacttagaaagtatatgagaaaacagaaactctttccataaatcttgttaggagagagaagaatcctgtagttacttaggatggaaaatccttctaagacaaaagggccttcagagcaggctgtgggagcacattgagcccacagagagaggttgacccccatgggggattttgtctggcctttcacttcctaataccttgttgtccacatctgtgtagtgggtctccatctgtcctgcctgcttctgagagatgacagagggagtctctgaaaaagccaggcgtcagatcctgtaggcggggtgccatgggcatggcctggacaagtgaagcctgacatgtg

SEQ ID NO: 118671 - DNA, 1020 bp, Homo sapiens
atgcctgattaatttttaatttatttttatttttagtagaaatggggtttcaccatgttcaccaggctgttcccgaactcctgacctcaggtgatctgcctgcctcggcctctcaaagtgctgtgattacaggagtgaaccaccacaccagccacattgctttttcctataattaccttcatacccccatgctccctattcctcttttgagtcccctcctctccctactctaaaaacctaccgtttgcagttcccaccaatgtctcccttctctggagtactgctgccctgcaattctgtatgtcaaggggaaaaaaaaaggagggagactttggttaattaccacttcacttggcaccaggaagggtaggctaagagaggagctatagccaggagtctaaaacttttcttttggcttgtttaaattgttgacaaaaatgggattagtttgagattaatcactgaaaaacaagggagataaactcctgggttccagagatattaattccttggttctcatcccagcttaggttatcaaaaccaagaattgttcatttttcacagtttatgaggtttatctttggcctgtcatgagatgctgacagaaaaatgaaattggtctgtttctagtctatttcactttctcattcccactctcataacaagtcaaaatgttccattgtaacacttaaggagggaaaaaaaagacgtgacccgcctatgtgcctgtacttcttgtcattatttggtgtttttttattctaaatatttttattgttcaagccgaactcaaaagataggtgcctctcccttcatttcaagcagaaagtgaattttaagtacttagtaggaaaagttgatggcaaattaatatgtgggggtggtttgagaacttttcatttttctcaggataaggcagacaagacaggttcaaaatacggacagtggcgatgagctggaagtgagaagtttcctcagaaagggctgaaagggttggctgagaattttttttcatttcat

SEQ ID NO: 118672 - DNA, 1040 bp, Homo sapiens
gggaagattaatgtctaaattaatatctagcgataacttttttggccctgagtgcttcagcaagagaagtcatggggagcccaatttcaaaaggcaaaaggtgtgtatgtgtgtacctgcattataactgcattagttaaaggccatctttagttctgattactctcgggaagaaacgctattaagaggggctttctacttggagaaagtgaagatagttaaaactctagcagagcaagtcagtgtatattcagtgaagcagacaggctgcagtgtatgtaggcaaacacatgcagactatacacccaaaatacacacttaacacacacataggtatgtgtcatgcaaactacttacctatccagagattcctagacactttcaacctaatcttattttaacatctattcgttttggatcaaaaagcacgtagaataaggttgggtccaaagggactgcctgatgttccaccccttcatccttggtgatcagggcagagcccctggaattgtcaatgagtcatgatgacagactaggaaaacatccaagatactgagacttggcagtatacaggttgtattagtctgttttcacactgctttaaagacatacctgagactgggtcatttataaaggaaaaaaatttatttgagtcacagtttcacatggctgaggaggcctcaggaaacttacaatcatagcagaaggggaagcagggaccttcttcacaaggtggcaggagagagaagagcaggggaaactgccctataaaaccatcagcttttgtgagaactcactcactatcacgagaacagcatggggtaaaccgcccccatgatccagtcacctcccaccaggtccctcccttgacccctggggattacaatttgaaatgagacttgggtggggacacggatcctaaccacattacaggttgcagttggggggtggggtgggcagggctgcgtgatgagagtagcctggcttaccaagtgcccagggcatgcctcaggcaccatgtatgtgtatccagacactct

SEQ ID NO: 118673 - DNA, 1041 bp, Homo sapiens
gtagtaacagataatacaaagtgcaggccctgggagccttatttattattttccatcagccaagtgaaggcaatttttagatttagacttttttttgatgaactatcaccatggtgatggaattggaaattcttttcctgacaacattgctgttaaaccatttgtttaattatttgcataccatgactctaggaggcccctagagctgtatgcttctctctgtacaaaagagagttaatctcaggcatctcttagtttccttacagcacagagatccaagttttctatatgcctcgtctttaccaggtatggattgaggctcctgggggttccacagaattcatcttgcaaaagatgttcatgaaagaacaagattgaagaaaagaaagaagagcaaggaatgtaccatctgttctgggaaaaatggttttgagcctctctacttcttctctggacccaacagatttggtttctggcacatcacatctacagaatcacctataggccagagatgttggaaggagactttcagtaagtaccttctggtacgagctgggaactctggagtctaagttaccttttctattatggggctggagccatttctgaattcatccctttccttccttgaataatagtgtctttaaaattccagatggattcaagatatatttatgtattttaatcccctctcttaactctgcagctgactccagaaccatatccagaaaggtctcttctaaacatccctccctgatttgggtcgtgcttattagcgaaagagaatgagcttgcttcctgagtcttcctatactttgccctgacccacacttccattcagacctggtctctgaaaaattactagccccaattataatgaacagtttccccatgagaagtaatttaattttgcaaattgttgtccaagtcataagggttggaggtgtctggagactttgggagcggcagttgttctctaatcctgtggccctgtggggatactgtgtacatcagggtaggaatttcttcaagctgaaccaa

SEQ ID NO: 118674 - DNA, 1032 bp, Homo sapiens
tctgtctcccaaagaggagaggaaattaagttgtcaagggcaggatggggatgagggtttagctgaaagaagaaacccacaccatatccttaatctctaaatatgcaagactgtcttaaatggttgaagcaagggctcttctttccagttttatttcctgagaaatatttgagctgtttatacacaattttgtcagctttacagttaccaaaatggactgttaagataacttagcctcctctctgtgggataaatacagatgagcaatgccatctcaaaggaaaaaatgctttattgagccaatatagaaaagtattaaagttgtgtaaacatgcaggaagaagcaagggaattcctaacagagctgacgggctgtgattgcacatgccttgatatactctgtcccaaaagttgaatgaaaccctggatgtggtcgataggaattagattacgtgttgtgagggctttttttatttccaagttaaactgtttatatctcatctaaatggtctcatggcatctaaattttatttcaaatcatgatttcaaaaatatttgttgctgctatatggttgctgctatacactaaatgatagggtcctttgaaattctgactcaacaatgtgaatcaaacattggcttttgttaaaagggatagtgaagttcagtattgtattgtgccctgaggcgcttgcattaggtagggtgcctttggctgcaagtaacagaacaatccctgtttgaattcgttttaataaggcattgtactgtatcacgtgataaggagtcgtttgataggggttgctccagctgtaagatgtcctgattacacgggacatcatgtcatatgtcaagtcagtgttgggactccatcctgatactttgattagtggtggtggaaggaaagggtatattgtttttctatttcaagacaaagaacttaactcctggccgggtgaagtggctcaagcctgtaatcccagcactttgggaggctgaggaaggtggatcacgaggtcaggagattgagac

SEQ ID NO: 118675 - DNA, 1022 bp, Homo sapiens
gagaagtatacttcactcttgcagagaagtgccttttttagaactgcaagatttaaatgagggaagagatcaatagcttattttttcctattcatttccaggaagggatcttggcaccctatacctatccacttgggttcctaagaggaactatctttcatgcgtctgattgctggaaatagggtcttgtctaacagaagtggaaagtactgacttcattgttagccttagagagtaaactcagctgctttattttctgaagcatctcccaaatattctaatctacccagattgcttctgttcttcaaactcctataatatatatttgtagcagaaaaaaagtagaaaatagctttaagcctgcctttctttcccaacatttcattataagaattgaagaatatctgacatttacttatataactgcattggggaaagaaggaaggacaggcactgtaggactaattattctatggaagctttagtgtaagtgctgagagcgctgtaaatgtaatggacaagaggaaaaactctgaatgccttctgaacagccctccctgctgtctccctctcaaatcaaatccatgatagatgccactctgctgtactcccatggtatccagtactcggctccatccggcactcatcatactctgttgtgattacctgtgtgcatgtttgtcacctccactagactgagatccacgagaacaaggactgtgtctcattcacatctttatccccagtgctcagcatacagcctatgtgctcggtatatgtttgtcgaataaatgattgagcaaatgagtgagagagccatgtgaagtagttggggccacgtctcaaaagaagtgttactgaagaaatattaggtgaatattccagatatcagaattgatttgaatgatattgtacttctgaaacctaccagagtttgggcatatgatactaggaatcatggaaacagtgacaaatgtggaatattcatccagtaaacaaattgtgggtagctgaacattttt

SEQ ID NO: 118676 - DNA, 1095 bp, Homo sapiens
tgaaccaaactagagttaattcagttggctttcactttccttcctatttttcgtgaatctaaattgatcccttgaatgtttgatttccttttcctttccggttctgaaggacccacaaagtctacttttattgcttctgacaacaagtttagaagttgacatgaacttcctggtgcagccaaccttcaatttttcatctccgttttgcagtgatttagatgcagatcttgatggtttgctagtgacgttttcagataaaacaaaagccagtaagagagaagttatgtcagataaccaaccagggtccataagacagcagagcgctggaaggctgctgaatctaaatgcgaaacataaatagtgccaacaaattcattcaacacatatttctgcctattgtgtgccaggtacatggaaatttctggaagggtggaatgtgatctcgccgtgatacctatggcgtctttccatgtgtattcttcctcttcagaaaggaaatctacacgttacagttggcagcaagctcaacgtgaagtgttatatggtcgccaaaaaaaaaaaagtgctattataggctgcgtagtatccagttcaaagggggcagtggttaaacaaatcctaacattaattggcattttatttgactataaatttcataagggcagacacaacgttggtcttgctgctcaccacattccaataacctagctcagggcttggcacaccatggacactgaatagatatttgatgaatgaaccaattatctgggcacagacccaatcgtggcaaagaaacagaggccaactttgtgctgggtaagctggtcagataggataattatgggatggatgggtggatagactgggtaaagtgacatcagaggaagtgagatgagattttgttttggacaaataagatggggataactgataatgggcaaataaaactcaaggttcactctcaagaaagagctcacaggctttggggatttgtgcatgaggagatacagtgctgcattcctaactgtcgagtgactctgctttaattaggtttgggcagtaagtaggaagaacagtaagagactccttaacatc

SEQ ID NO: 118677 - DNA, 1009 bp, Homo sapiens
ctgcaggtttcgctttgcacctttccactaatatgacatatgactgtttaaccatatgaacttgtctcctctgtgcttctggttcttcaaggaccatactaataatttccataccttcctcaaaggcaaagttttgaggataaaattaaatagtgggaatgaaaggtcagaactctttgtgtcaaggcaagcaattaggctgggttctagtttcgaaactgccagggaaaagtcctctgaagctcttatttccgtttcattaaaatgaggaggtcgggctggaaaatctctttggtccctcataggtgtaacgttctgggagtctatatgaaatattcaaaaggattcatcaacagcaaatccctagaacatagtgctcctagaattgaatcaatattgaaggaaatccagtgtctcgggacagaagatgcacagagaagagccggactgacctttcttgtagctgcagtcacaagagacttatggcacgggaagccgtaacactcatcatacagccagttattgcatgtgaagtgtgtgaaatttggcagcagaagaacctgggttcaaattttggctctgttagtttccagctatgtaacctaaaacaagtcattttacatccctggcctcagtttccatctctgtgaggaaaaaagaaaaaggacaatactcatgctgggtcttgtgagtggcaaataagatcatatctaaaaatactggcatattatagggcctcacacatagtgggcattcaccaatgtgaccgccattgcttttattggactaaatcagagaagacaagtttccatttcaaccacccaaagaattaagaggcagtggctcggagccaagaatacttcaagcaggcaaagaatgtttgttctgtcccttgcctcccctcccgacttcagttagagtcctttcaggaagtcagaggtgggtcacagggttttaataattccagaaagagcatctgtttatctgtttaaaggagagcaacagaatc

SEQ ID NO: 118678 - DNA, 1072 bp, Homo sapiens
aaaaatatttgagtataccatgatgatttccttgggcgaaaactttacatgccggtcaaagggagtggagaatgttaatgcttttgctatatagtaccaaattgccttctagaaaaatggagcaaagtaaacttccactagcagggtatgaggattgattacttcttcatatgttgtccaacactgggaattatcattgttatcattaattattttcctaggtttcaaggcacagggaatggtggttgatttaatttgcactttttttggtcttgtaagttgagcgttttttcatgcatatgttggccatttgaatttcttattttgcagattgcctcctcttgttctttgcccattttgggctgtgatgttaattttggtgtgattatcttttgaaggattcagatggtcctactttaccaaaaataattttccccacttactgtctgtattacctcatactaaaggggaagataggattgaccctgggcttgggactggagaaatgtaatggtagcactgcaatggtaccactgcagtcagaatataatttaacaaattccagactgctcaaaaatagtttttacattttagtgccagctatggttgtatttgcattattttagttagactgtgtttgagtcctggatttgccatttactagctttgtgagcttgggccaggttaccgcacctctctgaggctcagtttcttcatctgtcaactggaatgacacctgccttgcacactttttgctagtaacaaatgtgatgaagttcatgaaacatagtacctggcacaaggatggcagccattaagagatatttaagagactatatgtatgatacctaattttctactcaaacgtgttactttaaagtagccttgatggaatcataaaggtctccctcaccctctgttcctccctctttgctgaagggacagagaagcaggggtgcatgctatgttgggaagaagccttccagctcctatggaatgggctatccgggaggatttgcagagatcttgccctcgttgccccacagtggcatgggaatagcagtgctcccag

SEQ ID NO: 118679 - DNA, 1070 bp, Homo sapiens
aaatggggtggttagcctatgtaaccctctacgctcttaaaaaacaaaaagaggtatttgtgccccttggccttgactgttctcacaggggccacgagagcttctgaaggacacgttggggctgtgaggaaaggccgttggctttaggggagggttgccatttctgctgaggaggctagctgtagggaaaatgagggcctctgaaaagtgatttggggagccctcatggagtaaagggtgctgctgactcttgccgctgcaggctggtgctctgtggctgagtcagatggaggtcaaagacaccaacgttggaccagctttgaaaggtggcaagatggggctgcctagcaacacccatgtcatttctgcctgtggtttgcacgagatccacccagctgtgaatatcacagaaggaattttcacgaactcatggacctttcattactccagaaatgagagcgatgacagagcgtaggcattgcatgtctctggctggtccctttaagacgacgatttgtcttgctgagctggggcaggctgtgttgggtttgggtattgacaccaaacagttctgattcacagcggtaacctccttcttatttccatttcattaattttcatcaaggcttaaacagccatgcatgtggcctggatttggggaattggggtggatctggacaattaaaagtcccttaagttttgcagtttatctctgagtagagcaagaccaaagaaaaaacccctcccacgcccctttgctgctgtgttagttgaagcgatttcagtgggattaattgactgctggaatgatttgcattttattgcccaggtctgctcactgggtcagaagatgtcataaaagcagaaaccccaggttgctgacagcctcagagacaacaggctgctccacaaagaaattggaccagccgttctcattctttataactcagcagtgtaataagccacatgtgtttccagccgacctgctctggctctgagagtcagattttgtgtttttccaggagcccaggaagcaagtaaaccccagtagaagttggagggctgaattt

SEQ ID NO: 118680 - DNA, 1010 bp, Homo sapiens
aaataaaagctccccaaatgtgcagaggccaggggtgcattcttagtcctgacctcacttttctcttgaagcaacaggagaaagcactgcctcacatccctacaaagtgagcccagctccagaaatcaacagcagacaatagagatttgcctacaaatgccctgggcctacctgggagatggcagcattaccaacctcacagcaaaatatagttgaaaatctccactagacacttctgtcctctacccctctcaccaccttctggactctgttttctcctcccctgccacagccaccccctgcaggatgcctccctagcagttagtgctttgcagaatatccgggggaagaagctaagttgttttgttgttttgttttgctttgctttgttgtgaaacacaaaatagcatgccgggagggtgcaagatgtcaagctgctaaatatttactcagttgctgtattgctgactcttattgctggctagtaagtagttgcaagatagactctagtttttggacggcactttgcatagcactaatcttcagccctttccttttatgctcagcagtttctcacttcttagcttctccaaacttgcattctcacaccatcatcctgcccaacaaagacttctcctttggatgtccccctgttagaaggcagtcaaggccaagttaattataccagtagtgctgaaatgaacatttgggcctaaacctttgtccacatttctgcttaggatagatttcccggagatgaattaagggtcaaaggtcaagggcattcttaagactcttgacccacgttaccaaactgctttcagaaagtttgcacaaattttcataatcaccagcaggagttaagaggtccagcttgactgaatccatgctaatactgacatcagtttgattttcaaaatttcatctttgctgtagtgaagtcaaggaaaaaaatactatctctgaatggttctaatgtgcatttcttttatttttagtcaagccgtata

SEQ ID NO: 118681 - DNA, 1060 bp, Homo sapiens
cttgatcctccaacttgtgcctggggagcagggtttggacctaacaaagggcagatgagaagcagcatctgggaccttttgcagggtggtggggggctacagagcaagctccaaggcaccagtgccaacctgacagccctcctgctactgctgctgcgcctgactgcctcctccaacagccccctctggccagaaatgtctgtggctgctaagctgacatcatcgtgtaactactcttcgtagaataaacatctccctggtagtctgcctttgatagttttaacagttctccaaactgtcccaaaaaggtgaaagcatattggataaatacaattttgaaaatgcgtctacatgtcacagtgggattcttttttctctcctttctccctccttccctttcttccttcttcccttttctcttccaccttctacctttcttcctccttttttccttccttcctctcccatttcctctccccttttcctcctccccatttatctatccatcttcctttcattcttttgtgggtaaaacacaagcaaactgtaataccacatctcacacttaatggactaagtggggaagaaaagtgaggatttctaggcagagagaggagttttaagttacaacttcttggccctataggcagggaacagtgcacatttcaggtagagacagcaaatggtaatgtttcaacactaaataggttcccagcctcatgggtcctaacaaggaatcttaacccgaggttcatgggtggcactcaggagctctgttacctgaaattgcagacaaactatctatgcatattcctggggaaatggtccaccagaaccatctaaaaaccattgttgttacaacccccaggaacttaaatgttggactagctgtcttttgacctgtctgcactctacctcttctccctttaacagtaggacgacattgtaatatagtggttaaaaatgcaggcttggagtcacgctacctgggaaggaatctcagctccactcattaccagctgtgtgaccttaaatatttaatatcactgagtttcaattg

SEQ ID NO: 118682 - DNA, 1067 bp, Homo sapiens
ctctttacctgctttcatttacaaagcattttcttccactcttgcctttgtgctacgacaatcctgggaagtgggtatcattttccccatttgactaataggtaaacgaagcctcatctagtttgaaggacttgaccccagttcacaaatctttcatgtgactttgccaggactgatcccaactgttaagtccagggctttttgctgtcctctccttcccgtctgactcatgctgtttaccactgttttcttgggcccaaggggattccatgttcaccattcttcctaggctcttctagctttggactggatccctcattctgctggctctgctgcaggcttgaacctacctgtttgtatagaccacacactctactctgttttttcacttacccccagcattagcagtgccagagagaggcttggcagggtgatgagataagtgtacgtgaagcagaacaaggcgttccaagctaaaggccagtcatctctctgacatctgctccccaggaaagaagctgctttctggctcatggtcagtctgctttcgttcagataagcccagcaagtgggcctggacctgcctcttccagctggcagatgccctccttgccttcggggcacaccttagatgttatcttttccttgcaacattgcctgccttcttgacctaatgcagggttagatgcccgtctggtagcacttgtcacactgtgttaccatcctccccttacctgaccacctcgccagctacaccatgagcatacattgaggtcatgaccggcattctgtgtcaggatatggcatggttgggactaagatgagctgggaaggcagactgcctggatttcaaccccagcccctaatagctgtgtgactacttacaggctgaattgtcatatctgtaagatagggctaataatcatttctaatcaaaaggttatgagaataaaatggcataaagtctagaaaacagtcagcactgtgaagagcacacagtagttgctaaacatgtgttagtgattctttttgcatccccagtgtctagcacatggaagggaaggaac

SEQ ID NO: 118683 - DNA, 1049 bp, Homo sapiens
tgcttaggaagcgctgtggcctgttcttgggtgtcacgtaaagggccaaggagagaacctagagttttcaaatttcttcaatctacttctgacttcattggcaatatttggcactcaccttgtataggagaaacagagttctccttttgagaatagagacccctttgggtcgcagggaatagagtttgttagatatctccaaagaacgggaaccctggtacagcttgggtgagactttttaaacaaacagaattctggctaacaccttctcttagtccctagaaatcctccattcctcttccccacatcaaactttgaggtagagctgggattggcagcagcttggctctgccatcgtgtccaaattccactatttctgtcctgaatttgcatttcctggcagacttgagccaagtcccaatgaaacagccatagcttttcaaaattacaggcaaaatcaggctgggaagaggtgaggggggcagggaggggacgggggagaacatgcacagtaattgtcacgaagggcccagtgatgtggatctggactgaggaagtcatttcacatgatctttgctcactcacttccagtttggctcttccagctcctcaatccgggcatggagccgtgctttttatagattgtaagtccattgtggagttatgtatcctggcagtttgtaaagtggtgttttctctatttttatgggtgccctaggacagtgcaggcacacacacctttcttggtaccttctcattccacgctacttgtgattaatgaagaaggactgccacctccagtcgcttcacaggatagacttggggcagcctctgacttgctgtgtgtccctggtggagccaaccctttcaagccccctgctccctgccccctgctggatattgtgggagtgaatgagggatgaggatgacagtaaaccctccctgaagggttatgtaaatctgaaaggctctgtggactttgaggctggcctagggaaacctcaacaaatcagctactccttgcttccttgctttttattagattccct

SEQ ID NO: 118684 - DNA, 1034 bp, Homo sapiens
gtgctctgtgtcaaccatgatgtcatttgagagggccacccagtccaggtctaagttgtgcttttcatgatgtcaccactaaagtcccttgactatgaatcaaagacatttctcttatgctgacttcttttgttaattggtagtaagagaggaaagaggctctgaggattacaaaatatcttaccctttagcaacatcatggtgttgcctgcgtgaggtctcacatctctctctgtctctctttctcctttccctcttcctctctctctcctgctttccttctctctgtctcttctttatttaaatacatttgctttttaaatttttccagagcacttgtcacttcagaacataaataggatgtctaaaatacatgatttttaaaataaaaatttatcaaaggatcctgcaaaggaagatagtcctacaaggtcctttgatgtctaacgatgtgccattggagagctagaaggcagcaaagcccgactttctaagataaatgtagcatctcttgcaataattccatgggccgcttctgtctgtgggtctcagtgcaaacctgccaccatgagatgagctaaaaagcaagcttgcaaaatgaagttcctgaggagtgtgatctctagggccctagttgaggtactcttactacagccaggctgaaagcatatttcagcttgtagcaagctggtttcgtctctacctgaggaaagataaagaactttgctcaggaaatgtgagcccctgttcccaggcttcattcctctcaagctgatggacaggtatggaaggaatgcgttcgttggcaggaattagataatgcccaggcacaaatggcagtcacgttcttttcctccctctctctgctttgggggaaaaatgtggtaggaggggatgctctgcagggagaggggtgcagaacaagctgtctcagcttcagccagctgccgtttgtcactggattctgacaatggcatctggctccgtgagtgtggaagccagggacctccctcacggtgaaggccgagtgacca

SEQ ID NO: 118685 - DNA, 1035 bp, Homo sapiens
caaagtgctgggattacaggcatgagccaccacacccagcctagagaactatcaatataagtatctcttaagagagtttggatttgattgccatttcagcacattagagaggggcatcttactcacacgtgctctcctggtgcaaaaacacagggaaacaatggagtgacgcatggcctttcgggccaggtgcttgcagagtatggcaaattgtaggtttcgatgaacaagcagcttaccaaggaattataacccccgctcccctgccgtgtccaagtccaattccaagtgtcttataaccacagtttgatgctgctggctcctcccccagctccacctttgcctgtgagtatatgtatctttcaaaagtcatctcttatttccagtaactccaaatacaagccgccttttagtgacaagcagatgagcgtgagctgcagtcgcctggagtgtgcaatgctgtcaccagagagaacttagtaattacatttgccaggctcaccgtccatgttggctggcaacatgaagggatcagagaattctttgaaacaatatccaagttcttggttaaaagagatacaggctgggcgcggtggctcacacctgtaatcccaacactttgggaggccgagacaggtggatcacttgaggtctggagttcaaaccagcctggccaagatggtgaaacctcgtctctactaaaaatacaaaaacattagccaggcgtggtgttgggagcctgtaatcccaactactcgggaagctgaggcaggagaatagcttgaacccaggaggcgcaggttgtggtgagccaagattgtgccactgcactccagcctgggcaaaacagggtgtctccaccttaaaaaagataaataaataaagatatatagcattacactacaggatggaagagcccagaaaaaggattccttcttagaagctactgaagagcgaagtgatttcttagggcagtgtttcagacaaatttaaaaaatttatatatgcacacatataaattatatatatatatat

SEQ ID NO: 118686 - DNA, 1054 bp, Homo sapiens
ccccagtgtgtgatgttccctgccatcagggcctactttttatagggtggtcaagaaaggtgtccctgaggatgcacagtttaagttaagtcctatggaaaagaatgaggcagctatgggggagtgggagaaagggaggacagaaggcaaaggagtaggggaggagtgttttgggcaaagggagcagcaagcatgaagaccttgggtccaagaagacttgaacttaagctgaaagaaagccagtctggctgcagcatgtgagagggacagaggccccaggtggttgcaaagagaccgaggggcccactcctgttagaccttattggacttgattctaagctcagtgagtagccattgagaagtcttaaagcagggacgtaacatgatctaatttatgactttaaaatatcctgttggctaccatgttgagagaagatttgagcagataagcgtggaataggggaatcagttgctttttatctatagtctctagaggaaggccagtggatctgcctttgcaatggcccaaagctttgcacatttagaaaacctgcattattaatgaaacatttgcatcttaggaaatgataaaacaggctgctacatgtaaaaattaagtaactcaatttgttttaacagcttgtgctctagtacagcaatttgtttggcatatacacaagactccatcggaacagtaattatgccatgctaattattttactgcattgtgtacatctgacgtttaattatgggaaagtatgtgagggtagattttcttcctccctttgcctgcctgacaggtagttttgtttcccatacctcttttgcacctacattgtctttatgccaacttgtcatctgcagtgaaattgtgtttccatgacagctttgctcagccatgttgcctgcaagttgcagacaatcaccaaaataaacagttgacacagatgtcattctcaccctctcattctgcctctccctcccccttaatctagctcctactataaagattttatttttctcccacctcgagaaggaaagtgatccctgacaa

SEQ ID NO: 118687 - DNA, 1048 bp, Homo sapiens
cacctgaaagctgcccaatatgctttccattgctgtgtgaagcctgaagagtgcacatggcagttgtgaatttcaagggttgttcagggagagaaaatcgttacttgtccatttgccaaataattgggaatttagctaagtcaaagtagcgggtgggggtggggtggggctgaggattcctcctcccctccccattggcccaaatggagtgaggggtgggcgacatagcttgatttgaggcgacttgtcagtatcctgctgtgcattctgaacctggcccacgtcagccgaagtgatgtcttatccagacacacactatgggaaatgtgaactggattgaaatcagagcagggatgactatggggacattcagagccttctgaaggtatttttagaatgcttttaacctgaaaaagggaaagtgccacctttctggagaccgtagagctgagaatgactcacagcgaaaccaggctatacctaatttgggggaagccccctttggctgcttccttgggtccaggtgggagtgcctgttcttaagctctgggaatgtgacataccggggtaggtgtcattacagcccctcacactctgagtctgaaactaggacactcacagtgtcagggaaggaaataattattccctatatttctgagtatggtttacaaaacacatggatagattttctatcactgatggtattggatacactgggcaggcctgctgtcttccacttttctgataaggatcttgacgttcaccatgtgccacgcccacacagctctagagtagactctcagcccatatactcacctgtaagccaaaaaaggtacacgtggtcaaaattaccccgcaaaatgctgcaagtcatccccacgaggcggtgcccagacactttgcccccgaagagctggaagagattagttccttcagtggactaccagccaaattcaggtgacttacatttagaggtcaagtttcttaatactcagcctgctgagatgcatgcacgcgggacacctgcagaagctgagggatcagcagg

SEQ ID NO: 118688 - DNA, 1027 bp, Homo sapiens
ggattacaggcatgagccaccatgcccggcctcagtctctgttttttaattggcatatttagaccatttacatttaatgtaattattggtgtgccaagtctgccattttattttttgttttctgtttgttctgtttttagtttccttgttttcttgtgggttacaagaacattttttagaattccattttgatttatttataggtttttgattctttttctgtatagcatttttagtagtgcctctaggtattatatgtgcataacttatcacattctactggtgttgacaatttactagttaaactgaagtgtagaaacctcacttccctttatgttcctttgccctcccctattacaatataattgtcttaaatatttctacataaactggaaaaccacaccagacagtagttataatttttgctttaatcaccaaacataatttaggaaatttaagaaggaaatatattttcccatatttttactctttccattgttcttcctttttctgaatattctaatagtcattttctttttgtttagaggatttttttttagccatcttttaggggccatctgctagtgacaaattttcttagtttcctttcatctgagaatttcttgattttcccttcattccaaaggatatttttggctggatatagaattctgggttgacagatcttttctttcagcccttgaaaaaaaattgtgtcacttccttctggacttcatggtttctgatgagaaatatgcagtcatttgaattctttttcccctgtaggtaagtcagtaaagtattgtttctctcttgctggtttcaagattttgttatttccagaaatttttctatggtgcgtcttggcatagatttctttggatttatccagtttgggatcttctcaccttatttaatctgtaggtttctgtctttttccaaatttagaaatgtctcaaccattatttcttcatgtattttttaagccccatcctttctctccctcttctttttgatatctgattat

SEQ ID NO: 118689 - DNA, 1042 bp, Homo sapiens
ctcagaaagcctgtgtcgggattaaggtactcatgtatcttaagtgcaacttggatttcccagttcaacctgggcttcatgcattggagtctgcacgttcaaagtgaaagtcatgtaaatcagatgaatttgactatcagcctggcacaccttttcatttccttttttttcctcgcacggtggcctgggctggaatgcaatggcacaatcttggctcactgcaacctccgcctcccaggttcaagcgattctcctgcctcagcctcctgagtagctgggattacaggcacacaccaccatgcccagctaatttttgtatttttagtagaggcggggtttcactatgttggccgggctggtctcgaacacctgacctcatgatccacccacctcgacctcccaaagtgctgggattacaagcgtgagccaccgtgcccagccccttttttaatgatcatcagagccattttcttctccctcctgtctgttattgagatatttactctgtgttggaatcaggttcaagttccccattctctgcaggtctttctcccttagagctatctccctactcctaccttaccttcctattatgatttggcagtgaatcctgtatcacctggctgacagatcttaatgatgaccctggccatttagcaactaagcctcctaccatgtgccaggcatcatacaaggtcattgccctaacttcattttatccttacagcagcctgaaaaggtaaggggagccaggcccagtgagattaagtgacttcattaaagtcccactcataacaatcggggtcaggaatggtgtgagctctgtttgaccccaaacctctgaacacggatgctttgactcatggtgtggtcagtgctgttggataactttgcgcacatgcttgtctggttttgataattagggaatatgctttgcagggcaggaagctcacatttctttgtgtccccatggcatctggcacagcacttttcactccaaagacctgcatgactgtgtgttgcttgagaggtctgagcagct

SEQ ID NO: 118690 - DNA, 1050 bp, Homo sapiens
gcagactgcatacaataggatctctcttttaggttggcctaggcacaagttaagactcatcacacacacctggattataaaaattctcttatgcatgcagcccttctgaggtttctcatacttttgtgtaaattgcatcacttgtttcttccaacatccctgttgggtagcaaggcaggtgcctttagttaccccctcccctagcaaaggcaagggatctagcatttcctgagcacctactatgtgccaggcactctgctagttgttttgcctatatatgttggctcccttatccctccctagagtccgggaggtcatgcattatcattactgtttgaaagatgaggaaatctaggtctggctccccagattggcacagcaataagctgcttgctgggcctgaagcccaggcatccaacggcagggtatcttctgtggctcacgcagtgagcctgcccccatctttgtcccgaaaccttggcatgccaccccagcagggcagccttgcctgggaagcctgggaacagggcgtgttgttggcttgcagtttaattgaagtggaaagcagcccattgagacaggcccagatctgttaatcctgcttgtaggaatgctggagataaaagcagccatggacctagagaacaatagctccacataccagcaggaaagggcactgtcattgccccaaaccaaacaactgccagggcctggagggtctggcggggaaggcccaggatgaggctgactcatagagatgacagaacagcccggagagaatgggaaaatgtagaaggccaagtttaccccagtgcatatatactttggggctgagtaatgtggtagacaaatcactcccttcaccatcccacccagagtggaagcacaccctgaagcctcaaggataatttctacttaaaacagttgagtaaaatggaaccacagactctgctgcttcttcaggaaaaggggctgcggtcctgagactcccaacccgttgtgctagaatgggaccttgggaaggaaagctttctccgagggaattgaatt

SEQ ID NO: 118691 - DNA, 1069 bp, Homo sapiens
tcttgtctccaagtcttagttatactgttgctggcaagtaatttggggtgtgctaattaccatctgaactgagcagcaattctctgatagggaccaatttgtggtaaggagactttccttgccagggatcccctctctaattttcggaaccatgaaaacttctaccattctccccagtttgacatctcaagggcccctggcctcagacctttttgcatggaaaggctgggagaaaccagctaatttattttcctgagttatgttattgaaacctgattccattatttatttcagaaaaaaatgtgtgttttcatacacttcatatgtagacaagccatgtaatgatatattactctggaagcagcctttgagagcttctagttgaggcatggcaaagagattatgtcctggatgcccactcggattagataaatggtgctcagggtaatatattgaacatgactctgaggtcagaaaagctcagaaaaggcatctggggatatattaggcctggatgccgtggacccaggacagggaacggagcacattccctaggtgctgtcactcccatggaactcatgctcttcatctagcaggttaggagccggcacctagagattggaggcaactaggatgctgctgttgcttacaacacctctgtgcgagttagaaaaaggtgatcccccccccactctgggctgaccctgctctgggatcacagggcttgggatgaatcctaagtgaatgcctcttaagcaggctccctagtgctttggtggagggagaggagcatagagctgagtggtccccagtctgttgtcccagcagggtctctggccactggccaatgccagcaatcaaggaacttctccataatttgccccaatttgcccccatttccccttgttcctcctgaaggatgcatgcagctcagacttcagccatcagccatcagagcatccctgacagtttgaggccttgaaggggatcaggtgtaactgagtggtttaaaagtatgaaaaccagacagatctgggtctgaatctcgactttgtcactttgggtcctt

SEQ ID NO: 118692 - DNA, 1181 bp, Homo sapiens
acctactatatataactcatttacctgcagctacttagccagactccagtgaggagtcccaaattgctatgctaatgatggtagccctcccctcccaagaagtgctgatttccccgctcagcatgagggacttcaataatatctctttccagtgatataatttgattcctccatgggatgctgctttggtcctagttcacttagcactaaatctctcgttagatactctcatgacttaatcttttcaggccccagatcagcccaggcctcttatttatttatctggggccctgtttacttccctgttgtaaattacttctggctcctggccgtctgattgctgcagtgatagactaatagctcagagctactgcatttgccttgtgtgatgaggcaaataatatgcttaacttatgggagagaaatgcaccctccatttatttcagtgggggaaaatattactcaggggaaagggccaaatcatttacctaatggctgctggtggaagtcgatgtaattactgacagaattatgtgaaacaaattgtcatgcctataaatctaaacctccagttctcaaaggcagaggggggatttcagtggctttcatgggctctgcctctggagccctcgaggtggatttctaagagggtgctggcagaaagagggaggttggccctctagttttcttcaccaggggcatgttcttcaccagctccaaacccaagcctgggcagactacagcctgtgagccagtccagcccactgccacctgctattgtaaataaagttttattggaacactgccacacctattcatttacatatgctatatggcccctttggtgctacagggcaacgttacatagttgtggctgagactatactggccctttacagaaaaatgttactgatctctgatccttattctaccagaagaaaaaatgtcaaatattttatatggaaatggagggattaatttaggtcactcctcttaacttctttcaaacaattcaatgccatagtaaggaaattcgaaggatctaggatggttatcacttactctgtattgcttctgcctctattcattgcatcttctctccacaatctggtggctagtaagtattagaaacccatttgacggaagagaaaatcgagactctgaaaggtgttttaggcaag

SEQ ID NO: 118693 - DNA, 1011 bp, Homo sapiens
tgacttcatcactatctttaatccatgtcacaaagaaatagaagaggtgtcttgtgagtgaggatatattcattaaatgaattgggtgggggaaggattatagaatggaaagaaaggaagacaacctgaagaatggaagaaggggaggaaggaagaaaggataacagcaacaataaaattaaacagggaataggggtgctaaagatagagatctggtaatagaaaggaaagaaagaaaataagaatcgtgtgtgtgtggtggggtgcggtatatctcaggtttgttttagtctttttctggctcctcccaaagcagctggaagaatctctgatcgcacgtgtgactctccattctgtgccaagctctgtgtaagctcttgtctctacagcaaccgttcagtgtgtaaggagccaccttcatagaatgccagagctgaatggcaccttctggaatttctatatcaatgccctcattttacaattggagaaactgaggcagggagcagtaggggactcacaaacctcagcactcagatttctggtttgttgctgtgggcacagcccaaaggtacctgcttaccttagccgtgatttttcattaagcgacaggggaatcacagaagacagaatcttagcttacaagaagtaaaggattgatgcttccctggtttgggccagctgggatagcagttacttttttaagaaaaggatgttgatgatactggtgatagatttgctgcagaaactaaggattagcaattctcacctgtagaaaaattgtgagtggttctaccaaagcactaggactgcctccacgtggttgctgtcatgatgtactttttttctcaaggaaaggagctgaaaggacaaacctcacgtgagagtgattccaaggaaagaaccaacagaagaggcaatcagaaggaaaaattggaagatgactccctaaggattccatcctgctgttgggagagtggcagtgccatccaaaggaagggaagagaaaggaag

SEQ ID NO: 118694 - DNA, 2011 bp, Homo sapiens
tgagcagaacccaaacacacattcttcagttgtctgaaagatgcaaatgtacccacatcaataatcttgaaatatttgttcctgaaccacattcagcatcaacagaaacatttctaaagagcctaattatctctcattttcaaccaacatttgggaatccctccaggggacaaatagtattttaatttgatgccccaaattctagcataatttcaaatcaccaaaaacatctgtaactttgtctttcttctggctttcctatggactcagtatcttggatttgaacattaaattccatttgtaaggtttgcagttcatttacaaagtccaggaggttgaggtctgtaatgaaagtgttgatacaatattaacaacagcaaagctatgataacacagcactgtccaaaccaaatagaaatggagacgtttaagtcaatttcatgctccttgcctaaatttggtgagctggacctgagtttttgattcatggtttagaataatattctgatgttttattcatgatgtttcttttttcccatcgttccttttctaattctcctcaccctacttatggtgatgaagcctgcttagaagtgtggcccgcccgccccttgattagcactgcctgttgcgtagccaaaaactctccccacggttggccaagtggaatatcctgctgttgaactgatggtttggcctcttgttggcgtgtctggggctctggacttgaatttttagtcaacgagtcagcttttgattgaaatatatgttgaatcatgccaacgtttctccagataaagggaacatcttgacttttggaggtcaaaatgctctgtctaaagaagaaaactggattttcaagagagtacaaggataacctatgactaatctcttctatctcagtctcattcaatttgggatttgtgaaactgtattgtggatcaagatactcagataaatctaacttcaataatttttttttttttttgagatgaagtctcgctctgtcgccaggctggagtggcagtggcacgatcttggctcactgcaacctccacctcccaggttcatgcgattgtcctgcctcagcctcctgagtagctgggactacaggtacgcgccaccacacccagctaattttttgtatttttagtagagacagggtttcaccatgttggccaggatggtctcgatctcttgacctcgtgatccgcccacctcagcctcccaaagtgttgggattacaggtgtgagccactgcacccggccaactttaataattttttaaagatgaaaaccagtggtagcaatctagagagaaatgaaaaatcatcagttttactgatattgctctaatagtcttcttcctatatctgtctcccactctgactcctttttgttaaaagcacaggcacatacacctaacgtaccacgcacacacacacaaaacctctctataggagaatcccagacagataaatgaagatcctttttgggctgctgaattaactcacagatataatttcactttagtgcaagacattgactattaaattagctcaaattattgggcaatgctatggtgagatattagggattagaaaggcagctgcagtgatggttgggggaagctctttgacttcttggctcataattggtgtttttggtccatagagatgatagtggcagatctgtgtcagagacagtaaattattactgtaaatgttttctggcctccagggagagctctcttttccctggaagagatgtgcatgggtcaggcttccaactgagaccttcagggactttcatttcatgttagaactcagaacagaccattgccaaccaccagttctcaagggcgtagccatcaaacaacattatcttaggaaataattgttaggggttccattgctaatggtattctctgcagatccttttcccttatgtgtgacacttcctttatttaaatgagagtgaaaggtgggagatcattaggtctaatggggct

SEQ ID NO: 118695 - DNA, 1780 bp, Homo sapiens
caacataagcatttcggggagggagggtcaggggcatttcagccttaatcagttcccaaatgtgtgtggtgaatttactaggggcaggtcctctgcaaagtgcttcacctatattctgtcacttcctctcagatttcagaggtagatacaatattatccccattttagagatacagaaacagaggcctagagatttagacagcttgcccaaggtcacagagccagtaactggctgagccaaagttgaaactcaagcttgcctgacaccagagcccacattcctaaccgtgattcctgtactgtactttggagaagttactaactaaagtgccaggcgcctagttaggaatttagtaaatgctagctcccttatctctatgaagccctaaaagagctcagagttgttgaatgactggagccctgtacctctaggtagtgctttctgctactcacagagccctttgcagtcaccttagtcttccaattcggcactaaactttaaaacataactacaagcaaaatgtgtccctataaaactctgcattgatgtgaaacagtgctataaaagtgaaaaaccagtggagaaaacaaaaaccatactacccaaatttccagtggagttattgtctgatgtggtgaaatgataatagcacaacagaaaaaccaatccatcaggctggtgtggggcttcagaggctgcccccctgcctgaagctggatgcggagacctgctcccttgtgcgctggcatggatttcagaggccgggggacggcaagaccagcctcaccatctcatacatggggtcacgttttttcagggacacagccacccaaagctcatggaaaatgtccctgcaaactgagtcccgatttcctgatttttctccttgttcccccaaacgctgaacactgcagtgaggccagccttgtgtttgctttatggcacatgtcatcaattccagagtttgtgatgcttttgaagacaggttttgctttaatctgtgtgtggacagagaatggattatggtggttgctgtgtcattctctctgtagtacctgaagccagagccagggatgaaggcctgggaggtgtcgtctctctcctccgataggatgtgtccagctgagcatagaagcctgcggacttgccacagagttgataacaaagccaacatttaaattgccttgtagattcttgcattacagaatttttgagctaggaatagcaatctagaccagtgcttctcaaactttagtatgtatctgaacacctaaggatcttgttaaaatgtggattctgattgtgtaagtctggaacacgacctaagaatctgcatgtctaacatattccgaagtgattgtgctggcctagcaccacagcagagcaaggacctaggctatggttggttttcaaacttagcatatagaaacaaatatcttgaaaggatggttaaaatgctgcatcccaggccacacagccgggaagtctggttcattagatttggaatggaccgggggatttgactttgtaaataggcaccctaggtgattttgttgtgtgtcacttaggggcatactttaagaaacatcgatctcatatagcccctgttattttatatattttgaaggaaggaaccaaacatcttttgagcacctaatgtgtgctaggtaccttatgttgatgccaactccttcagtcctcccaagaatcctgcatgaaaggtgtttttatgcttgctacactgatgaggaaactgggcttgagtttcactcactcacc

SEQ ID NO: 118696 - DNA, 1052 bp, Homo sapiens
cgaagagaatcattaaatctatttctaaagcttaggggtatctaacttacccatagttgtataactaggatgcaatggaactgggactcagtacacatctgtgtctctgccaagtccttatgttttctaccataccacactgccatgctaattaccgtgggcagctgaagttatgctcaaaaggattggtgatggacctgtcatatatccaagggattcccttaggattttgctggctaccctccgtgcacccatcctcagagccagtgccatccgactcatgtgtgtattagtggggtgtctgtcctcttattctgtgttcaaacacacagaacatgagctatagaatcccagatcttggaagttccctgaacttatatcgctgtggtctgcaaaatgcccagtgaggtctctacgatgcttgggtcactcaataaatatttgtcccctgccatcctgacgtagatcatggtcaagtgtggagactgggcttctgttctttctaggctcttgcagcacctgacccagagcagaggacaggaggaggtagtcaagtgaaagggttaaggggctgcccactgtgtatcctgaaacctttggcaagttacttaacctctcttgtctcaggttcttatcagtaacatagacaatggtagaactgacctctccatgttgttgtgaggataaatgggaattatctgggggaaaataattggcattgaacaaagcacgtagtaaatgctccatggaagatggccacggctgaccttggctggtcagctgatgagagtagtgcgtatgctggggctttgggctctgtggtataaactttgtagcacctagggaaggagtccagtctccaaattagaggagggttggatgaacactgcacttggagtgggaagacctgagtcgtcatgctggctcttctacctgtaagctgtgtggccctgggcatgttacttggcctctctgggcttcatctagagaggacaggatggagcatgatcttgcatggcctatgggctattaatttctccctttgccatcct

SEQ ID NO: 118697 - DNA, 1648 bp, Homo sapiens
cgtgcctggcccatttatgtttttaggtgtgtatttcacatgccagtttcatcactcagtaatagctacacgaagctcatggtgagaaaagttcaaaagtcttgtctggagtccatgggaaggaatattgtgatccattagtgatgtctctccaagactgatggaggtgtggcagcacagcgcatgtgctgtatttttacttttgactgacctttgctttgcattcccaacctgactctaagccccgccaacagggaatataccttacatgtgttgagcagcccatactgaaagacgtagagagtctcttaatgcctattgattgattgactgattgattaaagtggtatctgaatacgtttgatctggtttaatgtccccttgacatccttccattctctttcctctttaggcgcctgaacaagaataagctgcaagtccttccagaattgcttttccagagcacgccgaagctcaccagactgtgagtagagttgccttgtgttctctaccttgtgccttgcctggcttgggtgatgtggaggatgtggtttgtggagcgccgtgccgtgtggagcttggcagttaggccctgacatagagacttggagcagggctttgacatgacgtctacccccaacaaacacttccaggcctgacttcttgctccttctctcagacatcagcggcttgcatgaccagtgaggactagtgatgtgtggtagtccatcgttgccttgcaaggagggaggcgatgcttccatggattgtgggtctgaacttacttcaggtaaattccctgaggtggggtttgagataggtttattcacacgagactgtcagtggtctcagaaggcaacggtttggaccgaacatggcaacctcatcaccttgctggttgaagcagctcctgcctttttcccacttcctagcgctgccagtctaggaaccctgggtctgggggtttatgattttgtgggaaaaggaagaaatgtgttgaattttgctttattctcttcagagatccagggtaaaatgaggagaggggagagttggagatacttctatttattcagtgggagaatttggaagcccaggagctggagttgcaggtgagggtggagactgtgattcatgtattgtagatgtcaggcaagtgctaattaaattatcgacagtgaacctgaaatcatgctggcagtgactcagttcatggggtgtactgaattgcctaaggtacacctttctgaatgaagcgacacagtcctggatggctttgcagtcaggtagcaagatttacagcctggctgggaaggctttaacattgcagggaggctccaacgttgtggccaccattctcattcccagtggttgcatttaatgcctacttgtgcagccaaacactgcatataggctctgggataaattgggaaacatgaaacacatgtcagtgtgtgcacttacgaatgagttctgaattaggaatatatatttctatatgtctatacacacacacacacacacacacacacacacacagagactatatacataaatttattttaaaagggcactttgctggaacaagaacaggcaagggttggctggtattccaatcatgcagtggtctcgcttgccttctctagga

SEQ ID NO: 118698 - DNA, 1049 bp, Homo sapiens
tgcttgacccagctttgctcattgatctcatctgtccagttcctcttggctattgtatttgtggttcgtttcttaaaaccacactgtgttatatgtatgactgttctcgttttaaaaatagaaaaactgaggctcaacaaaagaaaagctattgcccaaagtcacacagcaagtcatcagcaaagctgggagggagacagacctgagcttcctacctggccagcaaagccctgcccagcatcacagaacagccactggtagagtctccctgcattccgagatgctccagccagatcttctgcaccttagagtttccttgaagaaccaaatctcagtgtcccttttgctcaccaggaaacccacatgtcaccagaatggcaagagtgtcctctgagtgtagcttcccagactacatttttcctgcgtctctgccactctttgggctgtgtccaagggctgctcacacactcccacatagccgaggggccagctggtgtgtgtgcttctgcctgagacgaggccgcttgcctgtggggaggatgtgattgctttaggaaattaagtgggagtgattaattaggaaatgtactgaggatgctggaaagaaatagcagaaaagaaaaaaaaaattggaaccctcaataccaaatgcttctggccacatggctaaggatactgcactcagtgggaccaaaagcatttgatcctgttatttctgatgctgctgctttgatagcacctccttgcatgaggattttggaaggaaccataaagtcagctggtccaacctctcctttcattgaatggcaaatgaaggcacaaggagacccccagcggaagctgggcagcttacaagaaacagcaggacttgggactcagaaagacctgagtttgaattcctgatgcatccttgctagatgtataatcctgggcaaatctccgagtctcaggcttctcactgtgaaatgaaggtagcattgatgattgccaaggatttttgcaaggaattagtgaacaaaagcaagcgtggtgactgctaataagtgaca

SEQ ID NO: 118699 - DNA, 1093 bp, Homo sapiens
acttaattttctccatcactccaaatgacggctagctttgccggtggttgggcccaataaaaactgacaccatgtcataggctttccctcacttgaccacagaggtcctgaggtcaagtgagagactttccaagatgctcaacagccaagtcctctgtccagccctcagggccagcttagaggacaggaacaagctagtgaatcatggggtctctctgggtcaaccacggtgatgtggccttttagggaaacacagtgccctcctggacagactaaggagcagctgagtggacccgcctccagtggaccggtatagcctccatggtgctgtgcaactctgaacggattacattacctctctgggcctcattttcatgaaagtagaattcttgtatagtcttagtggttttcttagtggttatagtccactgggggaactgtaagtatccgcctccctagtgtctagaacagtgcctggcacacagtaggtgttcagcagatgtgtatttaataaaggaataatgaacctcaaaactacaagtctgtctttagttcttaaaagtgaaagatgggccattatagatctgcattctggcatatgactaagggatcctcactagtaacctatgacatgagttattaagggtatctaaaatttggattttatgaactaatatttattgccttactagagttaccaaggactcctgttgagtgatctactctggagtctggttgccaggcattgcttagcaaccttgcaaaactcctactgtgcacatgcccatgaaaagaactggaaatcctgagcacttaaaccacagggctttctaatcaggaactcatcagcgtcatcctgagtgctctgtgggttttgattgctgctcttcttgtattaattgataagttctgcttttgttgatcatctggattttctattatttctgcatttttgccgttttgattgttatgttgttttctctccagtattgtttgttgtcacagagttctgtctcacctggaaagtgagaatgaacagtgggttgcagctgtagaacctcttgccttggcaatgtgggctatggcaagaagg

SEQ ID NO: 118700 - DNA, 1050 bp, Homo sapiens
aagtctgtgcagcacatcctcatgctttgtttaacttgattccctgggtgggacaatttttatgagcaggtgttctggttaattaggtgattaatgttcctcaaattggagagccatctccccaatgacagttcttgctttgctcaaatatgagacaaatcttccctgtacaatttggagaggtccgtgatcacgttagtctgtctgccaggcctctcgggtcagcactctggccctgaggaccaagagcctgaccccacacctggctgacttgcctcttgctgcaacagtttagagaaccaagagctcccagatcatctggcttcctctcagaccaggcaaaattgaactggggacatatttctggttcctttctggggattccagtccgtatcacctctcaaagtcagagccattgcctctacacagagtcctccagtttctaaagcaaggcaaccaagccacagccaagggcaaattaggcatcaaaactctttttctccaactgtctctcaggcaaatagaaatgtgctccaaattcacttatactccaccttctcaaaaccctttcccacctcaaacacaattctattcctaccaccctccctctgtttctctcaatgccagaacccttctccctctcgttgacatcagcaaacccatacatacttcaaatgccagactgaattattcagctgtccttcccagcttaaagtgatttctccctcttcagaatttgtgtagcacttactatgtgacccatatcacgtagcatttagttatataccatatcttttctcttcattcatgtatcttaattttgtcttcccaactggatttttgtcagctgtggttgtgtcatctcctgggcatatataaagttcttagtcaatgtttatttgattggtaaattaagctgaatgccacttacacttctggaagatgggtcaaatttagtctctttcaccatggttagtcttgactgggccacatggatgctcactcctgttcctcacatgttccagttttagcaccccagaaggactagat

SEQ ID NO: 118701 - DNA, 2060 bp, Homo sapiens
agtaatcctccccagttgctgggattacaagcatgagccaccatacctgctactatgaggtttcttgattacttttttgttattcccttaattttgattatatggatagtggtccaattatgagaccaaacttaccttaacatattggaagcttagcatacaacaactgaacagttttctgatggtgaactgtttagaagcaaaattaaatgtattctattccactctttaatttttgatcccaaatcagtaacagaattgtcagaacagttcttgctcttggaacaagaatgcaaatttgactacttattagtcaggaagaaaattttaatgtttttatacgacagtagtattgagtagatatgtttcttctgttattgatattattgcatggagttttttgtataagcttaagtagttttatttcctctatttacagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgaggtaggactctggactcctctgtctgcaagagtgtgcttagctattgaagatttgtcctgtttagcaattaatagtagtagtagtttattcttttctgaagattttagatctagttcccgccctgccccgtccctgttaaaaaagaatgaactaaatgaattcctgttattctttccaccctagtgtattcagagtttgaaagatcaagttatcattactctctttgccacatttactaccagattttgctttgtctgcacacttcctagaagacctcacttgttttagacctctaaacatctaagtgccccatgacactacaccaagcccttagttcccccatgaaatctaggtttgtgttcaactgcccactaatagacttctcaaacttaacacagacagaagagtggattccctgtccgttaaccaaatattcttttacgattttttttagcttatttagtaaatataatagcattcagtttcttgaacaccaaaaatctttatataccaaagatttttggtatatttttggtttctttatataccaaaaatctagaacttttagtcaatatcttccctttatttctcacatttcactcattaataagttctaagaactagactacaaagcatgtatctttgctactggcactgtagtccagatcaccatcatcactcctagacaagtattgtagccttctggccgggttgcctgcttccattgttgccattcatgccattcattcttcactcagcgtctaagtggtcgtggaataacacaccaaaggtcatgccacagccctgctaaaaaccatacaacagcttctgattttatttacaacaaaatctgagctccatccttgggtttgtagatccctatgtgacctgacccctgccaagcttctgacctcacctcaaactgctttgccttgttcttgactatactggtcctcccttatgggctttacaccagctattgccttttttttttttttgagttgtttacccctcactgctcttgggttgagtcctcagatttcagctttcatttaaatgtcacttcagcggagaggtcagcccttactatgtaatgtaaagttgccctgattcactttttttttcttttttcttttttttttttgaaacagggtctcactctgtcgcccaggctggagtgcagtggcgcaatcttggctcactgcatcctccacctcctgggttcaagagattctcctacctcagccttccgagtagctcggggttacagatgtgtgccaccacatccggctaatttttgtgtttttagtagagatggggtttcaccatgttgaccaggctggtcttgaactcctggcttcacgtaatctgcctgccgaagtgctgggattacaggcatgagccgttgtgcccggccctgattccactcttaattatct

SEQ ID NO: 118702 - DNA, 1452 bp, Homo sapiens
gctctgcattcattctgatagaccttttgtgacatttctcagatgactacattctgaaagtaaaggctaattcagtatttcttttttttcaactattattactactacattgtgttcagagctacaagtagagcatctcattatcaaactaataattctcatgaggaaagcttaagtgctgttaaatctttttttgttgttagcagagattacttgacttgacgtgttgacataccatggagcacattttacttccttgacaaggcacagaagcagtaaggtatcccttgcatgggtttaacatagtttcgaaatacacctcaggggtttattaagactgattaactacaaagttattccaggtttaacatgtcttcgttatttggaaagcagcaaatgcttgaaataagaatgaaacaattgaagttgaaaactgattgtatgtaatggctttaggctatttttatgtaattgaattgtaattgaatctgttttcagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaaggttgggatatctgcgtatttcagcacaaaatattccatatttatgcagccatctgtaaactttagatgataaagattttcttaagtgtcagctttgcaaaatagccaagatctaagtcttcattatcttaatattgggggtgggaacactgagatacaagagtttgtctaagggacttgtataaattatatcctattaattaaatacaattatttaattttggttgctggatatttgtgaaggtttagtttagtgactagcatggcctccttgctgatagtgggtacagcagccccttgcagaaagcctcgtctcctagccttccctgcagtcagtggtatgctttgtaattctgtaaaacagaccagtagtttcttactagttaatgtgcattacaaatgacactttatagtttgtttactgaggataaactaatacatgtgctccagttcttacaataatattgtggaaaggtaccattatcatttccatataccagatgaaagagccagtgtttagacagactgagtaaattggacacaattcaagaactagaaattctccatctaggtttgaactgaggctgtctgactccaaaggctgtgttactgaatcactacatagtctaacagcatgttacactggctccatttcaaacataaacgcaagataaatgattggtcagtggttttcccttttcccagctagccagtgctttcaggttgcttctgaggaatccagaactttttatcatggatctgctttgtgtatagtcta

SEQ ID NO: 118703 - DNA, 1057 bp, Homo sapiens
gacctcgtgatccgcccacttcagcctcgcaaagtgctgggattacaggcctgagccactgcgcctggccaaaattacatatttaagcttgcttattttttcccagtatacactaaaacaaacatagctatctaaatataccttcatgtaatatataatcatcttgcataccactctgacagataatatcatccagcttgtctgaaactagtcggatttgaggccctaatgactgataatgatgtgctttcttccccctctggttgttatttttatttttgcaatagttttcatcacctaaacaaaaaagagtaataaagggagtattcaggactgaggtaaggctaattatagagatggcttttttttttttttttttttttggtggagcaaagagtacattagtgaaatattttgttttactgattttctcaaatcacttatgccaaaatttggatttttttaataccttttcttctcttatttttcacatttaattcatcaagttctaagaacttgacctacaaaacatctatgacgctactgccactccaatccagaccttcatcatctctttcctggactactgctgtagccttctgaccaggttgcttgcttccattgtttctcttcatgccagtcattcttcacacagtagccaagtggtccgcatcatagtgcctccagattgcttctgaggcatccagacccaccccgattactcatggattatttctatgtttattaaacaaggtgtgtcactagctgttaaaagatgcctaaccttgggcaaataggaaactccaatagtatcatcattcagtaagtttggttcaatcagttcaatcagtgattgtttttagaaagaaaataactttcaatttatgacttttttttttttggctttagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcag

SEQ ID NO: 118704 - DNA, 1024 bp, Homo sapiens
aggaaattttccgaaaagaaaggtaacaaaaatatctttgtgcagatattcatgtgtgaatacatttgaaagactatttcctcctttgtccatttcctttcaagaatgcatgagtattttttaaatttaacactactattgttaaggattatttaaattgtttattgtttctttgttactaaaaaccccagaaaaatgtatttttaactaagaattcaaatatgcgatgaaatatttataccactacacttattatatgctgtcttaatactcgttggttctccttttttattatcatagcaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaaggtatatatgtctcatatatttttgtcttttaaattatgagtaacctgaaattatatcaaattattttcttactgtagttttatgcaactctattacaaactcatttgtagttatatacctatagttaataaagcaaatttattgtgtaaaataggtaggaaaattcagggagaactggatactgggtgtgcctgaatataacatgtatcctttttggatatctaatttcatcatactgtatagtagaaacttgagatttgagactttcccattttaagattacagtattttatgtcatacctaatagtttaattatgttgaagcagctgatgtttggaagctatacgaggtaggactgtttatagaaaatctaaagtaatggagactttaaaaaggtgggtctttatctctgcctctgatggaagtctggaggaggccttccaggactgggaaagcactccacggtatcaagattcaggcttcttgtgtttgttggtctgctgccatcctgtggagcagaatttagtcatgcagcc

SEQ ID NO: 118705 - DNA, 1288 bp, Homo sapiens
atacgaggattaggattcgaacctggactctgccgctgtctcttcatctccacactgagatcttatgaaccacctttttcaaaacaccaagagagaacagtgaagcattcatgcctaaagtcaaaatattgaattcccaaggaaaaatatatagccaaataaactttaaaatatatagtttatatagattccatgataaagaataaaaggtagaaacaaaggatgcatttcagtgaggagatggttgcattttaaaagaatggaaaaaggtatacatataactagttctggcttcttgtgttgattgtgtctttgttttcttagattttttcttttccccactcgtttttattctcagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatatacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggtcagtgtcctcttttcctccaggcagccagcagacctctccatctctcctctctcgctgcatgaactgtgctgtctgtttctttatctactttcttacaattgcatgcagtataattcctcagtttcatctacctaccttcaacttttccagaactttaagaaagactaaactgattgcaaagggaaaggactcttgaataaggcaatcacattaaaaagttacacgtttctgtttcatgaaagggaatatcacagtttaacacatctctgaatgttttatcagtttgaatacatgtactgttatttttctcctggttcaagcatggccatgaaagaaaaattaacttactttctcaaagggctttccagtagtctaagaaatttcagccttctaggaaacttaggtgaattttttatgtcttttgaattgcttatcctaggcattcaaaaatgggcttcaatacttattttgacatttttacatatcaaagctaactcattttcattgtttccaaaacttgaaagcctctagtttctgcataattgagtttgtgactaaaagaaatagcgtcagatatgtgt

SEQ ID NO: 118706 - DNA, 1108 bp, Homo sapiens
ataaaaaattcacctaagtttcctagaaggctgaaatttcttagactactggaaagccctttgagaaagtaagttaatttttctttcatggccatgcttgaaccaggagaaaaataacagtacatgtattcaaactgataaaacattcagagatgtgttaaactgtgatattccctttcatgaaacagaaacgtgtaactttttaatgtgattgccttattcaagagtcctttccctttgcaatcagtttagtctttcttaaagttctggaaaagttgaaggtaggtagatgaaactgaggaattatactgcatgcaattgtaagaaagtagataaagaaacagacagcacagttcatgcagcgagagaggagagatggagaggtctgctggctgcctggaggaaaagaggacactgacctgggagagttaggggtgtttccacttctttcacttaaggcctcagcgtcagcgggaactcctatgagtttcacacatttcttttccttcttcagctgcatatccacgggcagatttttgtgaggagagagactgactactggtgtgtatatagaaactgatttttctaattgcaagttgttatcttctaaactgttagggcaggactgtgtctcctctttctgaggcggtaatcgataaacttctcccccgagagcactgttgttgacacatgcatctttagcggtggttatatccacagggagcacctcacgcctctttttcagtacaggcacttcaactgtctctgagaataaaaacgagtggggaaaagaaaaaatctaagaaaacaaagacacaatcaacacaagaagccagaactagttatatgtatacctttttccattcttttaaaatgcaaccatctcctcactgaaatgcatcctttgtttctaccttttattctttatcatggaatctatataaactatatattttaaagtttatttggctatatatttttccttgggaattcaatattttgactttaggcatgaatgcttcactgttctctcttggtgttttgaaaaaggtggttcataagatctcagtgtggagatgaagagacagcggcagagtccaggttcgaa

SEQ ID NO: 118707 - DNA, 1027 bp, Homo sapiens
cttaaaaaataattggcccagcgtggtgcctcacacctgtaatcccggcactttgggaggctgaggcaggtggatcacgaggtcaagagatcaagaccatcctgaccaacgtggtgaaaccctgtctctactaaaaatacgaaaattagctgcatgtgggggtgcgcacctatagtcccagctactccggtggctgaggcaggagaatcgcttgaacccgggaggcggaggttgcagtgagccgagatcatgccactgcgctccagcctggtgacagagtgagactctgtctcaaaaagtaataataacaataattgagcctattgatataaaaagacttttagacagccagtgacttaatattcttacagtattagagtcaactatattttttttccttgaataccatgccttattggaggcccattatactgggggtttgtttcttcaatccttcataaccacatttgaattcagagtggatgctttaatgcctgtaggttagctgctgaatcaaagcttcaaacagaagttaaagaaggaaaagaaacttcaagcaaattggaaaaagaaacttgtaagaaattacaccctattctatatgtgtcttctaaatctactccagagacccagtgccctcaacagtaaagacttgtctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttt

SEQ ID NO: 118708 - DNA, 1008 bp, Homo sapiens
gtttttctcctctttattaactttattttttacctctcatcttctgtcatctactaattgcttttagttctatggcatctgcattttattataaacatttatcctcttctacattatcaatcgactcccacacccactgtgagcagcgggtagggactatatcataaatattcctgcttcacacagatgagagtttgagtggcgactagtgagtgatagaaatctttgctggttctcacactttgataataataatgatgatactgcctatagtaataatgctagtaatcataataggagccaaagtttattaagtggttccagcctgacaggcgcttttctgaaagatttatgagtgtgtcacctcgtttaaatcttacagccagcttcttaagtaatattattagctacatcttcttaagtaatattattagccacatattacagatgagaaaatcatagcccagagaggttaagtaatttaccctccaacaaagatgcagaaaatggcagagccagcattgaaatctaagccgtctgttttcagaatgcaagctcttgtccaccatgccacactacctaaattatcagaccacccccagccactccacatgggatttaaggggtcccggtacttcagataaactctgaacccataagattctggatctcatccagaatggggaatgttgatgtgagctttaagaagttgctcactgctgactgcctccccgccccccgaccccaggagcaacggtttctggctctttcaccatctgcctgcacgctctgggagctccttccaatccctgtgccccagtgcagccaatcaggctcagacatgggactgggaaacagaaaggctgtcctggtcgttggcccagaaaggatcatggagggtggccaaggccaggcttgagatcatagcattcacataaaggtccctgttcaggcaagacaagggtagtggtaatcggggacatctccaggccagaaaatagggaagaa

SEQ ID NO: 118709 - DNA, 1048 bp, Homo sapiens
tcactatatagcagttatcgccactggatgttgtatcttctttgtttactgcatctgtgcctaactccccactaaaatataagcatcatgaggtcaggactctgttgggcttatggctgtattcctagcacctagagcagttcctggcaggcagcaggctccagaggtatttgttgaatacatgaatgagtgaatgaatgcatgatattttccctgacccacagtgaagaaagaggaacatagagaagggcaggcaggagggaagcagttcagaaggctatgatccctggaggaaggattcctgttatttctggggctagctgggaattgtcctctgggccacttggctgtgcttccatctcctggaagcacagtgccagccaccttctcccatgtgagctactgtgctaggaacttcaccttcctcacttataaccctcaccaccatctcacacagcagcattagcccagtttcacagacaaggaagcaggctcagagatcttgtgtcagtttgccaaagtcaaacagcgaataagtaactgaaatgaaattaaaacccgaattggtctgacctcccaccccaaaacaactttccacaaaacgataccacctcataaaataaccacatctaattttatatgccaggaacttagtgcacttggataggtggaaagagtttcttcaaagaagtctgagggttcaggcgaacgggagaagtgttcaattgccgagaggcggcaatatcaaggcaagccctttgagagacgctggtgtttgtgttcttcccactgacccactgttggaagtaagacctgtactttgatggctttgtcagcaactgggctgggttgagccaagccttcctcactctcctggtcgtctttgggatgcacatgtatttgtaagatggtttcctagagctgggctctgtaggaaggtaactttcatgactcaaaatatcccagacaatgcttaatcctaagatcaagggtgttagtagcatcattagtttggccaatgagtcaaccagtcaagcaaagccacttt

SEQ ID NO: 118710 - DNA, 1013 bp, Homo sapiens
ttcctagcacagtagctcacatgggagaaggtggctggcactgtgcttccaggagatggaagcacagccaagtggcccagaggacaattcccagctagccccagaaataacaggaatccttcctccagggatcatagccttctgaactgcttccctcctgcctgcccttctctatgttcctctttcttcactgtgggtcagggaaaatatcatgcattcattcactcattcatgtattcaacaaatacctctggagcctgctgcctgccaggaactgctctaggtgctaggaatacagccataagcccaacagagtcctgacctcatgatgcttatattttagtggggagttaggcacagatgcagtaaacaaagaagatacaacatccagtggcgataactgctatatagtgagataaagtggcgtaagagcatatgatggaggtgacagaagcctattaacatcaacggtgagtatctgatttttagcatcacctgcacacacacacagagtaaggagggtgggtccctgagtttacagagccctgttatgaggaaggagcactgagtgagggggacactcactcatatgaagggactgcatggagtgggatctaagaggtaggaagtggttggaactatacccgctgcagagtagttgaggaagaaaaggggaaaaggcaggtaggtgacatgaagtagggagagaatggggaaggaagatggcagctgccatgtggcaagagagagggaggctttggagatctctcagttgatggaacatgcttctgggtgtcctcatggagcctcaggaacaatctgcatgcctcactgatgcttttgccgtcagttttgggttttttagacctgggacgcttgacactgaccacaaggtgagggccaggctggatttgtatgtttgttgttttaagtaatccaaaccttataaacacatgtaaggagaaaacccaaggctctttccctgttccctatattccagtctccagaagtga

SEQ ID NO: 118711 - DNA, 1041 bp, Homo sapiens
cagtatgccgagattgcaccactgcactccaccctgggcaacagagcaagacttcatctcaaaaaaaaaagaaaagaaaatcccttttctctctgtggctggaggtaaagcagcataattttgcagggcaatttggcatatgtattatttaatccatatttctttcatttatcagaatatcaaaaaccatttatgcctggttgaatccacttctgggagtctatcccaaggaaacaatcaaaattacagaaatacctgtctgcatcaagatgttccatgcagctttatttatgtgctggagaaccggaagtcatctttatgtttaataattgggagatgcttaagtaaactgtagtctgtctactatccaaataatgtcatgaatcctttgtattagtaaggaaaaaatcataatgcgataataaattaaaaatggaaaggtaaaaaacttcacgcagtcctgatagattgcaaaaatggccacaatattttgtagttcctccatcaagaaataaactttctttaccccactgagtctgggctagcctcatgatctgcttggaccaatcaaatgcttgtaagtgacagtgtgagtttcaagcttggacctctagaggacttgcagcttctgctttccctactgcttctgcatcttgtcaccatgagaacaggctcgtctagcctgctgagaaacacatggcatagtcactagcctgtcacccatgatagccaggcaaccacctgacacaagggaggcccctgggaccgactgactgcaagtacatgagtgatcctagctgagatcagcctagcccagcccagaagaaccactcagcagaatcctgagcatctggtgccactacattttgaggctgcttgttacacagcaatggataaccaatacaacagcctatgatgataactatgtacagaaaaaccatttacaaagggaaaaaaaaatcttggaaaaaaatttataaatgcacatagtacatttattaaatggtagaattatagatgattttttattagtttccaatt

SEQ ID NO: 118712 - DNA, 1792 bp, Homo sapiens
tagtgcattctaaaaaagattaaaattacaaaagttgtgcttggttgttagaaaaatttaaatattctataaatataaaaagaaaaattttcttatcccctctcaagagtaaccattgtgtatggtgtgcctctcttttgtatgaaaaatatgcacacatacataggtatcttaatatgtaagagagactacctgcataattaatgctttttaattattattattattatttttgagacagagtttcactcttcttgcccaggctggagtgcaataatagcacgatctcggctcgccacaaactccgcctcccaggttcaagcgattctcctgcctcagcctcccaagtaactgggattacaggcatgtgccaccaagcccggctaatttgtatttttttctccatgttggtcacgctgaattaacgcataaggaacatagtgctaagacatttgccacttcttacatggagggtttttcctatggcatttgtaaggaactaattgtttagaaaggtaacagatttggtaatctgattgcgcacagatgttgttttatcccccacttggctaagtaaatttaccacaagaggcattcaagactcatggctgagcttttgctgacctcctgatactttgcttctcttcctttactctcctggaaccctaaacaatttagaatttcagaacctccacacttggtccagtgtgcagactgttgggcctcaatcctggagtctcagcagacagattgaacttcagagagagagagttctatctctagagactgaggtgtcagagccaccttcaagaagccaggccaggtcagggaagtttacttctctttatatggagatgtggaataatggacctagatcccagctctgtcacctcccagttctttatttgggaaaagttattaaatctttcagagctgcagttctcttacctgcaagtggagatcatactgacatcacagggtcatgggaagggctaaatgagattagacgtgtgacattgtctttgtggagtggcggcaatggggagtgtaagagaagtgcctgcctagccggacatcctgaaggtgttcatcattggttatctgtacaaagctcccagcgtcatgtccatcagtcacgtaataataggcgctcaataatggcatttcccttcccttccccctctcttccgtaatcctagctaattttggaaaagggacaactttattcaccaggctaatagatgcaatagcattcacttgcaataaataacccccgggggtacctcaggggactgtgataatgcattaaccaggaagaggccaggcggatttcaaaagaagcttaaaaacatctcatcggtaggaatacggcaaggcaaactacttattaatctaaggagactaagccataggatataggtaggaatttgaaaatgaagtgttagagccaatgcaattgaacaataattgaatgttaatatctggtgggaaagggcgagatctttgagggcacaccctggaaggtgctggagtgacctggtgctaagtggctttctgcccctctgggcagcaaggtgcagctctgagacgagaagcctggagtcagagacaggtgtttgaattccactcaggccacctaacagctttgtgatcttcagcaaatttcaagtttctctgtgctgcagtttctcttctttttctgtctttctttctttctttttttttttgagatggagtctccctcttgtcgcccaggctggaggtgcagtggtgcaatatggctcactgcaac

SEQ ID NO: 118713 - DNA, 1048 bp, Homo sapiens
tgggggccccaggcactgtggctttgggggcttaaccccagagatattcaattaaaggtcagttatgccctcacagtggagattgcattcaccaggcctctatcttcctttttcttcagtgtcatacatttttattcagcatccttatttattaagcactgtgctaggtacttgggggaaatggaggtgattacagaatggtgctcacctccaggatgctcactcacactccctttagggagacagagactaacaatagctatggtttactgagtgcttactgtgagctagtccctgggctgagtgctttgcatgcattacccctttgaacagttctactaggtaggaaatattttaattctcattttactgctgatgaaactgaggctctgagagtcaagtaacttgcctaaggtcacagagctgctgagggacagagcagggacttgtaccaaaatctttatgattctagagccaggctattaaaacatcactcattatttgtaatccttacacaatattgattgtgttgtgtgccataatacagacagacacacatgtacacacaaatgcatgcacacactcacacatccacattcacacattgctgtgggaacatggggaaggggaacattaacgatgattggaattgaggtcaaaagagaagtctaattatgtttcatgagacaagaattgggctttgagatggtctttgcaaaactcagtacagttgaggcatgtccagaaattcagtttatcggttagctcaacccttgttttataactttagactcttacttaagattaaacatcagccccatgaatatttggctcctggcctcctccccaaggcctctgggagctttaggtttgcacagtccttgcacaggcagggatgagtcctgttccatccaacccggctccattaacaattgggtgaaaggaacttgagcttcaggaatttggggagatggcaaaggggagcccatggctgcaggtggcagagactttggggcactgcaccttggttttctctacaaacatgact

SEQ ID NO: 118714 - DNA, 1054 bp, Homo sapiens
ttaggagatatacctaatgtaaatgacgagttaatgggtgcagcacaccaacacggcacatgtatacatatgtaacaaacctgcatgttgtgcacatgtaccctagaacttaaagtataataaaaatatatatataaaacaaaaaaaatgaaaaaagaaataaaataaagtctttgtgattttttagacctaaaaatgtagccctggacatatttgctgacaaatgatgagtacattgatgaaaagtccatgacctttttcatatcttctactgggacctgtggctgatatgatcttgggagagtaagggtgggtgggtggcaaagaacatggtcatagaactcatctggaaccacagaccctttgagagttagtaatcagatagatggcataaattaaatattaaaagtttaggtctcaggggctagtctatatttgttgtcaccgaaatgttttttatgaaatgattgtcccacaaaacgcttatgaaagaagattccatggtttaaaacgtttgggaagtgctaccactccttcttggaatttcacgtggaagtaacttattagagcccgttaaaaactctgcagcaggccaggcacggtggctcacgcctgtaatctcagcactttgggagactgaggcaggcagatcatgaggtcaggagatcgagaccatcctggctaacatggtgaaaccctgtctctactaaaaatacaaaaaattagccgggcgtggtggcgggcgcctgtggtcccggctacttgggaggctgaggcaggagaatggcgtgaacctgggaggcagagcttgcagtgagccgagatcgcgccaccacagtccagcttgggcgacagagcgagactccgtctcaaaacagaacaaaacaaaacgaaactctgcagcaaagaagaatgttaatacttaaggctttatgagtcatctggtctctatcacaaatactcaactctgccactgcagtacagaagtagccacagacggtgtgtaagtacatgggcacgactgtgtgtcagtaaaacttccttagcagaaaca

SEQ ID NO: 118715 - DNA, 1220 bp, Homo sapiens
taacaatgctagggagttcattcatcacacatcaacctagagttaaatcctcattcttcatcacaggcaaatccccaggttacagtttagatgcccatttactggcatgactgtgtgagctttatatctatcaagcaattttttttaaaagttggaagcacgagtgataaatgtcaaggatggctttgcatatttgccatcccttctgctttgttccttcttgtacataatcctcatcttagcagattctgagtcccactccttgtctcttggtccattccagctgatgccctatgtctcattccaagtgacactttccctaggaaaactctgaccccccccccattacttttcattgttgtaactcattctgttataattatttaaagtcctgcaccctctattagactgtagagttctcgaagactgcagcattacttttatctgtgtattgcaaacatctaccacagtacctcacatagaatcgtcatttaatggttgaatggatgaattgaatgtatttaaatgaggatagacagatggaacccaaccagccatccagactggctggagactttagtgggacaatatataaaactaaagtattagaatgagaaaaaagactttccttagcagacacaggaaaggacaaacactggtcttggtcctaggtaatgcaagggaactggcacagggatatgtctgggactactgtgtggtaatcaggttgcaattcagttgaacattctggcaggatttggggaatccaacaaaagcgtcacatggttactcaatttggggaacaatgatgataataaatggacactggagaaattgggaaggaggtattaaaagattttcattatctccatattactgtttaaaagcactttatggtatactcaggaaaaataagcagctcagatcacaaacaagccactggaacaaactccctatgtgactctccagcccagtggaagggctattagagttcagggaacttgggaccttggggccattccacctgggttgaagtccccgtgcggctacttcactttcccttgggaaaattgccaaatcctaatgaacctcaatttctctatctgcaagatgggaaaaacaatatacatatctctcaggattgtttgcaaggtgtctagtatagtgacagacatggattaagtaattgttaaatggatgctacagtatttattgggaaa

SEQ ID NO: 118716 - DNA, 1048 bp, Homo sapiens
atgagttctttcttcatagtgataagtccaaggacaatcccatgcagaacttagcaagatttcccaagtgcaattgcaatgtctgctctgaatgaagtgacctgccaggacgatttgccgtcaattgagagctggtcttgtgttaggtactgcgtagatctggtggatgataagtcattagaagtggcctccctcattatttaaattacatttattaagcacatatctgtgaacacgcaaagatactgcctttcaagattgtataatagctctgatgatattttcagggacttaagaactgatctgttcatatttctatattggcataaatgcaaaaacaaaaacaaaaaacctgctttattaaagcctgtaaaaatgcacgttagataagtctcaaagcagtttaattaatatacttgataatagtaacaatagttaccttttgaacatttataagtactttatacattatgtcactaatgttcttgtaaacttgcaaggtagccatttctatatttcctcaattctaagatggacatttctttacattttctgaaattgaactggatcttgtagttgatttatatctatataatatataaatattataatatatataatatatataatatataatataatataatatataatatataaacgtatatatgtattttaatatacagtaaagcttatattttttcctgaaatgttattattcaataaatgctgttccatagaactcagtcactataatgattttcccacattattcttgaaaactctcagattcagaggggttgcataactttctcaggataacaaggcaagcaagaaacaaagttaccttaggaaagtttaatcccaaagtctatgagtgacgatgataataatacctatcatttaataagcaattgcatttccaagtgctttacaacattatcatctcatttaaccctcaatgtatctctttgagaagatacatgaatggttcataagcaaacaaaaagatactcaacatcactagtcattagggaaatgcaaatca

SEQ ID NO: 118717 - DNA, 1794 bp, Homo sapiens
gctgtttaactgcaaggcaggtgttgtggtgcagtgatgtcaaagaaaacattggctatgtcaccagcatttactatttgcttggcagaagatattaatggtagggtttatatgtgtgtcttgagcatatatgtgtaccgtttggggttgggggaacatgaggatagaaggatgtgagcccattgagtttgtactgtgatacataccttctccagattggatcttataacaatcattgtatagatgaccacttgatttggtgggtagctaatatggtatatttatttcacagtttcacatctttatcattgtttttatataaaaacaatgcttaagtggggtttcagaacagatatttccttttaaactttttttaaaaaatcacaaatatgattggctcatacaaccacatttcacctcttttcaccagcactcccacccattcccgttagaaatattttgttaaaaaaatcaggtgatcaaactcatagaaactgaattgtgagaagtataatgggaaaaggaatgagaacctgtggctctagggagttacagaagggaaatcatcttttagagccttggtttatttctgacaggaaaggtaaagccgtgcatttattagaacaggaagctaagaaattaaagatggcgagattgtctaaaataactgaggctgaactggaagcctttaccctggcacactcaaaaatcacttttggtactgttggctgagactggccgaggaatgtgcatctctggctggatttggagagggcagctcacccgcaacctgaacataggttctgtaacgtatctcattgttactcagaaagttcagtactcagggccagcacgctcctgctcatgcgggataagccactcatagcagaccagctggaaggatcagggatctgagcaaagccaagtttacttaagctaagccacttgttcctgggtcaagcagtttgttttctaataagcatcattcctgatcattagagcaaagggatgaatgctcctcttggaatgatacaggggatctgccactgggagagtgttgctcagtgttagagtagcagcaatgacagaatgacagcgactctctgagtcaacccagtacttttagtaccccatcactatgtgaataaaggcagctagaaaatggactcaattctgcaagccttcatggcaacagcccatattaagacttctagaacaagttaaaaaaaaatcttccatttccatccatgcatgggaaaagggctttagtatagtttaggatggatgtgtgtataataataaaatgataagatatgcatagtgggggaataaagcctcagagtccttccagtatggggaatccattgtatcttagaaccgagggatttgtttagattgttgatctactaattttttcttcacttatatttgaattttcaatgataggacttattggaaattggggataattctgttgtggtattaaataatattcattatttaaaaactcatcttggtattgagttagtgcattgacttccaatgaattgacataagcccatatttcattttaaccagaaacaaaaactagaaaatgttactccctaaataggcaacaatgtattttataagcactgcagagatttagtaaaaaacatgtatagttactttagaaacaacttctgacacttgagggttacccaatggtctccttcccattctttatatgaggtaaatgcaaaccagggagccaccgaataaacagccctgagtacatttgtaatcttgggctcc

SEQ ID NO: 118718 - DNA, 3571 bp, Homo sapiens
aaatggaaacccagtgtttgatatccactctttgtttttaaggctctcttaaatcaagaggcgtacggccattaggtgccaacaaaaaccagttaagccagaaactgtgaattttgttttgtttcaccaataatgtgccttttatttttatatagtgacctcacagccaaagttccaataaaaaagagataacatttatggagcatgcaacaatcggccaggaactgtaagtgttctgcacacttggtatcgttgtgtgcactgcacacattgcatcattggaggctataaggacatttttcctattttacagagaaggaaataaggtacaaagaggttaagtcaggtcacacagctaactggtgacaggcagagccagggcagaaacctaagctgactcaggtcaaagccagcctcctaacctctccagtatcctccctggattcttcacagggtcagtttgtttcttcccatcacccttatgagttactggctttggagatggaaagttcagtggacatttctaaggtgggaaagtgaaaggggcatgatcttattattgtttgcatttctttcatttctgttattgtctagcttggatccagattctggagacttctaacaacttgtaagaatgaggctgtatggtgtagtggatgaagcacaggttttgttttgttttgttttctttttgagacagagtttcactctcattgcccaggctggagtgcactggcatgatctcaactcactgcaacctctggctcccgggttcaagtgattctcctgcctcagcctcccgagtagctgagactacaggcgtgtgccaccatgcccagccaatttttgtgtttttagtagcgacgggattttaccatgttggccaggctggtcacgaactactgacctcaggtgatccccccacctcagcctcccaaagtgctgggattacaggcgtgagccaccgcacccagcccaggcagaagtcttgaggccaaatagacctgggttcaaatcgaagctctgccacttcccaactatgtaaccttgagccggccattgaatctccttgaatcactgttttcccctctgcaaaatggattaatatcatctaccttataggactattgtcaggatgagagatagggtaggtgaggtgcttagtacatagttgtcacataaaaaattgtagctattaactagcatttatacaccatggacttccgtcctttcatgcaacttgtaacatcaagtctctctatctgagaaaaagcaaaataaaaaaataaaaacacctctgatggactgcactatggtgattattcttaatattttcccccagcaaactgcataaaagttactttactcctgtgttctatttggaaaacattacaaaactttgagcagacagtggtgctgtgacaacacagtgcttaccaaagcacagtatgcttttctgataaagatgtaactttattgccctttatgtactctcttggttaatatagtaagcaaatgggagataatttgaaatacctttactaccatttatagtgtcagaacatacaacttgcctttaaaaatgtgaaagattcattgcaatagaaggcattgtgtatacatacaaatgcatttttaaaacaatcaccagtggagtgctgagaggaatcatgagctgagatctttcacctttgtagagatgaaataggatgttcttgttaactgtgttcttggagcagtgagccaggctgctccaatatgcactgtgggcaagatgccagcttttgtgatctcctttgcaggaacttttagatggaagaggtgaaaagcagggtcctctaggctaacaaatgactttaagtcttttctggggaagaatgatctgatttgctagtaaagattccagagatgcccctgcctcaaatttctggtgggtgggttagggtgtggaacagttctggcagattgagagagatcatcaagacacaggccacagataatgccattcaatctttatgaggtcgcggcttgctgttgttctatagatgttgtaatcttgcagccctgcttctgcataggctgagcatgaagctgagtgcacagaatcctttgaggaggtcatgggattggtgaaaagatgctaggcctagaagacatggcttctagtcttggctgtgccctgtttgattttggacgcatcctgtgtcgtctcccaccctagtttctactaacatgacatataagctggctgcacttcatcaagtcccagctactgattttctgggagtatgtaatatgtgtataaccatgtatcagattgattaggacccatttgtgtgactgatatcacatgtccaaaatagtttcacatttataatcttaatttttaaccatactacaaacctgtgagatagaaagggtgaatatatttgttccctttgacgtattagaaaacttaggcaaatagagattcagttaatagtagagtccaggtctcttgactctcattcttgggttcccacactaaattaaactggattagtcttttgggataagtctgaaatggaatgcaactagattctttgtggaaaaaataacttaataaattctattcaattcctaaatgagtagataaaaaacaaagttgtatttcccttgttgagaatttgcctttgaatccctctgtgaaatgaattagaatgttttcttaggatgtaagaaatatacaaactcagaaaaagcacatctcacatattttttaatggataatttctcctgggacttctttacattctgaaaattcactttattattgcattctaaagtttgtggctttaaatgccatggcatctgagtctaacttttattggtgatatttgtggttatcagtttccactgtcaccctgtcccatttcctttgttttgttccatagatatgatttggtttatgaatgagggcttttcgatccttcaagatatgtttttgtgaattggttcaataatttgttattgaaaagcaaaatccatcagagacatgtttgcctacttcctttaaaaagaaatattttcatagagaccaactgtctattcatcattcatgcctcttctttgtatgttttaaggacatagccacaattcttgttcgttaaatgtgtccatgaatgtattcaacctgaaatcccagcttcaaaacttctaaaatttggaaattacacaagtgtcttagtccaaaaagaaactgcaggcctctgccttgggtgcagacacagagtaagttggcaggccagactcaaagaggccctgagaaggagaaggaagtctgactctcattcttgggttcccacactaaattaaactggattagtcttttgagataagtctgaaatggaatgcaactagattctttgtggaaaaaatttggagttgcctttttatgtcacaactctgatgatcgcatatttctcagctgagtgctccctcctttcattactctgagttcttagtgaagcttttgactcagacccctgaccttgagggctacctatgaggcatcattcaagccagctgcccc

SEQ ID NO: 118719 - DNA, 2022 bp, Homo sapiens
tttcaaagtccagggcttgactctgacacaaaggtgtggagaaagctgtggaaaagggggtaggaggtggacgctggttgctccagtgttctttctaaagaattgatcacatcttataccagtgaagagaactactggggctaagggaggtctaagcttttggcaaaagggaaatgcatgaggaattcaggccctaccaggtctccttacttggaccctcctacactgtggctgcccaaatgaaacttggcttcccagagttggctgacagagcaagagcttgtttaatttgtgagtactggacaccaaatcattatttgtggcagctctgatattggcagatgggagatttagctctgtcctgtttatataacagcagttgatagatagtgacttcatagttggatatttatgagaggtttcatttcaaataatatagttttggcccatggcaatgctaaggctcttacccattattactgagaagctaaatctttaggatattgtaactataactgcagggtccttttgatgtacccggaagagctacaaaagttaatatttttcgaagcgatgaaagctttattataaaaagtctcattaggaagttatctgtccctaaaacatatagcctatcagaaggtcgggtatatagaaaggcaacatttcatacttttctttcactctgtgacttctatcacataacaacgtaattaaaaagaaaaaaaagtctcctgctttccattacagaaaccaaatgccttgccattgactgagtagcagcataaccatcgttgacaagcacctcattttaaaattcaccttaataaaaaaccgcttaaatccaaagggcatcagcctaatggctaaggtcagcatgaacataaaccacaaataacttctccaatcagaaacattccaaactcctccctgaccagagacatgctagccccaagataaccccccaccagctgggaggatgccagccttgagataaccccactccggctggaaagatgtcagccccaagataacttcccctccacccagagacattccaaccccaccataaacttctccttcacacagaaacactccaagcttgtgataagccccctcaccctaaaaccaatatatactgttagtctgcaagagaaagtgctcctgactgaaattggccagaagcccctctcagggttatctctctaaaataaacctgtctttgactgttaagctgcgttttgtgtttcctctctctttctttaactcttacagccatgccctctagccagttcctggttttgagggaagctggtgaagtccatcctcactgttttaggacaataaccatggctgtgttaggcgctgaggctgttcacagtcctgtaagctgtcatcagatagtgagtgtcctgtgtttccccagttgtgaaagaagattatccctattttaacactactggaggagatctttgggattctgtgggttttaaatccttattctgtgatagcagacccttggcagcagtggaagtggcaggatctgaaaaggatgattgggttaagtggtgcaaagactctttaaggataggcactgggaatctgtggagaagcccgatgctgctcagctgttcccaaaaggaaggtagaggcactggaggacctgagtcatggtggctctcttggtttgtgggagacagagcaagagttaaaatggttggaggaaaattgggcaagaaatgatggtgatgggtaacttagcagagggcttaaatttttccttttcatgggccaggcaaggtggctcatgcctgtaatcccagcactttgggaggctgaagcaagtggatcacaaggtcaagagattgagaccatcctggccaacatggtgaaaccccatctctactaaaaatacaaaaattacctgggcatggtggcacgtgcctgcagtcccagctacttgggaggctgaggcaggagaatcgcttgaacccgggaggtggaggttgcagtgagctgaga

SEQ ID NO: 118720 - DNA, 1393 bp, Homo sapiens
ccggcagcacgctcgctgaccgcggctttagtgttgccagggcaggtgggagtcccagctgggccggctttggcgcgcctcgcgcggctgccgagcggtggagcagccttcccgccttcccgccgcgtcgccggcgcggctctatcgtcagcctccctccacacagttgagccccagccggagcgggggcttgggatccaccgaaggagcggcggcagcggttggactttaattggccagaggagacaggggctgcgtctggggggagttgcgagggagggctacgcggccgcctcttcggaggaggaaacccgggccgggcgcgggcgcgggcgcggacgcgaggatcgcagaggctacgaagatgggacgcgtgcttgtatatcctcgggctgctctgacatccccgttcagttattcagcaaacatttattatctccccactgtgtctcaagcattgtggaaagttctggggataaaggatgacatcttactatcctcgccctcatacagttaacagagaattacagtacaagtgaaaaatgtatggtagaaatagtcacagtatcatagcacagaaaagggggtagccagccaaatgtgtatgttgagaaggagtgaagcagagctgctatgctcttagctgagagatgctttaagattctttgagcctccattcttccatttattaattattgagcgcctactatgctaggcgctgaagatacaacagctctgaacaaaactatggtttctactctcagggaacttgcagtctactggtccttgaaagagtcgtagttgtttgccaggtgaagaggaagggaaggatatggaggtagaaggacgtgtgagccaaggcaaagaattgtggaagaacatggtgtactgcagaaagttgagtctggttgggacaaagggatgggatcaggggaggcagtgggtggcaggagatgaccccagggagggaagggaatttcataatatggtgacagtgtatctaagaatctcattccccttgtagactcttttgaaccccctgtgatcacactgatttataacttggctgatttattgattcttctaaagggtcttttttttaaaaccagttactgtctgataatcgacagttctagaatgttatgtagtaagcccgacacattaccttttgacttcatgccatttctaagggtcctcaggtcaaaataatgtattaccactttagtaaatatgccctctgggaaattttcacaggaagaatcttacaaggaggatttatggattgtaaataggtaatcagatgttcacagagcccgagtaaatcttgagagtaaattaaaaggtatggtggaactttggaattttttcatacatggaaaggtgatgtacagtt

SEQ ID NO: 118721 - DNA, 1030 bp, Homo sapiens
tgcctcccgggttccagtgattctcttgcctcagcctcctgggtagctgggattacagttgcaagccaccatgccctgctaatttttgtatttttagtagagacagggtttctccatgttggccaggctgacctcgaattcctgacctcaggtgatccgcccacttcggcctcccaaagtgctaggattacaggagtgagccaccgcgcccggccctgtttgcagttttaacagcaaggcttagaaaggttaaattatttgcccgaggtcacttaataagtgagtggcagattccaaaggttgtgtccactctgttggaccagtggttttcaaatcgaaccatgacatttctaagaccccactactctctactcgcattcccagagcagcttgagaaatccctggccctggcagccacagttagaaaatattgcttgatctactgtctgtgaatatcagggggaggtgttgagttgagtctttatagaagaataattgggaggactttatgacaaattaggtatgtccctggaattagccatactgagattagagggcagagtccacaagactgccctttcttctcagaccaagtgcaagtttgggggtttcccaaaaccaccctcaggttcagtagttgactcacagaattcaccgaaagttgtcatactcagttgcagtttgttacagggacaggatacagattaaaattggtcaaaggaaggtgacacagggcaacatctgtgcaggtttcaaaactaagcttctgttggcctcaggacatgttgtgctccctgcatcaatatatggcaatatgcactaattattgcaaactgggtgagctcacctagacttcattatacagggtttttactggggcttcagttcttaggtatgattgattgattgtccacgtgtttgaaatcagtcctaggttgactattaccttgtgacccaaagtcctgatcctaaacatgtaattggtgtttctggtgtggccagcccccagcctaccactattgggtatggc

SEQ ID NO: 118722 - DNA, 1050 bp, Homo sapiens
cccatccatctccctaacctcatctggtatctccttgctgtgtttatcagccgcactgacctttaatgctttgagatgactaaattccactctactgaaggaccctggtaaatgttctttctttgcctggactgccttctagtctttttaaaatctgattcactgttgtaggtctcagcataaatattatttcttgaggcctacctttccaaatccttgttgtagacaagttctccctttcttgtacttttccattgcagaactatcaatttgtaagtaaataatttggggagtaggagatgggcctgttttgtttgcaactgtatcccctagtaagtagttgtatatcgataaacatgtattgaattaatgaatacacatgtgatatttgtatcccttgttttttgtggttaaatatttacctcatttttttcattgaagtaaaatgttaatttttttttctttgaagagtttggctgaattggaagtgttatgtactcatctctacatagggactgatcttacacaaagaatagaggctgagaaagcactcttggaacttattgacagtccagaatgtctcagcaagtgtcaacttttattagaacaaggaacagtaagtatttggtaacaatgattaaccatgaaagatcagtagatgtatgtcattgttaatgaactcgtgtgttagcaatggtaactgatagatattgccacatggtttttttgtttttgtgaaactatagtttcactgtcaaaggggttaatcaggaaaagaattggaaaacctggaaagcaaacttagggaagagccaggaaatgaaataggaatgaattgagatagtttcttgattactattggtctctttttatgtctcatattagtgggcaaatttacatttttaggaagttgactaacaacttaaaaaaatctagataggggaggcagattgtaattacctcagaaacatgaaaggatgattcgaaagcatgctgattacctcttgcctgcctcccatctagatattcatagtctagacattcatattc

SEQ ID NO: 118723 - DNA, 1113 bp, Homo sapiens
atttgctcccaccagaaactagtaatcttattttctctgcacatataactttggctgctgtaataaaacaatgttgatttaattaactcatcatcggtaaatggctgtgtgattggctaacaaatgagccacttggaaactttggttgcagtctcattttttatatttgtaaagacagtctactatgatgagatatccaattttctattttttctgacttttgatttcctgagttgggaatattgtgatgggaatattggggatattgcttggtctgatattgtcagcatgtattgtattcttttaggacaaccatagtaccattacataaaaagcacattgttttgctatgtaatcaatgaaagaatagtccatactccattgtgccttaaaaattagatatttgaagtccatttttatcttttcttatttcgatatgatagacatgtgctggtaataataaaaggtatgtgtcatgtcatgacaacacccatggctctctaggcactgtagagttgtagctacctcactgtggtttatgatacgctgagcagcagtaggaagcactgagcgccacatgtggtctctgttttagctattcaattctgccatcgtggcatgaaagcagccataggcagtgtgtaaatgaatgagcatggctgtgttttaataaactttatggacaccaaaatacagatttcatatatttttctgtcacaaaatattgttttgatttttttgaacagctgaaaagctgtttaaaattgcaaaaaacattcttaggtcacaacccatgtaaaaacaggcaggatttggtcaagggccatagtttgccagcctctggtctagagaaaaaaagagggagtatctttgcaagaatttctaggaggtggagtgaatacatgaaccaaattttcaagggtgagcatgcgtttagacagtttgagtatagtattaagataattgggggccagagagaatatagtcagacatgggtttcaaggaacacggaggtcagggtggggaagatttggaaaggaacctaaaggctgtcatggtcagagcaaagtcaagaatggaatcagatgaatttgaagagataatcagaggcca

SEQ ID NO: 118724 - DNA, 1306 bp, Homo sapiens
tataggaatatcactttcaactagaagaatttttctgtggctaattcagttttcttattcatagacaaagttagaatttggagattatcttggagatttctcattttacaggtggaatgtgaggaacagggaagttgttactgcatgatataaaatatggtacatggtttaggagttaatagtcttagtatctatttttattttataatctgtgttgtttatactgcctctgaaagtgtgatgaactttggtttttagtattgggatcagtacgggttgtaggaagaacattaaattgaaacagtctagaaacttgggttctactcaagtttatttccttttttttttttttttttttagtaaattttggtttgctttttcataggtctggttaaactaatttcatctttatctttttaggttgattattctagaccttcagcaaaacacaggaaaatagctacctcatttcgtgatacttctctcaaagacgttttagtgctagcatgctctcttttaaaagaggtaagttatttgataattcaacttcctagttagaatatttgggaaattttaagagtttcaaaagaatttcagttgaattttccccccagttttgccttttaaagaattattgtggacagacttaagtatagtaaatttgcataagtctgtaagcagttccaaaaaattcacttttactcactgggcatatgataaggtgaaatccaaagggaatctaataacttatcttcaggtagtagtttcattgccttcccagtgtagattctttaattatagaagctacttgagtattagtttctttatctgcttgcttatattttgataggatgcagatgaaaaatgaaatgacaatattttcctgattcatcaactatcaaaatttattcatagtttagccaagatcgttgactttaacaacttctttgggaaatagtatttccccatttgctacttagtgccctattgaatattagtgatagcatgattcataatgatactgtattctcttgtataatatagggactccatcatgctattcaagcctgataattggtgtaatatagcattgctgaaagtatgcttcaataagcactagtttccatttatttcaattctttggtttagtaacatgacaactgccacactatgtcagacccaaagaccttctattatcttaaaatttttcttttaacacagaaaattttaacatacacaaaagtagatagaatagtataaccagttaacctgtcagccagttaaacagtagcaactcatggccaat

SEQ ID NO: 118725 - DNA, 2419 bp, Homo sapiens
aagagatgtcaacatatctttcagggttataaagagaatgaattagattaagtgacctagaagaggagagttgcaacttgcttatagaaagggataccaagaaaaaggaagctaatttgttctcccatgttccagaaaaatggtggcacctaaggtacctctgaactcagaattgggaaatggggctgacggggtttgataaaaagtctgtactctgaacagttaaactctccaggatcttctctaccacctgtgcagctaggtgactgccttttcctcccttttctctacctgtgctacttctttactttccaagaccagagtttttttcctcaagaaataaaattggagaggcctcatattcatggataccagatataatagaggaacagtattaattttgtgaaaaacttctaatatggagatcagagactacaacaacaaagggggactttgtgttctgtatcttgactgtggtgatggaaacatgaaccaatacatgtaataaaaaatttcacagactgaaaacacacatctacacacacatgagtacatgtaaaactgggaaatctgaataagattgtggattttatcaatgtgagtttcctcgttgagatattatactgtagttttgcaagaaattaccattgtaggaaaatgggtaggagttcacggggtctttctgtattattttttgcaactgcatgtgaatctacaattatctcagaaagtttaattttaaaatggagggtagttaatagcaacagagacaaggtgaaagtagaaataaacttcagaaagatataaagaatatgcccagagagatgttgagataatgcatccctgaaacaaggacaggatattgttcagagaatgttccaaatttacaggacagttgtcaaaataaaacatccagtggaaaagttgtaagacaaagttaacccaatctcctagaatgtagaacaaaaaagcaaggagatgtttgataggaggaaaaaaaaaccaagaaaactagaagatgaaattaaggaggtgtgacggttaggagttctagaaagagaggatggagaaagaaggaaatttgcaaacagatagtaccccaaaatgttctgagttctgaagggtatgcatttttggattgaaagatcccaccaagttcccagcataatgaatgaaaaaagatattcactaagctttataatcatgacattttagaatagtaaggataaagaaaaaaattctaaaacttaccagaaagaaaaaagtaagtctcctcctacagaggattggggtcaagaaggtattagacttctcaacagcagcactgaaagctagaaaacaatagagaagtatcttcaggcttctgagggaaaattgtttccaaactagaccaaacttatcaaatctaagatagaataaagacattttcagatatgcgagtccttccaaaatttatcccttatgtacttgctctaaggaagctacttgatgtacaagcaaagaaagtggaagataatggaatttgggaaatgggcacttcaacacaagatgacagtgaaagacatagaaaggctacagttgtataacaaagttaaggagcaaccagttcaagttgaaggctctgggaggtaggggtgggtgaatgcaaatgatgggttatttgatgctattgatggtgtggaacatgttatgaagaacattgtgccagtctctcagagcatttggagagaattagtgacagatacacaactaagcacagaaaagatggtatgattaagtccagcgagtattagaaatgtgatgtaattacagctcagccgttaatattatttacatagtcataataaatgtaaacacatagaattgatttaatcacaaattgtgataatagtggatgggtttttgagaggattgattgtggagagagtggtaggggtggtagggttgtggcattcgtgattagacagctaaagcgttacacactgtaataggaatgcagttgatgtctaaagtaaaacaatcaaatgaagaaatagtatacgctattatttggaaacatgaatgtaactatagctaagttgaaaagcagttggaatgggatagggtacagttttttttttattgtaagctttttagtactgtttactttttgatactgtttgaattctcaatgtttatattacttgaatacaaatgaaaatagtaagaagattctcccagttcaaactgtagtgctacatagaggaagtgctacatgaggaagagcctggctagttaatttctctctgtattatttcatctttcaaaggaaaatagctaggaattaaaaataggcctaactggaaggaatggccacatgcagaggccttggatttctcagtttgtgtgatattgtcttactttgttaagatcactgaat

SEQ ID NO: 118726 - DNA, 1134 bp, Homo sapiens
atatagagatacagtttttcagctaaaggcacataataaactcatcatgaatttattatgattctggaagaaaacatttagtatcatatatatcttccttagagcttttttttttttttttgagatcaagtcttgctctgttgcccaggctggagtgcagtggtgcaatcttggctcactgcaacctctacctcccgggttcgagtgattcttctgcctcagcctcttgagtagctgggattacaggcttgcacccaccacctctgctaatttttgtatttttagtggagatggggtttcaccatgttgggcaggctggtctccaactcctgacctcaaatgatccacctgcctcggcctcccaaagtgctgggattacaggcatgagccaccatgctcagcccttagatctcatttgtggtggagatgggtagtttttaaaaatggatgtttccatggctgacttctgtgtttctcttatttttttcttttaggcaaatatgactagagattatctatcttactatgcttctgtcttttaccattgtattacatttctttgcttgctcttaaactactgaagtgattaattcagtatgtccaccttatgaactagaagacataatataaatctgaatgttaatattggagcaagtggccttaaattatgaaattatgttttcttgccctcttgtggacaagtaagagtttgtagattttaaaattttttctgcattaactttagagcttcattgccaatattcatttcagagaattgcaaagctgctattgagtaatttgggtgcttacataaaatattttgttttactttttattttgattttggtttaaaatatctgtaaaatacagatttttaaaggttaaatgatttaaggaggtttacctaattctcttggttattaataaattttggggggtgacatatatcttcagtaagaatgttctacaaaaagcaattgtttttgcatattctcagaagtgttttatgggttatgcatttattttatcttttcaatgttagtatagttgtgaaattttctgttttgctgataaagaggattttaccaatatactttaaaatgtttagttgtttaactcactatcatcaaccaa

SEQ ID NO: 118727 - DNA, 1573 bp, Homo sapiens
ttcattacagggttttaggtaaaaaaattcattgaaatgtatataataaaaattgagaagctatttaaatatctaataattgaataatggcttgagaaactataataaaatctatgtgaagaaataaaatttttacagattatattatagaaaagtttttaaaataattttaagggagagattataaaaccatgtttttcacaggatgtcaactctgaaaaatattcatggaatgattagagggaagtagagtaatattttaatgttactctgggtggtaaaataatagagatgttggtttctttatacttttttgcatttataaatttgctatattatgtgttcattagttttatagtaagaataaaagttaatttaaaaatgtatgtttagtaattttattctgtaattcttattgtaggaagatgtaatattttaaataacttctgctttatttctttgtagcactgggaatttgctcctaacagtgttcattatttattaactctgtggcaaaggatggtagcatctgttccttttgtgaaatcaactgaaccccacctattagacacttatgcaccagaaatcacgaaggcctttatcacttctcggttggactctgttgccatagttgtgaggtattcaaaaactaaatgtttttgttgtatttccttttgacacttggaattttttaagataaagttataaatttaaaattcaccccttttagcgtacagttgtatgatttctgacaagtgcacacaattgtataactaccatcacaattgagatatagattagttccatcaatccagatagttcttttggctcctttttcagtcagcccctctcctcaccctcatctctggcagttactgatctgttttgtgtacctgtaattttttttttgtcttttccagaatgttgtataaatgaaattatacagtatgcagctttttagtctgatttttttccacttagcataatgcatttgagagattcctctgtgttgtgttagtactttactttcattgctgagtagtataccattttgtggatatatcagtttgtttaccaattcacctgttgctggacttttgagttgtttatgtttttggccattgtaaataaaactgatgcaaatactcctgcacagattttgtacaaacataagtttttgtttctcctgggtaaatagctaggtgtgggattcctgggatgcatgttaaatatagtatatattttacttcgtaaaagctgccgaactattttccaaagtggctgtaccattttgcattcccgctcacaatgtatgaaagactcaattgctctgtgttctcactagcacttgatattgttagtttgaaaaaattttactcattctaataactatgtagtggtacctcattgtggttttcccttaatgactaataatgttgagcatattttcatgcacttatttaccatctgtatgtattcattgctagtgtgctagtcaaatccatttcccattttttaattgggttgtatattttctttttttttttttatattgagatttgagcagtctgtg

SEQ ID NO: 118728 - DNA, 1014 bp, Homo sapiens
tttatttaacatgaagtttatttgtggtgaataaaagtgcttcacattctaatgttgtctgcaaacttattctgtgtttgcagagatcacttagatgatccactggatgatactgccactgtgtttcagcagttggagcagttgtgcacggtcagcagatgtgaatatgaaaagacatgtgctcttcttgtgcagttattcgaccaaaatgcacagaattaccaaaaacttctgcatccatattctggtgtaactgtggacatcaccattcaggaaggtcagtaaactttatatgactactgagtattatgttgaatattaagtaacatcattaatcactttaatagttttactgcaagttatttttatgtattttccccaattcctggtcccctaataaaccattaattttattaacctcctgggtatattggtaatttgttggttgatttttttttttttcagttttcctctataagattgataggatatacttctctctggaatcaatatgaagaaaaattgataatggcccttgagcagatagtttatgaacataactatcttaactggttgtgttttcttctttgctatacttgattgcaaactcagaacccaatttcagccaataaaaagtatataatatatcattgtgattttgcttttaggtattagccttcgttatggctttactattatttttattcctcaatttctttattttgtttttaaccctttattgacggaggaggtatttatttctgtatatccttttaggtcctttcaggaacatagggagtaaaaataaatgtatttttccaattttcttgttaagatgcactacaggaatggaaatttctagtagaaagcactttatagttctgaagttgttttgcatatttgtttatcttgtattggaaagtgagtttagtaagagatcataatcaaatttacttccagtgatttcccattttaacttaaaaaaatttttagaagattatcctttacatttga

SEQ ID NO: 118729 - DNA, 1267 bp, Homo sapiens
tgaacaaagaaaattatatgctcttgttatgtgtgctttaatttagatgcttaatggcttttaatgttacaaaataagtttattattatattatgatctcatttgtattatattgtctcgctcttctgtatttgtggtgatatggtcatggtttacgaaaacaataatccgtaagaaataggtcattaacagtagttaacgtttacttgtgatctatggtaatgactgatttctttgggattactgcagttataaaccataattacagattattacagcaataattattttgttaaggaaaaaatgttctatgtttgaacagctgctaaaacaagcaccctgaacatttcaggataaatagaaaaatggaaaattataatggaaatttagtattattataaaatgagatttaaaaaaaattatagatatgaaacttatgtagcagatttttttctctaaatgcaatttagatacgtgtatttacatggttctttaaattttgtgaatgtaattatgttaccaaaataacattttttgtatatatttaaggtgtacggcatgatgttttgataaatacgtagcgaaatgactactacagtcagccaaattatcctatcaccttccatagttaccatttttaaaatttttgtggtaagagcacttaaaatctaatcttttagcaaataaagtattactaactatagtcctcatgctgtacattagtagacttactcctcctgtacaactgcaagtttgtaccatttgacctaatttctaatttcctccctttccttacctctagtaaccaccattttacactctgttcctatgtattctacctttttttaaggttctgcatatgagtgagaccgtatagtatttttctttctgttagtagctaatttccgaaagtagcttcttaacatttactgttttgaacactgtgagtctaaaattgttcagggttaggaaatagtttaacgtttatgagaaatactgtttctctttcatctaaatatcaaaattgtatttgacagcttaataagaacgtctttttttgagacagggtctcactgtcacctaggctagagtgcagtggtgcgatctcggctcactgcaacctttgcctcccaggttcaagctattctcccacctcagcctcctgagttgctgagattacaggcgcatgccaccatgcccagctaattttgatattttttggtagagacagggttttgccatgttggccaggctggtctcgagccca

SEQ ID NO: 118730 - DNA, 1011 bp, Homo sapiens
tacaggcgtgagccactgcaaccagctccaataataatgtctttatatttcactgttcatctctaacattaattctaactcattcagtacttgctcgatttttaaggtttaagaaatatcttcttttcatttctcatacaatagaaaccattgctttctaaaacagagtaaatatgtactctatttttctctaagtaaacttcctttcaaaatttactgtaattttagaagaaaatgctcataattaatcacatgctatctttgcacagcattctttgatctaataagtttaattccaaggtcacagaaattagtacaaatttaaattttgagaaattcacattttatatttagatactttactcattctgtttttaaacaatggtgctcatcatactgcattgcaaaaattattgattttttcctctatcttatctgtctctcactaggctcagttccctgagcatggagtctctctctcccctgccccagcctttcccatacatttgtgtatttagttatatccctagcacagaacatgatacaaagtagatacttacagcagatgtttttctggaatgtcttttacttggaatttttttttttcctggttggagggtgtttgttttactaacagcattagaaagtgtatatggctagtcgtaactagctttaattgtaataagcctctttggtagagaggaaagaacttaaaaattcttattgtgtgacttcattttcttgagcagcatctgacgtaaggcacagaaagaacatggatgttacatattggtatgtcttatgtttttttgtaggtatgatacagaaccacgttaaaaaggggatgacaatttaataatagttacactagccaacatttactgagcacttatagcacttactcatatattttacatgcaaaataccagttggtgcttgtcacaactctatgggccaggtattattatccttgtaagattaagtagcctagtgtaaataagtactagaggc

SEQ ID NO: 118731 - DNA, 1054 bp, Homo sapiens
gtgataggctcatggattgaagattcccagtaaaacaaaggattatggagttgtgagattcatctttgtagatattgaaatcactagtgattatgatataaatattgttggaaagactgacagccaagaaccaatactttcaaaaaacagggggaaataatctgcaggagagtagataattgcaataagaagggatatttgttagtgttgttgatgatgtaagatgtaaaggtgaatgctttcatgatgaagaaagagaaaatattaagtagaaatgaggaacgtgaagatcacctactccatattcaaggcccaagatacacgagaagtggaagaaaaagcagctaccacttgatagagcctacagagaaagcagggtcatcagagtagagcttctatgatagacttttatattgaccctaaaacactgaaattcataaggtaactttctggatactttcagcttcctacatgaagtttttgatctgttacgtttttcatgaattgtatgtcatgaaacttgagtctgtttttcagtggattacttgatcaaattagtgttcttactctcctacttaatctatttcacattcctaatgtataaggctgtataattggtcagttctggtttatttttgttttgtgagagaataaaggatgtgaatacttgccaggttagatttctaatttacaggaatcttgtcaccctaataggttgatatgtctcaccaaaaattataaaagagttgttgattaattgtagtataataatgactgctagtatccatgggagaacagaaagaatttgttctttttctaacttttatttgtcctttctgagtcttctaacaagcagatagcctcttttcttcattattcagttccataccttttaaaaaaacatttttacttgaaagcgtttcttaatcagaaacaattgatttcagtattatgaaatagccctctcatctttgaaaaatcagtctccaagaatagcataaaatttgtttttagcaagataattttatgttgttaattatttgtaaaggtctca

SEQ ID NO: 118732 - DNA, 1028 bp, Homo sapiens
atataaaataatataccttaagcaaaaatcattgaataaatacctccatttctaaattagtcaatttcagctgcccccaaagtaagatttatgaaaactgtagatgttgccatttgtgccactgccttaaatctatttaatcctctactactatcagctgtgaagttaactctaccatcaaacaatgtgaaatcttggattttttaatacatcatgcataaaaatacagaaggaacaaatttattactatctattatgttccaagcaggggaaatatttaaaatgatcacactggtactatcatgacattgaccattcagaaaagatgctggtccttggatcatgagagtacatcctgactgaataacagatctggtcctagacagtttagtgttttgtactcaaatttattttcagtcatgtcttcatggtagacattgttttttccattttacaaatgaaaaccctaagacttaaagagataagtaacttatgcaagatcacatagcaaattagtagagctgggattcaaattagttttatttggctctaaattctatgccattttcagtgttctactgccttgataaacttaaaaccgatctgctttctatccagaactgagttcacaataatttatcactcatttggaagaacagatcattgtgctgattttggaatttcccccaagataagctacgtttctatgaatacttactaaacttttttcttccttattctatattaggacgtcttgcatggctggtatacttagttgggacagttgtaggaggaagattaacatataccagtacagatgagcatgatgctatggatggagaattatcctgtcggtaagtaagagctatgtaatttactgaaattcactaaatagttaaaaaaaattagttattgaactagtattatgagtgaagacattttgtatgtggccttttgaggaaggtattatttccctttttattggtgagaaaaccaaggctcaaaggttaaatgatttgtagaagtca

SEQ ID NO: 118733 - DNA, 1033 bp, Homo sapiens
atcaccttgtagtttatttaaggtaaaattttattattcattaagggcaggatataacttttgttagatgtacctcttgatatttttttgaactttgagtcatgacctcaaaatatttaattatttagaaatacaagattaagtaaaaaggtgaaatacaagactacatacttaatatccttcttcttttactaaaaatttatagtaaatttttactgtagtatagggttttttatgtgtatgccatgcatttattttatcagtttttagtaaaataatatctgtatatacatacagagttttgcatctatatgcatgtatgtgtatgtcttaggaaaaaaaggctagaatgaattagaccaagtagtaatatctctcagtagtaggatttcagatgattcaaaaaatattttctttatatttttttattttcccactttttacagtgattatatgttatattacatttatggtaaatgttttaatgttgtttctctaaggttttgtactgaaggttttttttttattttcccttcatgaagagtttttcagcttatatctttaatggataccggattgcctcgatgttgtaatgagaaaatagagcttgcaattctgtggttcttggatcagtttcgtaaaacatatgttggtgatcaacttcaaagaacctcaaaggtaggtttctactagagagtttaaaacatgttattggggatgaagaaagatgtacatatataactgaatgatatatttgggaaatttctacataagacgtgtaattgattaatgaattgatgaattggtgatgaagtgcaatgtaaaattaagttgcttgttttatacctagtttaccattttctttaaagattgagtggcagagaggtaatgaatatgttttacatggatggtcattaaacagttgagattattttaaacactaatcaattttgccttattgtatttcaagactgaaagcataagatttgcttttttagtagttccagggttttttggacacttatttatttat

SEQ ID NO: 118734 - DNA, 1043 bp, Homo sapiens
tttcttggcatttgtacatgattaaataatgaggactaggaaaattagatgtgtccttaggagactgcatataaccttaatgttaggaatactcatagtatgataattgaatgtttagcatcagtaagttaagatgacttgatcttaaagtataatgaaagattattaagggcatttatgtgaaacctaagcagatatttagtagcattagatactgacactgagtaaaatcttcgccataagaagttctaaggatattctcatttcatttgaacttagtttgttttagtgatgttgtaggattttttatttgaaaattctaaaataaactttttatactcattttagctgttttatcttaggaaatgtaaccttcagtttacttaggattttctgataataataattgtgtagtagtgtgaaaaaattttttgtttgattttaagattatcctttagtttatttcaggtaaaatattcttttttaaggaaatgatgccattttataatttctttctcaaatatattatgatattatcatttaggattaatatcaataaaattctcttagaatttagctgccaccaaatgagaccatttggaagaaaaagagtagctagaaataaatgttttaggttgtcagtaagacaacttagaatcagacaataattacatactataaaatttatataacagagtgcctttttaataatcccagatgtgatacttgaagattgaatataaatcaaatgatgataaattttcttgtttaatatgtccagagagtatctttgcttttgcaaaagggttactctcaaaatattgctaatacagtatccatttggtgtaggtcttaaatcaaaacagtataatatggagtagaaaatccttctaagtgttgttttgaaggcacctggaaggaactatgtaaaatgagactagttgttttagggctatgggatttcggattttgtttcaaaacttttaatataaggtaattgtgaaaaaaagcgaattacagattagtttttcgtttttgaaaaa

SEQ ID NO: 118735 - DNA, 1102 bp, Homo sapiens
taataaaggatatattcttgagttggaaaatgatgctgacttgagtgaaattattcagcagttataaataaggtgtaatattaagcatcttgaacattttataaaagcctgtatagacaacagaatataatttatagaagtaagttcttcaggaaccaaggtggaattactaaagtgtcctaagtgatgtatgtgatagaagtcctatatgtgagaaagaatgttgtaaatagtagccataggcatttattgagcaacaagtctgtgtcaaatactttgctcagaacttgaaaggcattatataatttcattgtcacaaaaatgctatgaaaatagcgattttgttaaaatccttcctttctgtagacatggaaattgaggtttagaggggttaaccaatgtgtttaagtggttcaacctggatttgaaccctaggcacctgactgcagagcctgagctgctgaccactttggtatattgcctcctttttattggatctttccactgggatgttgaatgggcccttgaaacttatttccaaaaaggaactcactatcttttagaactctgtcttcctacttcccatattttaaagaagaatgacattgaatttcccttttgtacctcttgtatccaatctgtcacctaatcctgtgaattttacttttggagtatctctcaggtgtactcctttcttctgcccctttctttttagcctcactttcactgcttgttatttcctatggaatttcaaaagtattctacttgccctctttgtttccattttgcttctccccactccactctattttccatactgccactggagtatttttttattagaaaaccaaagaataatgtaataaacactcatatgcccatcattcagttttgtcaagtcttaatgctttgctatatttgcttcagatctgtatatttttgagttaaacatgaataatcctgttgctgctctgatttcacttctctagcttcttgccccactgtcctaaatttagtattattctcatccatgattttgtactttttctacatttctgtgtatatataaacaaaacacagcactgttaactttatataaaag

SEQ ID NO: 118736 - DNA, 1021 bp, Homo sapiens
aaagtgaagtgaaaaaatcagtatgtgttgtggtagctgcttggataggggtaccatcttgtctgggagtgtatacctatgctagtttcctcctttttattttttgccttcattcttctgaatttacatatttcctaaaaatttccaaattgcttttcaggaagattttcaaggcattgggaaggttatgaagccagagggagtgaaaacagaatagtaatttataaataaagttaccatacatccagatttgcctgagatttccccagctcacgcttgttgtcttggcagattgttagttaatagcttcatctttcattctcaaaaatgtctctgtttggatgataaattatatgatctccttgcatataaaccacaagtttctaaagaggataatatagtaattcataaataagtttgtaaaggccaggaagtgaacctttccttttgactctgtggctctcagtacctgagtaaaagccttgtttataagtgtcatgaactagtgatatataagcatgtttagatcttttttgtggaataacttgaaatttgcattaagccgataagtgctccagtagtgtaactatagtgaacaataatttattgtatattttaaaatcactaaacaagtagaattggaatgctcctaacacaaatggcaaatgcttgaggtaatggataccccaattaccctgatgtttattacacactgtatgcctttatcaaaacatcaaatgaaccccataaacatatatatatatatacctgtgatgtacccataataattgcaaatctagaaattttttaaaagataagttctcattgatgtattttcaaattgtccaaaataaaaacggggaattatctaaactttcaagctttatctgtgtatatggatttctaaattgttttgtgtaattacttattattcaacctttttcctactgttgagtacacatatgaagcagcagatggcattctttccctgcaattgttatgtcttcctgtatggtatgtt

SEQ ID NO: 118737 - DNA, 1783 bp, Homo sapiens
agttactaaattttacgacttgaaaacccagtccctccatcagtctgtaattttttttaatagtcattggatcttgtggaaatcatcaacaaggcaatcttcgtccacaaatcagaaggctagggccacaaatatgcatattttccctgataaaagattttcataattaaaattttatgtctacagttcattatatatgtattatacatacatgatctttgcacttatgtgatagttcttgcttctggaataaggatggatgttgttgaacattcagagactctgccagatacctcttactgtttattatttttgtaccaaattaaatatgccattatttgactggaaaaaaattagccaggcatggtggcaatgcacctatagtcctagctactggcaaccagtttgtaagatgaagatgggaagccttccttaccggagtcttgggtagaatttgctatcttaaaaatattcaagttgcttaaagtaagatcatgtgtgaatacacgtcagtaactttggtatttcagtaataaagtcataggcaaaccctctactaagtttttactagaaatatgttcacctgtaatggtggtgctaaaattattatttgtcaaaaatagttgtcagtgagaatctcatactacatacttggaagtattttctaatgcttataattgacttaagtatcttgcttgaagggaatcaggatgagatataatctatcctacttgtgctgcagaaacgctgaagctattcagtctgtgtaaataatccatcccacatctttgcttcctcttcagtgaatgcttaacatccatatattatgatggcttgagtatcatttggaaacataagtcataatagctacaagtttgtaatcgaaatattgcgaaaagaattttaggtttcaagatagtgatcctttaatgtcaaatgtttcctgcaaaactgaatgaggaatattgtggattatttaatttttaatcatttatttcatgattatttaaaagttccctatattaattaatcacttctatactaatatgttatactgttttggtaggataagtgtaagaagataatcattggatattattcccaaggcaaattagtatttggagaatagatacgtttagcctgagagcttggtattaagtagtttaaacatcttaataatgtattggagtatgtgtgtttttatattttttcctcagatgtatactggtctttgctaactcatgttcttatctaatatccaggaaggaaagttaagaagttaggcttactgaaaaatatatatgactgttaagccagaatttcagactatcaactttcatgtatacagtatgattacaaagatgtaaaacaaacaatgaaagctaaagtattagcaaaaggacagaggaaatatgacaaaatatttattgtctttagtactaaaacaatgagcatgtattttcttgttttttatattttcacattttccctacttgttatatacatttgggaaaatcagcaaagtccaagttaaagtgcttaactataattgtctaagtttgaatggtattgccattgttcagatgatacttttaagcaacaatttaattcatagcatagtttgcaatttattgaataaaaatttaaaaatatggtatcaataattattctccaattatactatattgtcttataactttagattctactacacataaatgaatgcaatgtgtatttattagattcccactgatttcagcgaaagttgtggcttactatattt

SEQ ID NO: 118738 - DNA, 1134 bp, Homo sapiens
aaacatagctgctgttattggtaagaataagaagaactatttttaaaattttaccactatttaaatttaatgggaaaattctctttgaaagaattatgtgtaatctttagaacatctaatgtaattctaaatttgtgttggaaaccaaccaatttatcacagattgatttttggagaagaatttggaaacagttggtctttggggcatgtatttatggtgattatacatgttgtttcctaataccaggcagaacttggaattaaaaccagacagtttgattctaaagtcaagactctagaaaaagacaaaagtgtgacttctggcctgatgaaatctgtaatgagttcaaaagctctgcttctcccctcagttgcttttgatgcttgtgttgcatttgtgtttccatccattcctcctcttttgctctcctctgctatccttttcgggggtagtagtcatgaaataaactggctattaactctatctgtgacactaattctctcttttgttttccttgccagtaaaataaaataataatattcattgctctttttggtaattgaatcagtgtaatcagtgtgttatgccaacatcccttcattagttatgttgcctcttttgtcagaaaataatttgaataggaaagaggagagagcaggaaagacatttcataattaatcaagatatgaatactgtactaccttaaaaaataagcattgcccagtctacttaacagaattatgaatgctaaataaatatactgtatgtgaaagtaagttgtaaactataaagcattgtgcatatctccatggtacatgtcaaatcagcatactacctttcacctgcttacaaactgaccaaaaagaaaattaaagtggtgattctgaagagaaggaaaatgaatgggtttgtttctgtggagggtataggagagtgggagagaatgtcagagaggaagaaaggaggtaagatttttatgtatatcaaaggggatggggttttaaaaggttagaaatgttgaattagagtagtggcctcaaactgaggtcccagattagcagtgtcagtccacctggaaacgttaaaaatgcaaattctcgagccctgctccacatcttctgaattagaagctc

SEQ ID NO: 118739 - DNA, 1051 bp, Homo sapiens
tatcaacgagtttaagctctcttttcataaatgactcattatattcactttttactttttgaccatgacgttgttggatttattctaaagggatagtatacctataatttaaacttaaatctagatcttatgtcagaaaacatctaagaatttgtaactggtaaatgttgataatatttagaataataacattgcctttataactgatacctattcaaggcctataaagacagtaagaattccctatgaaatgagaattagttctggtgtatattcagatgtctgctttcaaatattcctagttaaatcagccagttgaagaaagtcaaactgtatattgcattaattaaattattaagatttttatgatcttacgtggtgattttatgtgttacagttgaaacatttccgagacatgttgtatgcatatcttttctttaagatcttgacatttatggccaagctacgtacccatttttgcatttaccatgttgtcttttacaaggtgtcaattagcatgtattttctatgtattaggttaaagatgggtttgtgtggtttttactttcaaagtaaattgttctccaatttattttgtaacctacttttattttgtaacctacttttctttcctgttttgacttcagagaaaccaaaccaaataaaattatagtatgaaggtccttaaaaatattcctatctgttgacacagtgtttcatgtctggaagtgcagtctgaataaataatttgaaatacagacaaagctttgtataccaaggtattaatcccagtgatatttgatagagtcgatggttgattaaataggttgtacagccatatgatgaaatatgaggcagataatgaaacttgtttactgaatgtaaaaagttttgttctttaccccattgtactccctctttctaggcataaccactgtatcactctagacattttcctttatgaaaaatgttttacatgattgatgttttgcatataatcttacatttaaaagggagggggtgaacaaattataaacatataaatgttttt

SEQ ID NO: 118740 - DNA, 1485 bp, Homo sapiens
cctatatcagtgtttgcaataattaaattttaagtatatttctataattgtaaataaaatcctgacatttgttacaggatggggttttctttcatcatatttttataataaaaattaagcagttataaaaataaatagcctagtttttcaattggtataagctggctttattttatactgctaataaaggcacattatgttcaagcattgcaattatcgctgaaatgcatgtccattaactgaaacattaggctgagtatataattactgtctagagccaatatctttgtgaagctgtacctataatgctattaaactataaacaatatttgtaaactaatatttaaataattcagaattgatataatctttttgtaaacttaaaaatgaatgctatatacatttagtttgattgtttttacgtgcttagaaaaatatgggaattctcaaagataattgaaatatgtgtcttgagatagatgaatttttaatatagttgctataacctaatacctattattctttctgaagtcttttgttccatattttttattgtggtaagaaatatacaacataaaatttactatcttaaccattttaaagtatgcagttcagtgatattaaatacattcatattgttgtgcaaccatcaccaccattcatctccagaagtcttttcatctgcacaactgaaacactatacccattaaacaataatttgcatcctcccaccagtccttggcaactaccattctagttattgtctcagtgattgtgacaaccctaggtacttcatgtaagtggaatcacatggtattagtgtgcttgtgactggcttattttacttcacataatgtccttaagggtagcttatattgtagcagacatcagaatttttttctattttaagactattattcccttgtatatgtatatcacattttgcttatccattcattcatcagtagacacttgggttgcttccatgttttagctatcatgaataatgctgctatgaatatggatatacaaatatctcttcgagaccctgctttcaattcttttggagtagaattgctgcatcatgggtaattttgtgtttatttttttgaggaacctccatgctcttttctacagcagttgtaccacttaatatttccaccagcattgcacaaggattcgagtttctccacatcctcaccaacacttattttctactttgttttactgaagtcttttattcatacaaaatatgtataaattctgtttacaaaaaaaatgatgtagctatagtcaagctttttaacttgaaaggtcttttggggcctatcaatgcaaaattgcttttaaatctgaatatattgactattgaaatctactgtgtcacacgcatccgtgtcatgcgcgtccgtgtgaagagaccaccaaacagcctttgtgtgagcaacaagtctgtttatttcatctgggtgcaggcgggctgag

SEQ ID NO: 118741 - DNA, 2260 bp, Homo sapiens
ttgagcaagagaacatttctttggctggaaaggcaactttttaaagcattcattatttggaaccatgttactgttggaacctaaataaagtagttatttacttgagtctatattaggacaactaagttagtatggacttagaaattgttgggtacaaaccctgtgtttctatctcgttatgtttgtgtaatatgtgcagaagaatcaaaatatttattgggtgttttaaaatgtctccagtggtatctctcttgaacagaaaagccatttatttaattctgcttcagattctagtagaaaattatttcccactagatcataagtgttttaagatgattaggttcctgtatgtgcattgtatgagtatgtgaacatatcctaacccaattttataaatatataaagtaatttaaatatttagaaatctcaacattaaaccaagaatgtcatccacattaaagtgtgtattaaatatttgaatctgtattgtaatgaactcagtaggcatgtttcaaagacttaggaagtagcacagatttccattatgctcttgggctgggcaagtcaattacatcctcaaagggttgtaattttgtagaaattagcagactacaaaggatgcttgatggttgtatctgactggctttggaaatgcttacatttctaagactgtgaatttttaaataatctttcctactttttttcctacttttatccttcttgtatgtttttgtaaccagtagttttttaggtagacacatatgtgaactttaaacatttccatatttatagttagtgtaattattacaacatctgtttcaatatatgaatgaactaaaatttggaaacttaaaagatcagtttttagtctttaaaacattagagcaggatgagctcttaatcatctacacaaagatttacaggctttaaatatgtagatttagattatctgtgatagcattttcattctataccagttaatgcatttcagagacatgtggtgtgtgtattaagggacatgctagctgattgtaccttactgtaagcaaaacaaaattataaaagcagatttgttatgaaaaataagaaatcgatgatttccaaaatcaaaaatgtgactttcggactattctatgtgttgttggattgatctgccttttcttacacaagagcatactgctgaccccaccacaagctttacctgttaagtaaaatatgttgtgtttggaatatagcatagcctagagccaggcattatggagatgatatgctgaaattggggtttcttttcttcattctccctttccagttaggatttgattgcattactgtaataaacattaacattgaaatcatgttttaaatttcttcatgttcattttctggcctctgtaggacacacacagaaaagaccagtgaatgccatttcatctaagaagctctttaaatgcatccaagatgccagaaataaccctttcatacctcctgagtagtagcaacatgtaatggtataggaagaaatattccacctagcttttcttttggtggtgtcttgccattaactcataaaaacgtatatcctactattatctctaccataccttcatgtcattggttagattgcctgatggctactaatgtctcaagttaatagccacagaatatttcagaaaggtggcgtccactttataaaatgtgtctatgattgccaaagtcttatttggctagaaacaactaaatttagttgaccgagtaaaattgtatattcttagaatatgtcacttaaaacaaacaaatagtgatttactttcagttctgaaaatatttagaaggatttgttatctcttgcagaccttcctgcagactactaatgggatgaacacaatatatcacttttataatagtgagctattaaaggcaagcataaagcagtctgaagcccataagtgctgccaacagctcctgctttaatgaattcccttttagatgtccattaaatgctcatggcaaatgtactcataatggaaatggcaaatctaaatgggtagatatgaataatccatggagtttaaattctgtttatgatcatcttcacatttagttttcaagacaacgcagtttagttttcattacagtttggaataaagaggacagggagtaattgattgcttcaagcagattaaaatcaatggttttcttttcaaagaaccagttcaatgcagtaattccaactttaaacattgatttagaggactcaaca

SEQ ID NO: 118742 - DNA, 1918 bp, Homo sapiens
gtgaggctctgtctctgctaaaaataaaaataaaataagagctgggcatggtggcgcattcctgtagtctcagcttctcaggagactgaaacaggaggatcatttgagcccaggagtttgaggctctagtgaaccctgatggggccactgcagcccagcctgggcaagagtgagacctgtctctaaaaaataataataaatgaatgaataaatatcaaataatataaaatgaaagccagaaattagcatatgttcatgattatgaaacactttatgtataaatactttgccaaagcaatagtaacctcttgttaacttagaaaaggcaacatattcttccaaagaggacagcttggtcccaggttgtaattacaagccacttacacattactcttagggttatcatatgtaattaccaccccctttgtaaagcatatattttatttataacacatactgtagttgtagtggtataaaacctgaatgcttgcttaccaaagaactgcaatgagacatgctgcataaaaggaaagcttagaattggctgaggggactatgcctaaatgatgccccagccaactctacctggtatattcttcaatgaagaaaactgtaaaacatcctaatcaaccaacttctttccatgcttgccagagtatatagccactttgaattacatgaatgtttttgtgactcggttcatttcatcacttcatgggagcaccttccatgttaaaaacagatgcagtgcaaaagcagaaagccagaaataatagtgagaggcaaagttagagaaatgtgcatattaaatctttaaaatactctatgactttttcctgcccagcatcttttgggggaaaaagagagaagatgaataaattaaaggtttttttctttctttgtttttttgagacaaggtctcactctgtttcccaggctggagtgcagtgttgccatcatggctcacggctcctggcagcttcaacctccaggctcaagtgaccctcctgcctcagcctcctgagaactgggaccataggcatgagccaccacaggtttggtttttttttcttaataggttggacatatggctataaataaaaaataagaaaattaaaaaagagtaagtgctaagaagaaaaataaaatgaaattataagtataagaaatgctagatggggttgttatatatatgattttttgtagaaggcctttctgataagatggcatttaaggaaaaatctaaataaagtgcaggacaagccaagatatttatctatggtaaaaaaatatcccaggaacagtgaatgtaagtgttctgagagagaagcatatttgatatgtatgcagaacagcaagactgctatggctcagcagataaagggggaaacataagaaattaaacatgataccttagtaattttttaaatgaatttaataacattaaagtctttctgtgtagttaggtttttgctattagagaggtggttctaagtcaaatgatgcttctaatatctttcttaatatattggatatgaccttgttttttaagtatttaaatatgcttgaacatgttaacccgatcatgtatcttttgtggaggtctagagtttttttttgttttgttttttagggtttttttttttaatgatacaggctttattatcttccccattttgcagatgagaacactgaggcatttacccagtggcttataagctgataggtgctaaagccaggaatcaaattcagaaagtgtagcccagattctgaacttttagccattgtttgcactgtttgtttctttttttgtttttttttttttttttttaagtaatttcaacttttattttagattcaggatatgtgtgcaggtttgttccatgggtatactgtataatgctgaggtttgggatac

SEQ ID NO: 118743 - DNA, 1057 bp, Homo sapiens
cctggtaccaaaatctggcaaggacacgacaaaaaaaactacaggccagtatctctgatgaacgtggacaaaaaaaatccccccaaaaatactagcaatccacatctagcatcatatcaaaacgttagttcaccataatcaagtagacttcattcctgggatgcaaggttgtttcaacataatgcaaatcaataaatgtgattcaccacttaaacagaatgaaaaaccatataatcatttcaatagatggggaaaaagcttttgatttttgttcttgataagatatgacagaaagtctcagagtcagagccagggactttcttaaataattttagagcttttagttgcaaaatgtctttgtttttactgctggcataaataggttttccatttatttctagcactcagtaaaaacatattatttaatttactggctcttccaatgtagtatatgagtctgctaaagtttgtgaagtcttgttcgtttatttatttaggttgctgacaagtggaaataggtgagatatgaagttttggggattttaatcctgtagaaggggtccttgaattgaaaaaaagttttgagaaccagttgccttcttcccagggagaagatggagcagaggtcccaaacatggtaaaactgaggtagaaaagaagaccttaggagaagcttgaggttcaaagagagggaataagttaaaaatgtaaaaagttaacttttgaaacagagaagaggaaactagtgaagaaggaattcttcctcgctgcattctgcattagttatctattgccgcagaacaaattacccctaaacttagaagttttaggaaaaatcatattctatttcacagacttcctgaggcacaggaatttcggaatggcttagctgagtaattctcacttaaggtcttttatgaggtttcagtcgaaatgttgatccagggctgaaaattctgaaaacttgactggggttggaaggtcagcttgcagaatggcttgctcacgtaactgttaacagaaggcctcatcagttctagcctgttgttgacaggag

SEQ ID NO: 118744 - DNA, 1095 bp, Homo sapiens
atgattgtaataacccactctagggggggtcatcatctttttgtcaggacaatcaggtttacggataggctcctactcttaaatttgtgctttgtacagagggagtatatattacagacacttggataaatcatttcataaagtattttctgcagtatcttctaaaatataaagtaatttgattaaaaataaataagattgtacttagtgggcacaaaagtggatgaatatgggataacttcagaaaaaagagatatagctgatggtgtgtattgattgatgactactttcctgtacttaaacagtttatactgtgcaaatattgacctgtatcaagtgactgactacagtattttcatgcagatattccttgaattacttttgtaatcagtaattctttttgagacaaatatgtaaaatgaagtattcttctttaagaaaacctaggatctttttatttttatttaaaatattttattccgaagattccaggaacatacataggataaaatagtggtttcaaactggtttacaatcagtggaactgtttcttcaaatgaaattttacatagaagcaaatggctcagactgaaatgaggatgtggggttgcaagaagccagatgttccaatggttcagttcttactctctctgtggtgcccttggggtgtctctctggcatcctaagcctctaaggagtgcattttgagaactgtggacatatgtaggaatttgtaattcataggccatatgccattcatttgggtgttagatgacactgcctcagtgtcattgttagatcacataggctagccaacagtaaacaggaatatatttattgcatataaaagttattattagtgaacatgtttgtctaattgacactgataattagatgtgtgatgtggggtcagacacttccaattctcaatttctttatatgtatgtaactagagggagttggactagggtaagcagaagctcctggcacctgccattctatggttctgataatatttattgaccttcaatgaagagtctagaacttttctgctatgagataaagaaaaagtcttaagccatggtttggaactct

SEQ ID NO: 118745 - DNA, 2515 bp, Homo sapiens
ttcccctggtgcctatgagtattaatatatattacattttaattttaatgcccccggtgaaatctgtattcttaaagaactagaaatctgaatttttcagctttaacagattgtattgtttatgagtacaaattaattttttttcacaaggcttttcttaaaatgaattttaatataacattaaagtcatatatatttcagcatattaaagaataaggaagaattttttatgttggaaacttattttaccttattagcaattttaattcattaagccttatttttgcttttgtaataataacattttttcaaaccatcttaaattttgtagagaattttaatttatttgatctttgactataatattcaaattggttttgctttgctcacaaaggtaaagagaattccaaatttactcataataaaaatattagagaaactgtcaataaatttactgttataattgaatcacatgatatctaaattgttgataatatgatctgctcgttaaacaatagtgtctggagaaaatgatggattaattgactgatggctaaagtttccctcaaatataatggtttacccagtttgatttgatttgtgtaaaataactttctctaataaacaatttgctcagaggcaatagaagaaatgaatggttatcaaaccaaacttaattagtctatcctagattgatattacttggggagtctttgttttaattgtggagtgctggatacaaagagtttggttcattattttttcctgtataaacactattgtgtaactacctatggaataataacatgtgaattcattttaataaatgcttgtaaagtgaattagctaattataccaggctaaaaatgattcctttaattattttggatatttaactggtacttcagttttattattgtttgtctgtaaatgtgatttgtattagctctgccaaactaattataatgtataacttaacaaacaatttgagcagttttgtaatgcttatattgttctcttctcttatgcaaaagaaaacattatttctagtttgcatgaaaataaaggtttgatacaaattcacatggaaatatatgtgtaaatagagaagaaaaacctctcaatatgcaaggtagtacttgatataactatatgaatgagaagaatgaacagatttccttcaggagaagataagccagtgactcattagtttaacttaaaatatgatatagcataagagatttgattgttattttaaagctggaaagatgagttttcttcatgccctatctagagagtgaaaaactcgatcctcattctcaaaaagaaagatttatagtaataatgtattgtggatgtcaaaaacaatatgcttcttaatcacttttacttaacagactaattgtctttaaatcagaaataaatgagaacaaaggctttagtaataaaaaatacagattccaagtttaggctttctaggggaaaagcaaaatagcctctaaaacagtatgcaatgtaaatcattcttcttttaaaaattaatatacagtaaaattcacatttccatcttttctggtgtacagttctgttttaacccaagtatatattcatgtaaccactatcacagtcaggatacagagtagttctgtcccctgagataaataaataaacaaacaaataaataaataaagcctccctcatggtgtcacatcttccctctgtccctaacacttgggatccactgatctgttcccattcactactgttttgccttattccagaatgttatgtaaatggaatcctataaaacttgaccttttaaaactggtttctttcactcagcacaattcctttgagaatcctccatgtttttacaatacagtttgttttctgtctccttcttcccaaattatagcaacactaatatcagtttttgaagtaaatataaattatctgccccatatggaaacttattttctccatcataggatccctaaaagaactggaacttgattttttaccctattcatgcctatagttctgccttttttttttttttttttgagctggagtctcactctgtcaccaggctggaatgagtgcagtggcatgatctcggctgactgcaacctctgcctcctgggttcaagcgattctcctgcctcagcctcccgagtagctgggactacaggcacgctccaccacgtccagctaattttttgtgtttttagtagagacacggtttcaccatgttgggcaggatggtcttgatgtcttgacctcgtgatctgcctgcctcagcctcccaaagtgctgggattacaggatgagccaccgtgcccggccagttctgcctttttaatggctgcattgtaattttatgaatgtaccatacttggtttaagctgtctccaacatagatacttagatatatttttttaaattatcttcagtgctacagtaaacatgcttatacagcatatgatatgtaagaatagctgccttcaatttctag

SEQ ID NO: 118746 - DNA, 1646 bp, Homo sapiens
ctcagtattctgaatatattatttctgtccaatttgagcagtttcagcacaatcttaatttttataaatctcaagtttgtcattttatttttgccattttaatgggattgtagggcatctcattgtagttttattttgccttttttttttttttttttttgagatggagttttgctcttgttgcccaggctggagtgcaatggcacagtctcaactcactgcatcctctgcctccagggttcaggtgattctcctgcttcacttcccgagtagctggaattacaggtgcccaccaccacacccagctaattatttgtatttttagtaaagatggggtttcaccatgttggccagactggtcttgaactcctgacctcatgtgatccacccacctcggcaccccaaagtgttgggattacaggtgtgagccactgcacttggccttattttgcattttcttaatgggtaatgatgttgaacggtttttttttccacaaacttaattgcctccatatatcctctttggaaaagtatcttttcaagtcttaacccttttttttttgttttgttttttttttttgagatggagtctcactctgtcgcccaggctggagtgcagtggtgcgatctcagctcactgcaacctccctccacctcccgggttcaagagattgttctgcctcagcctcctgagtagctgggattacaggcgcatgccaccacatcagctaatttttgtatttttagtagagacagggtttcaccatgttgggcaggctggtcttcaactcctgacctcatgatccgcctgcctcagcctcccaagtcttacccattttttaagttagctcatttgttttcttgctattgagttttgagaatactttatatatagattttgactacaagttctttgttggatatgtgatttgcacatttttttcctctaagtatgtagcttgtttttttcattctgaagtatccattaaatagcaaaagtttttattttggcagagtctaattattacatttttatggatcacgcttttgatatcatatctgagaaatctttgactaattctggttcacaaatattttctcctaaaagtgatagaattttatacaagtcttttgggctatcttttttccttttgctttaactgacttgcatctttacatttaatgtgagtttctgatagatttttttgttttttaattgagatagagtctcatcctggagtgcgatgacacaatcatggttcactgcagccttgatctcttgggttcaagtgatcttctcacctcagcttcccacgtagctgggaccacaggtgcactacacacccaactaacttttttattttttgtagagacatcttctttctctgttgccctggctggtctcaaactcctggactcaagtgatcctcctatctcagtctttcaaagtgctggaattataggtgtgacccaggatgcctagcccaaaagcatatctttaggtcttgtttttaatctgttcacacaatctgtctttcaactgctgtgtttatatcatttgcagttaattattactgatgcttggatgtagatctacccttttcttttttttttaacttttaggttcaggggtacatgtgcaggtt

SEQ ID NO: 118747 - DNA, 1048 bp, Homo sapiens
gcctactgattttaaaataggaaatgacagtgtaaatgccaggataaaggacaaagtgctctgacctgttgccaaacctttttttccacagctacagtgcacctatattctataatagtcagtgcaactcttttttgtgaattgtttacatgtctgacttcttgtttggattttacttggtgatttgatatgaatttttaatgtgaaagcacttagcgttaggagtttgacattttgtctgacctgaatcaccaagaggatcatgtgaggtttattcagtgggaagagaactgttacagctctgacagaaatgatgggaaataagtaaacagccttttaaatcttcaccagaaatcaatagggtttaaagatgatggacgttggtgttttttgctgcttaaggacttcaaccttttacgggaaaatatcttctctacgtgtcagcagttttttccatgcacacaatgaatcgctgctgcaaatagaacattctgcatagaacactcttcatcattattataagaaagaagctgtgtaagactggccttggtaatgtagagccttttggggcatttttgtatgaaaagagaggaccatatcttacaattttgttttcatcataagtgtaatttatgtgccaaactttttcctcaactaaataataacagtttttatatactgagaacctcctttgtactgggcattgactgtgtgatgttttaaggtagattatttgaccccactttatagatgacaaaattggagcccagaggctctaagttcgtctgactagtgatagaactgatacttaaaaccctagtccatctgagtttaaagcttatccttttactactttccagctgtgtctctgaggacaggcactcaataggtgttcttgcccttggttctatttcttcggtagtggtatctcttattttctttctccttttccccctagtcagtaaaactaatataagtgatggccttcacatcatttaataagaggataagagctacatcatggtcattgaataaaagaatatgggtt

SEQ ID NO: 118748 - DNA, 1055 bp, Homo sapiens
ggccaactgcaggactggaatatgcacggattttggtatatgtgagggatcctggaaccaatccccagaatacactgagggacaactgtactataggtttttatgtttaaatattttattttgatgaagtgatctttaatggttcattctagtaacccaaggatatgctttaaatttattgaagtcaataggaaaatgtgatttaatacttaagaaattgcagtaaaacaaaggaaaaaaatttcctttctgagaattcttatttgcctttgatatctaattcttatggttaccatttggcatttagtgaacccctaataatatattgaatgatacttcaagttatgttacagatctaagaatacttggccaaactgatctatgactacaaaaagaaattctgttgcagtgactcatacaacaaaaatgttcccagtttgtgagtgacgctctgtgttatatttacttccctaatatatagtcacctttcataatagtgtcagcataatatactaagacaaagaggatctactgaaacttctcttgcaaccattaggacaaacccggtataagactatgcctccagttacctgggtgaccttaccctgttaaagtcttatttataaaatgagggctgacactggattattgctaaggttctatctatctggagaaattatcaaccaggagagcttaatggtatttgtcacctattcttatttttcctaagagatctttttcatatgatagtgacatgatcattctgatgaagtccttccagcttctaataaaatctaggaaacacagttgttattcaccccatagtaatgaagaaacctgtcctgtgcactacaaggagcttcttatgttctgagaagaattgttattcacctttgatctctagtccttaaactctgtagtcggcatttaatggatgtccactaatatttagtttggtttgtgttgcatattatggaaagcactcatctatatttaatgtctatgccactgcctgtgaatttgtgggaagacaagtgtattgtaaagtcaaattc

SEQ ID NO: 118749 - DNA, 1111 bp, Homo sapiens
acccactaactcgtcatctagcattaggtatatctcccaatgctatccctcccctctccccccaccccaccacagtccccagagtgtgatattccccttcctttgtccatgtgttttcttcctactggtacagggagagtttctttcacttgagagtttgatctgctttcaggaagaaaaagaaaggtcagagtattcttcttgtatctgctgttttttcagtgccgttaactcaaaatattctttatgccaaagtagcatattttggagtagcatattctgctactcatctttcttactcagtcatttctaagatataaccattcagcttctccccagacttctctcccttttgctaagtgaatgtcattcttacctcagtcacaaaatgaaagatgtggaagtcatctggatgctttatcttcctatgttcttttgaaaacctttgcttttttcttttcccttctgccacaattcagacctttatttcccatctacctcttaatgggttcccctaattctagtcttggctttccccttcccagacatcctagacagagctgttagtgcagtctctctgaagtgtcagtctttcagtgagccccatttctttcaaagtgaaacccagacctccaagacctagcccaaaacaggggttctgagctatattcattccacctctcactggctttgctgaattatttgtaactctttgatgtgctccttcactacttttgggccctcctacatgctcttccttttctctggaatgctctctaactttctgtgatttcttctctgcattaggtattcctccaaattggcttaacacatagaacaaagcaatcaaagaatttatcatactttatggtaattgtctatttccttgtctctggtcccctttaggttatgagccacttatacttagggatcatgccttatttatctctgtgcctctagtgcccagaaaaatggcagacacccaggaaacactgaatgaaaaagtaaacttgatggaaaaatagcaaattacaggtgatgggtaatgtttttataaaataatatgtatggctagttattcttctgttcttattatacatagcaaagtcat

SEQ ID NO: 118750 - DNA, 1928 bp, Homo sapiens
aagtgagtcctgttgttatctttcacaatcatatgaatagtattagatggagccagaaaacaataaaaattctacaaaaataatgaaactaatttgtgcaacgtgagaaaagaaaatggacattttgcaaatctatttggtgtcagggctctactttttaaaaggaaaatcaatcatggtctgtggtgtacatgttaagggaaggacttaaattcacagtaataggtattctggttacagcatggaagaactatatcattgttgaagtaaaactcaccgaggcttcagcatacaactaaattgtactttgcataagaacattaaaacaattcttggaacactctcctcccccatcactaaccacccaccgaaatacaagaaattatagtaagaaatatcactctcttggaataagcacaggagaagaaattgcaaacagattattagaaaatgtcattcatcattttcattttctttggaaatttagcttttctccctgaatataatgttttcttttttctcacatttttaaaatatgctcaatcagaatactttaaaaagacttttttttttttttttttttttgagacggagtttcgctcttcttgctcaggctggagtgcaatggcatgatctcggctcactacaacctcctcctctggggttcaggcgattctcctgcctcagcctcccaagtagctgggactacaggcatgcgccaccatgcctggctaattttgtatttttagtagagacggggtttctgcatgttggccagactggcctcaaaatcccgacctcaggtgatcggccccacacccaaccaaaaaaatacttttttatatatatgtagaaacaccgttttatttgtaaaatatgtcaggtgctttttattaagaagtattttgagaatacagatacatcatcaaattgactgttatctttgtataattgtattacaagttatgttgtgaagatgaaaagctagtttcccttctagctacttttggtgaatagaaattaggagtgttacagcattttatttataataaaactatagtatacatgtttatgattatttaaagaaatttgttatgtttcacatgttcagagacttttgtctttggaattcctttgctaactctagcaataataagggcatgaacttttcagttacacagaattgggttcacatatggttctgtcacttagtagcctttgggcgaatttttcaaactcagatcctcagctttcttgtctacaaatttacaatagtaatatttaactcacaaggctgttataaggattagaggagattacctgtagtaagctctcaaaatattagttctttttccatataaaatataaaattctccttaaaaatattaagattatgtcataaaggtttctaagcattgcaagtggttcctatttatatctgctactattgctttccagatccagaaatagcttgcaaataatgggattcctgtagatggaataatgttaatttacctagctcactgctactgtattgtacagcttgggaaaatgtgctgtttttgcagtctgttcattcagatggcttatgaattaaaagcagaggcccatcatgttctaagatccagtagttcattattgcaaaataaaatatccatttattaggcaaggattgtctacagtgcaagtgtaaagagacccactcataagaataagtgttgccttcaaatttgtactgaagtatgctgaaaaacatgtatactatagctgtgataatgagcagtacagtagaaagaggtgatttatgatacctgtttctgacagctatagtgcagagattcccagggtagctgatcatggcattagcatgctgacagctcagcatttagaacattatggtaatttatcctgcctatgctgtcacctgc

SEQ ID NO: 118751 - DNA, 2896 bp, Homo sapiens
aagaaaggagagaaaagaaggaaggaggtaagggaaggaacaaaggaaggaaggctggcttaaattattattatggagcaagttgtttttctgactttagttgtttttttttttttaattgtctgcagggacaagactaaaatttgttttgataatagtttatttgggctgagcagggtagctcatgcatgtaatccaaacactttgggaggccgagatgggaggatcactcaagcccaggagttcaagaccagtctagggacatagggggaccccatctctacaaaaaatttaaaaattaaccaggtatggtggtgcatgcctgtcgtcccagctattcaggaggctgaggcaggagaatccttttagccttagagtttgaggctacagtgaaccctgatcacaccactgcactctagcctgggcaacagagcaagaccctatctcaagaaaaaaaaaagacttcatttgaagtcctttcattcactctgtactgacagtttttcaactcttttcgtttactctgattttctaagctatagtaatttattattccagaagaaaatgtgtttcaactaaactgttaaataattcttgagattagtcagaatgtttgtcttttttttttgagacggagtttcgctcttgttgcccaggctggagtgcagtggcgcgatctcagctcactgcaacctccgccttctggtttcaagtgattcttctgcctcagcctcccgagtagctgggactacaggggcccgccatcacgcttggctaatttttgtatttttagtagagacagggtttcacctttttggccaggctggtctcgaactcctgaccttttgatccacccacctcagcctcccaaagtgctgggattacaggcttgagccaccgcgcccggctgaatgtttgtcttttaataaattaagctaacatgttaaaataatgtggagttatgttttttgaaaaataatacatttacacatattatttgcttatatctgacataatttgctgtaaggagatacacagttttcagaactctgatgtgactattatagttaatagttaattagctttttaaagtttctataaaaaatgccaaataacttgatacattttgtttgcaattagtgacaagacagtatttgccaacttcatgcatttcaagtatcattatgtaaagattgtttcctaattctttatgtgtaaagatttattcctaattctttataatttatttataaaattatagtttcaacaatctttcatatatactaagagaaaataaaagattgtttttaggaaattacatttttgcagaattttcataaatgcttgaaaagatcatagaattgctaaacccatgtgggcataggctacccggaattttcagctcatatttagatggtaggaaaattgacagaaacttagttactgtatttctttgtgcttaaatgtatgaccaggagtctggtgaatgtgatttcccaaacattggagtaggaacactagcagttcttattttgaaaaagaacattgtacttgagctttcaggttgtggctgtgcattgtaatgcatcaggagctgcttttacattttatttaagagaaaggtcttttaagtatctatacatgtactgcctttatttgcacatttggatcatttaatgaattttgttctatgaacaaatggtaccatctaagataaatacttgaaacattgatgttaaccctacctcagttaattttcatgaaatattattttttgaaaatgaatacttattgcataagtcctaaagtcctaaatggaatatgctgtttttaatggttattcatatattctttggattcctttctaaaataagccattgttaaaagatggatatacattacccagtgggctcttcttcccctttaggtgtagaaatgccttccatgaagactaactgggaattgagatgatcataaatattgggattttattaagtttgctagtagtttgttcacattgtttttccagcaattttagaagatacaatatttagcctaataaggattatcatctttcagagggatcaaatatctatcctgtacttatggctagattgaagaaatttttcattgaaataatcagattatatatgaagtgatgatttgttaatggttggcatagtcaaagaatctgtttttgaagttgtgggaaatgtctctgacaggcattatcagttaagtaagggactaaaagtagaaagccctaagttctaacccaaacatttttccctaatagttattttgtcaaataaatattgctcttgcacactgaggtattagggtgagtaatagtgagcattaggccagtgtaatactcttttgaatattaaattataaaataagcccaggtcgaggcaggtggattgctttgagctcaggagttcaagaccagcctgggcaacatggcaaaaccctatctctacaaaaaatacaaaaattgactgggcgttggtggctcacgcctgtagtcccggctacaggggaggctgaggctggagaaccatttgaccctgggaagcagaggttatagtgagctgagattgtgccactgcactccagccagggtgacggggtgagatcctgtctcaaataaaataaaaataaattaaattcccaaaacagaaaagtaagtaagtaaagagaaaagtttaaggctgggcatggtggctcacgcctgtaatcccagcactttgggaggctgagatgggtggataacttgagatgaggagttcaagaccagcctggccaacatggtgaaatctgtctctactaaaaataaaaaaaaaataataataattagccaggcatggtggttcacacctgtaatcccagctac

SEQ ID NO: 118752 - DNA, 1048 bp, Homo sapiens
ctatttctgtattcctgcgtagtcaattcctaaatacgctttcttaagatagcagttttaaaaattataattactctccaccctgaccccttgccccacaacaaacaaaaatcactttgagttgttaatgttgaaatcacaagttacaagtcttcctttgtccttggttaaaaaataattataaaaatagagtaaagagaaaattctttttctctttactggtcagttctatagaagtaatttaaaataccgtatattgaattctttgatcatttctcctgggtggattgggaaagaagtcctagctgaggcaattgcttctgggctctctttctgtgtgcctggtaaatgaaacacaaggaacctcaccaaactacatgactaatggcaacctccagtgccgcctgcaatcaaagattaatttgctttatcaagtttaaagaatactgggtgataaatcatgtcaaaaagaaataatcagtcaaaggctgatgttcttttctacatgtgaggacaggtgctatgaggcatgcacttgtcatatacagttaattttcttttcatgcatttatgttcatcttaattactatttagttgatgcttgaatcaaataatttctctcattaagatcaaccagcatcccaactgcaaggctgcagtattatagattcaaaataacatttttttccttttaatttgtataagggtattttcacatgagtattaatcacaaatttttttattcaaacatgagaatgccaagtgggaagcgaaattattttctccatttcaagatacccaagaatatcaactggatgttcatgtttataatatatgtctgtgtgtgtgttatatctacgtattttatataaaattttcattttactcggattttctcacctttttttttcttttcttttcttttcttgaaagagagaaagctagagtctctaattctgtctcctgggttcataatgcaggactcactttaggtaagattatattataaagaggtcatctttcaggacttttagcagcaaacacattt

SEQ ID NO: 118753 - DNA, 1383 bp, Homo sapiens
tccctggccactgtacaaaggcccctttcctcatttgatatctaccaacatccactgttagcatccctaacctcttttggagataccatggatcttttttactgttccattttttactgagctctgagctatgctcatttttcatgtgtccactgaagtccacatagttatatatattttctccccaaaatcccatatcacacaaataaaaatatctaaacaggagaactgtttcctatcttgggttctctcaacacatgactgttaattttattcttttcacttaccgtatttcacttactgtatcagcctccttctaaattatatcataatctcccttaagtccctagattagtttgttcagaggcaaaacaaaagtgaaagattttgtgagaaatgcatagtttcattacacatctggtaaagacacgctatgattgctttcttacagtgtccagaagctaatttatggtactttctttgtttattgtacttgagcaatatagagtatactctgcagacatggtttacactttgaattagtttgcatctatctatattaatgtgttttgtaagccaggccttaatatctctttattgtgctcttttgaaaataattctcttaaatctatggaacgtgtcttacttgtgaagaaagacacatttttccacctttctaagattaaaatagtgagagaaacctcaaagaagaggaaatcctattttaaaataacagcgatctcctctgtagactcttggtttgcaggttgttagtcttcatcctctgtgtcaatttaatgtatcacgtaagtactagtgaacagatgtgggggtagggggaggcaagcagagtgttgaagcaggaaccagcagcattggcaaactggcaaatgcttctgttttgctaaacacctgcttttcttgtattcagattgtctgaaccatctgtttttatattctgtttacctactgtcagccattttggagttgttaaaatctttgaaagtagttgggaatttttcacagtaagctgggaatctataccactctttaaaaactttgtgtttttagggtattcccatttaatcctccagagaataattactttttaatttaggtgcaatgtgttaaatattatataattaaaatgtttttctcccttcccaattacttattcttagaaatcaaagtttaaattgtctaaataggtacttggccatagtgtgataacactaataacagattcgtaatgatagaatgtaaatattaatttatatgtcccctctcattaaaaaaagaaagaaaaaagcattacacaatttgatgaaaggtactaattttttataagcttacctactagatgatatgcaagtgatattctca

SEQ ID NO: 118754 - DNA, 2513 bp, Homo sapiens
tcacttttctagagcaaagctcacataaagaccaccgaaatcaatattatgaaagagtcaggcctctttggcctaggaatttaaacacttgaaaggcaagatcaggtttttggttttttagttaggatattggcaggacttgaaaatttctgaaatatttaaattcaagagtcgccttaaatatatgttaatttcagggaaaataagaagcaattccactttctctggtcaataataaaatttacagaacttctcccaagcaatggcacaaattaaaaatataaataggcttaataagttcatgaattaaagattctcaacaagttattatgaaaagatataaatatctgggctacatttctaaccctgtgaggttaatggtcattggtggaaggtagttcattgaagccttaatgagagacagttatgaactaggtgagccattgagctgatggatggcattcttatataattaacctagcagtggtaatcgcctccttcaagttcctagcctttctcgaaccaaggaaaaagagccaaaattgttgccattttgccaccttgacatttcttttcaattgccaaacctaactacctttcttcagtaatacaactaaaccagagagggctggtttttctgcattcagaactgtggatttagggtcattttggtatatatttaattgaactcttgggagcagatgaactcccccaaggaactgggtatatgagggcggagggcagtttcaattcaagaatgtgaagaatagaaatttctaactgaaaataaataattagaaagtgagaaaccagagtaagatgtccatgaaactcagaatatcgaggagaaagaacacatggtaacagaggcaataaagggccccagaagctgggcacagtagctcactcacgcctgtaatcccagcactttgggagtccgaggcaggaggatcacttgaggtcaggagttcgagaccagcctggccaacatggtgaaacttcatctctactaaaaaaaaaaaagtaaaaaattagccaggcatggtggcacatgcctgcaatcccagctactcgggaggctgaggtagagaatcgcttgaacccgggaggcggaggttgcagtgagctgagatcgctattgcactccagtctgggcgacagaacgagactctatctcaaaaaaaaaaaaaagggccccaaaaagatacaagctttacccctctgactctgaactatcatgcacaatgtagtcagacaaatcttaaacgtcactcttgtcctagggttcttcccacttagaaatctccctgttgctcatgacatcaagccagtactctggcttttaaggttctccataatctagctccatctactgtccagtttttggtttccacagctcccttctgtcatgctgactcccatttttaacttggatcatactgttctcttcctccttctgcccacactcatacaaactcatacctggatcatatttgctgttaaaacttaataatggcaatgctcgcactcatttattgtttattatacaccagtcactatgatgataaaccttctatgtgcattatatcttaataagtctcaaaataatcttatgacgaaggtgtcattaacctcatttctatagtagagtaactcaactaagagtacataggtaggaagtggcattcacaagatttgaccttaggtccttctaactctaaatccattaaatgatgaagtgtaattcctgatcttgctcctaaagcattttatgctctgtgtccttattttcttagcaaggtttgagattcttgaggaaaggggcagtgtctatacatatcttgtatctgtcatacaactaggacagtgctagattatcacctattttctcattgattgattggatattgattagagtgagatggtcagactttatggtgacagaaggagagaaattttattctgatcctagtcatatttctgaagtaggtgttgttaattagagcagcatcttattaagaaacagtgggttggaaccagccagtgtttagttttcaagaattgtacattagaaaaagatttatacagagtctgtaagaatgttatttttggctagattagtggcactcttttttttgtttcatttattatacaaatacttatcattacaaatctgtttattatatgctaaacagtgggacacactattgcctagggaaagatattcctgccatcacagactggtggagaacacaaagttaataggtaatcattgttcaatgtaatgaggcccatgactgatatgcagaatactgggaacatattggaagataactgatgaaatcttggggaagacaggggaagactgacacccagggggtgcttgggtttcttttagtgtcattcacttctgcatataacatacacagggaagtaagataggaccaagagttgcatattagtgcaaaaagagaacagaagtgttcagcttcatgttttccacttttccattc

SEQ ID NO: 118755 - DNA, 1053 bp, Homo sapiens
agcctgggcgacagagtgatactccatctagaaaaaaaaaaaaaaaaatatatatatatatatatatatatatgtacacacacacacacacacatatacacatatatgtatatatatggagttaatgatacctagctgtgcctattttgattgtacattcttagcgatgcaagagggagaatacaattagccttcccccagccaaaaagaggataatccaagtaattaaagatttaaaataaaattttatgaatgagatgtaggaggtagagaaagtagccatagagaaagtggatattttgtcagttatttttcttgatcactatttgagaataatatcatttaatatcaactacagtgtgggaaaaggcaatgatgatttcagcaaatgagcatttactattaaaaaagaagcaaaaataagttatgaaatatagcagagttctccacatacattgatgttatacaattatgatttatgatgataataattcccctaattccataatctgtgaaaatgaaataaacttatttccgtgaacccttcaaaaaagataactcccacaaattcctaatcaaactgattttaaaagaaaagagaaaaagtagatttgaatggagaaatcgagtgctacagaatataaaattttcattcatttgtatagtggattgtcatcttgaagtaaagatgaaatgaaacaaagttgtttgtgctttgaacattgaagcattgttcatcatgcataattaacaaagttgaaattttgtaagtatgaatcatgcacaaaagagccacagctatgatagctattacaggaaatggaggaaattaataataaaaggcaatacactacctcataaatacattctcatcataagattggagcatgaaagcattaagaaaatgccctgattaatttaacaacttaatcctgtaaattggagtatagttatttcagaattcatttgtacatagacaaagcagagacacaaaatagcttactttcattaagattttaaaagcaattcttatggatatgtgaagataatatt

SEQ ID NO: 118756 - DNA, 1019 bp, Homo sapiens
acagtgtgtcttataaaaaatatgaatgtacatctgcatgtatatttcagtaagttttacacccggcaagattatgtcagttgactcattcattaactaagtattttattcttcagtaccatttcctagtttttgatattacatcatttatatagggattgccaaataaggtactgtatgtaaagctaaacccacactgatgatctggactcttcagtgatgaacattgaaacttgtctttacttcttaaaaagggctttaaaatatgagcatttctactaaaacaatgtggcaacatatttgctgatgaaagattgtatttaccatattgaattgccttagaaaataattgcctctacaaaaggaaacatctgtatgatagcgcatggttaaagctgccatcaatttttaacatttgagggttgagctatgaccttttatgatgactgtgaacagtaactgcatccattagccataagttttgtttctttattttagtagatggtctagactgtaaatattagagaatctaaaataaatcaacatattatcctaaggatacaaaatgtaagagctatttgtggttgggaacctttgacagatagtttggatgaagcagatgattgcctgcctagcgtatctggtctccattgctatgcctgcaggcagtttagtgctatggttgtatattgatgtcagggttagtactgagtggctagcagtgacagatgtctataattacaggcaatgcttccagtatttctgaaaagccagcctatgttgaacaattatcttatttctgccttgccaaagagcatgttccaattgctagtattagcaatggtgaatatagtgctttatctgctgccttgggacaaatgtgagaaaagcacttggttataaaacataaatgcaaaatattttttcaacattttaaattagttaagttcagtgttttcctaatttttatctccccataatgtttcttttgaaggagtcttgaaatataaaagcacatt

SEQ ID NO: 118757 - DNA, 1019 bp, Homo sapiens
attgcattttctggttgacacccattacaaaattggaaatgcatttccatggaaaatctcctatgcccagtaagtttagttggaaacttttaacaagaaaaattataacataatagaaaattttgaaatgtgctaaacaccttagtactggtggctttccatttgctgagaattgcaattctcaagttttgttgtaaccttttttttttttcttaagcctttgaccatttattgtccatttctgtctctcaattttcatggtcacttccttccttgctccctcttggcccacttttctgactcattagaaatgttttcatgcttgttggtgccagttctcacctgccctttttatctggtcatttgcattcatgagctatgggctgtcataccacactttccagcaggtgcggctgcctaacacatgatactctctaaccttcctaaagattaaggtgttgggggttaaaacattatccatgttgtaagttatgaatcctgtattttcaggtaatgtagaatgagaaatatctaggaaatatcacttgagaatgcagtttatcttcaaccttaatctaacctgcaatgggtttctgctttgcatttaaccactttgctgaattattcattacattttctcatttagtcttctcaacaatgttctgtttaatatacatgaatatcattttgcagaaatatgaaacaatttcagaattaaaagcttgtttagtggcaggcccttggtttcaaccagatcatcttactctgaacccagtttgcttttcgctgtatcacattggctatgtatgtatttaggcatgagtccaggaatgatcagtttcagagtgtgttgactgataatgccaatatcataagtttcatctccatactagctgttttacttcccaaggaaaagactcatttctttaactgaagattggatgtctagtcctggctcgccatcagtcacaaaagaactaagctagatccttgatattttatgtcctacaataggagaa

SEQ ID NO: 118758 - DNA, 1711 bp, Homo sapiens
aataaatgtttaacattcagatgtattttatacttccataaccagtttttctttatcagatgctgttccttattcaactgaatgaggcaagcaggattattcaccttttaccacttgatttccaacataaattatggttttaaaatcaaattctggcaaaagatttttctgtctaatttcaggcttatatttagtgatgttatttgaaacgatatggaaaaattagtcacccaggattaatgtggatctattcagtgtcactaagtttgtgtatttaatatacagcaatgatgtttgtaccattaattctcttgttatggtgataagttaattgtgattatcatattttatcctgcttcaaatgttaatgaaagagctaagtacctttagttccaaatggtttagatccaagtcattaaatgctctattctttcttacacctctcctcctccctcctctactaatgcctttcacattgatgaggtctttcttatagaaagcactgaattgacctcaaaggcacttgaagcctaaaacaaaaatatgaaaattgatttcttattcatagtaagtgatttcatactgtgttcctaaattctcttcctaaggaacactaatgctttcattatattggatcctttccagtgacaggttttgttttaccaatttagaaccagttaaaaaccttcattaataagtcattccaatagattgaaacaatacttgaaaattcacagtaatatttgggggatcttttgtggtatcacttttgtattacctgatatgtttttgagaataaattggttcagagaaggtttgtcatccaatggcaaaatactttgttgttgacttctactgcactgttaattttctgcattgagcctgcttaaacaatgcactaaagctctttgagaagttatagcatcttaaacacttatagaaggcctaagggtattaacttactataattttctgaagattcattatccaaaatcttaattcattataaaaactcttttgaaaacctatagaaccagtgttttctcttattttcttatttgcacagaatgagagattcgttgttctttttaatttgtttcatgtggtgcttttgagtacatttcataaaggactgttattgaatttctgtgactgtcattatatatccatacaatctttaggaactaatattctgggtttcccagttctgtaatctactccaaatttaaagattgacataattagtttcctcagagttataaccagaatgttagagacagtgctccagatacctaagactaaggattaggattggtaaaagaaattttaaaaattatttcggcacatgctttttttattctttattaaatgtacaactcaaaattatgttgctatttgtagtttatgtccgcatctgtttttcttacctagttccctttttaaaaccatatgtaacatcttttaagctacttgcaaattctacaggcaatatttgtcatttgatgagttgagaatttggagaatgtattggctcattgaagcattatgtactatccaaatgctcttttcttaaatttataagaacctttgcagtaaaataaatacggctaagaaaacaaatatattaaaacagttttttaagagcatgccttctcaaatctgtaataatgataattccttacatttctaatcactttccatatttcaggag

SEQ ID NO: 118759 - DNA, 1150 bp, Homo sapiens
tttataagcttaatgtggcttggattgagactgaaatgttgcaccccaaactctgcaaccaacactccctaattggaagcttagtggattcccaggccctgatgttttcaacagggaatccctgagcttgggatttcagtgtcaacatgaaaagtaagacgtacctgtatatttggggaagcttaattaggtaatatttgaggagaatttctataagttaacttcctttgatttttttaaatccttatttttataactgccttaaataatcctgaaatggttaatattttgctgaaatctagaataggtggaaaatttttaagtgttggaaccttttgttgaagtactctactttccagccctttgcatacctactcccgtcttccagaaaggggtggtctaccactttgagaaaaaaaaaaaatgtgtgtggtgtggtgggagtaaaatggatatatgagtgtgtttgtgtgtaagcgtttatatatttcaaaataggagcgatctggaggaaaaagttagcaaattttaaaattataagattctttttaaaaaattcctttgctctcccacccactccctacttcagtgtggataccacagtgcattaaatcttatgtttgttcaattcgaatagtcttttgaaaatatatgttaatagtaaaacttttaacaatgaaatgttttaatgcaggtatatgctcgtatgtcagaagtcttaggaataacagatgacaaccacgttctagagacgttcatgacaaaaatgtgagttcttgttttggtctttaatttttcttttgttgttgttttaaatgtaatagatctttttattgtatttaaacctttttatatattaatttttaaataaaagacttaaaattatgctttgttagaatgttagcattgttcttaattgaaacttaatttcacatattgaaaagtcaccatccaaaggacattgtaatttgtcaagtttccatacaacggcagcgtgcagcatcagatgatgattttaaaagatttacagaccttgactcttcagatcaattgggcagcatttttttttatttaaaaagaaaagcacgcgatttgaaagaccacgtgaagagattattgcaaattgaaatcattgagagaggtctgatag

SEQ ID NO: 118760 - DNA, 1045 bp, Homo sapiens
cttactaaagtctagttgacagtattgtcatatttctaacaactagagagaatcatgtagattttcttttctacattagctatcaaatatataggacttgtgaaagataagtgttggattaatcactaagattagctgatcttttaatatgaggacaaattctgaaaatggtggcattgaatggaaacctttaatgtaggttcattccaggaatatgtttatgttagttaagtttaaaattgtattccttggtaaaccataaaagatttccaaagtattagacacccacttttgtgctggaatttaatatgcaactttttattggaaaataatcgtccttgtctggcaaaatccaccatgcaatatttctgttagtaggtataatgcaataaagccagggagggctatttatcactacaaattttgaggatttcaggattctttttattattttaatatatttctttgatattaaatcagaaaaatgataaattacacctgtctaggctgtttttcctttttactggaaagtgatgtacaacccaattccaatggtcatttggctttttaagatatgtattttttcttattaaaaaaaaaactcaacccatatttttttctaataataatgctgaaatactctttatttctaacatatgaagtggtttataagtacttcctagtattgcaaactctggccttttcacaatgaattactttgaaagcatattatctgcaaagaagcctcagttattttatagcatatatctattgtttagatttaccctatttttttaggttgaaattgatatttagtataaaattaatttgatttgtattcttttagtataatttgcataatgcctaatttatttgtatctgctatttaagatctttttctatcctattaagcctattatatattctttaattcaaatattatagccttttattttacatgctgtttattgcttttgagtacttctcaaagtgaattaaaaaatcatattttcagaaaacttactagataaaagtttaaaagcta

SEQ ID NO: 118761 - DNA, 1524 bp, Homo sapiens
ttagcaattatttcaggtttgcatatttagaaatatatattagttcaatttgatttcagtgctcagttatttgaattataaatcattatgtcccttctagctgatcagtcatgaaatatctttgaattcatttacataatggaatatgtgagtggtgtatctgttttagtgcagttactggttacctaatgcatgttttgtttttccaatggatttctttattataatgtgtttttcagtcttgattttaaagcaatacattatttctatattaggaataagatgacattcttcagcaatagaaacacgcaagatcaaaaccatcacctataggcccttgttattggaaatctgtttatatattaatattcaaaatatttttatttaaaatattagaagtaaatgaaaagcatgtttctcactatgaagttttttaatgttctttatttatagtacatgtcttcagatactttctgttttattttttctattttatctgcttcagatgaaccttactcagtgtttatggtgctcaaagccagtctctgaactttggtggtcttttatctgaccacttgttagaaattgaaatcacacaagacccccatttttaggaagtattaaaaagcctttggttgccttaaagcagtagtctcagactttagtgagcatcggaatgtgagtgctttttaaaacacaaattgttaggccccactccccagagtttctctttcaggaggtgttaggcctaggcctgagaattgcagttttcacaagcctcatgttaagttggtggctccaggaccatactttgagaacttctgtctttaggtagttagaaaatagagctgcattgtatgtcctgagcagaaaagtctggtacttccctcacagacactttttcataggacttcataaaactcactagacttacagttttagagatagtctagttcctaaataatgatgtggggacgtaagtccccagattgtaactggatgactgttgcattttaccccagaattgctgtttgccaaatttgaaacttttcaaattggtaagattattgttattttaaaatccagtgacctttttgacagaaagttaatgttttcccatcagattcattacatgggtatttataataaatttagcaaatacatttgagtaactgtttaacatactctttatattttcaagaccaaattccaagaatttctgaagtagcttttttgaacaggcacagagctgaaatgactctgtacagagccagcccgctgtgttcaagttcagtacttggggatctttcccttctttgaaatgtttcctggtcagaaattttagtttctgtctaaatgggaaaaggagagattgttcaaatgattgaatcaaggaagctcctgggaaaactggagagagaataagggtcatacagagcaatcaagtaaacttacttattttaaatgctgaaaacggagaagagtatcacattttatccaaaattctgtttgttcggtaatcat

SEQ ID NO: 118762 - DNA, 1046 bp, Homo sapiens
tggcttttgttgccattacttttgatgttttagtcatgaagtctttgcccatgcctatgtcctgaatggtattgcctaggttttcttctagggtttttatggttttaggtcttatgtttaagtctttagtccatcttgtgaataaatattgatgttattacccaaattatcagaaatggccaggtatcatatgaggataactaattagtatagtttttggcctatatagtctcccttagtacttttataatgggtagttcttcctcctattcttttctttatatttgcttaaaaggaattttgtctgtttgtgtgtgtgtatatgtgtgtctgtgtgtgtgtctagtagggttcatgagcaaaattccacttttgagataactaaacttacatttcagttactctactttgtgcatataacctaagtacagcaatttctgacatgtaatattgtcatctgtgaactttcttctttcatcaggatctaactctgtctgcaaaaagtgtctatgaacatgtatgacttttaaatatttgcccagattcagtatgattacccactctcttgtacttagtgaatatcatgtatctagtacactaatataattctaaatgaaattttttcacgtctttacacttttgtaaataggatatatcttataattgatggtatttttaagtactttttcttagtagtacatattatagtggtttttttgttttacaatcagtggtgttttagatttgattaaatggggtaaatactcagaaaaggcctggtactgtgaattgaagtcatacttggtgttactgtgtcaagcagctactgaattgtgtagtactcctgtaacctaagaaagcagttcattctcaatttagtatcctccttttcaaaagatatagattttcagaattttcagccatctatgagattcttttcttgtttttcttcatgtgtcatcctagctatcaataagactgtcttcaccctcttcgatgttttcataaccacatggctagagacagggattttctgagaatttagt

SEQ ID NO: 118763 - DNA, 2765 bp, Homo sapiens
agtattttccttgtaacatcaatggagccatataagattattacagccttcaagaaaggcgtgagtaggtattagggaatggccgagagatgctctagctgtggtagaaaacacatgactatggtagagtaagagaagagggtatttgcatactgactagatgtgtttagaatccacatcatacctgaaattatttagtccttgtattcatgtttccgatttcttaactttatgctccttctaagttgaactgttcagatgataatgtggtacagcagaaagaacatggcctttggaaccaaactacagttcaaatctcagcactgtcaatccatggctgtataatcttgggcaagcaacttaatttctcttagctcctgtttcattatttatggactaaaaataataaataatacttaacagtgtaattgtgaagattaggtgaattaacatatggaaatgccttttacgtactaggcacttgagaaatattagttcctttaagctgtccttctatacttgatgacatgcagtctgctatatcctcctaattatattctgatcttaggtttctaccaagagagctcactatttcttagaattgaataattttctcttttttgatagcctattatgggtcttttataaaattatttcattatgaaataacattaagtaagtagaagttcgtaagttacacccaaaatataaaaagggatcagttttaattttccactatcaagactttaatagtaaaggagttcttgtcttaattataaaattcattctttctttccataactagaatatgtataagatagaaaaagtaattgcattggttaataatagattatcattcttaacagaaggaaagacgtttctataggaatgctctttagaaattatatttttttataagtagaaattgatgccactacagttcactgttactttgtgatttattacatactgatattacaaatatatttccttagattccttaacttctattacttatatccttttaaaaaaacttgtgaagatagatgctgtgaaattcatgctaaaaaaccacacggtaagtcttatttctttaattaatgaataacattttacgaatagttgaggtaaagtgttagtaacttggattactcttttgctttcattagagtgaacacttcccttttcttggcatcagtgacaatcatagtctcagcgacttcaggtgtcgaacaaccttctacacagcgctcactcgccttctgatggtagatctgggtaaggttaagaatttaaactcaattaataagggatcagcaatacacttgtgtgaataaagaagtggagtactagtgggtacaacatttaacttattagaattagcgtcttctgacagttttctacaaccttctaagatttgagtgttcacttgttagcattagagccaaaagacaaatatttgtacttaaggtggcatttttcacttcacataacacttgcactgattttttacctcacagcttactttctgcctatcctttgacacattaattttactgctatgaatctaggaataatcttaaacagagaaaaactttacacacaaagattttcgtcatagtgatgtctaaactagagaaaaagtagaaatgatgtaactgtccaacagtagggaattgtaaaattatggcacgcctacttacttgtagaatgattggcacgcaataaaaatgaagatttaaagacaaggcaatacatgaaattttatattataacattaagtgaaaaggcaaagtgttacactggtgcaaatggtatgatcatgtatgttggggatggggggacaatacttcagaaaaggcttaagtgaaattcttcaaaaatggttagtacagccattgtgaataacagtgtagaggatcctcagaaaattcaaaataaaatgactgtacaatccagcaatcctactactgggtgtataggtatccaaaggaaatgaaatgagtatatcaaatagttgcattcccatatgtttattgcatcgttattcacaatagccaggatatacggaatcaacctaagtgtccatccacagatgaatggataaagaaaatgtggtatatatacacagtgggatactattcagccataaaaaaggaaaaatgtctgccatttgccacagtgtggatgaacctggagggtactatgttaagtgaaataagccaggcacagaggacaaatactatatgatatcactcatatgtgaaatctaaaaaagttgatctcatagaactagagagtagaatggtggttactaagagctgaggactttgaggtgatgctggtcaaaagatacaaagtttcaggtagaaagaataagagatctgttgtacgtagatggtgactatagttaataacaatatattgtattcttgaaaaatgctaagagaatggatgttaagggttctcaccacaaaaatggtaactatagaggtaatgcatttgtcaattagttagatttagttactctacatcatacatatgtacctcaaatatattgcaggtttagttccagaccatcatgataaagtgatacagtaaagcaagtcacaccgtttttgttttctagtgtatataaaagttaaacttactgtactgtagtctattaagtgtgtaatgtcatgatgtagatacaatgtacatatcttaatttaaaatactttattgcggccaggtgcggtggctcacacctgtaatcccagcac

SEQ ID NO: 118764 - DNA, 1755 bp, Homo sapiens
tttctgatcatttgaatttttttagtgtattacttttataatggtaaaaattaacttatttttaaaatttgttactaaaaagctaaagttagtgagaagtatttacagataggcagtaccttaggatgggtacttaagcttctttgtagtgaccatgttactctagactcccatttctcatatttgaatactgcaggttagaccagttatacatgagagggttcagtcagtggcaatatcatccttagacaataccaataatacttttttctttgtttctcttgaagtctattactacatcaacttaaatatgaatttttaaaaatgtgttcatacaaacagaagaaaaataatttttttgcccataaaaggcattgaatttttaaatggaaaggggactacacccctctatgtttcttgcttttttttcatgcttttccacagactaaatcaccagaaagacaaactgccaaaaagttgagagacatgcaactagaatgattaaagagcttagtgggattgatttctaaggaaagattaaaagaaccatgtatgtataacttggctaagtgacaactagggctggaggcaaagagaactatctataaatatttgaagagcgtaaaccaggcatgcaaaacccaatcatctgctaccttaggcaagtcggagatgtaactgagtgacagcttttcgtactgcatcctggcctattttacctcttggctgctgtgttggtgagaagaggcgcagccccagactgtgtcattgcccttgacaatcatttagaaagcacagtgtgctaaactctgagggcaagacaaagatgaatcaggcatactgggtcctggcctcaaggagcttgtcttcttgctttcccagttgtccaagcattaaagagaccttgaaacatttgtctggacttaatttatttcccaggccttaaaaatgctcttttaataacacggtcacacagagtgaaagaagtggggagaccaaaaagagaagtatctggaggagagtttttaaaactaggtccgtgtcactcacattttcagaacctggaaatggaatgggttaacatttcctttttgatatggtcatcacagatagggaacccactatgtatctgtggtaggttaaacaacaggatagcactatcggagcctgcacacagccccaactctgtattctcagtactactgtacttattactgcattgataattgatattcatgatgatgcccagaaagacattgcacactttttggaaagcaaatttgctcttatttagtattgcttaatgtaaactatgaggtatgagaaactgaaataaacacatataatttgaataattggattttattagtttacccaggattctattcctttgaaatacttaacccataacagtataaagaataaattcacatttttagttcaaagtttttttttaaatgtaaatatctgttgcattacaagcactttttagacaccttgagagaaacagaaagaggctatggtggaagtgcttggtgcatggtaggtgctcaatataagtcagttgaatctggatataaataaaatttaaaatcatagtagctaccctcatagaacttccacatgtttgaaaagaaactccttccttatttatcagtaatttttactttttaaaataatgaaatgtatgtgataagcatcaagttatgattaaaagcatcaagtatgatttgttgtgtaaactaccagagctgc

SEQ ID NO: 118765 - DNA, 1955 bp, Homo sapiens
gtttatctgttagaaaactgaggttcagaggccgggcgcagtggctcacgcctgtaatcccaggactttgggaggccgaggcaggcggatcacgaggtaggagatcgagaccatcctggctaacatggtgaaaccctgtctctactaaaaatacaaaaaattagccaggcgtcatggcgggtctctgtagtcccagctactcgggaggctgaggcaggagaatggcgtgaaccccggaggcggagcttgcagtgagccgaggtcgcgtcactgcactccaacctgggcaacagagcgagactccgtctcaaaaaaaaaaaaagaaaagaaaactgaggttcatagagattaaatgacctgcccaaggtcagccatgtatgtagtggccctctgaccacatattttcatccacttttactaaactattacttcatctttcaccttatcaaccagtggagaaatacaacttttttccttcatttttatttgaactatttggtccaaatgattgatttggggcttgggggcagtgaaagaaaatgagaaatgattactttctaagcgtctatgaaataaacagatagatgcatgtttattgtttgttctgtataggtatattatagtttgatggtgagtgaaagtcaaatgtagtttttaaaatttgttcttatgcctaataattggccaaagcgtatttcttctcatggataaaggaacacagaggtggatatctcaggaaggtttagcaagtgaggggcttgatcagaaatagctgatagataggaagaatacatcaatgtatcaactgtgtccatgacttggcagagattatctgaaaaatagacatggggggatgggggagtgggcagtaaggggtaaagaagcagctggaaatacttaaaatctgtaatgagataattaagactaattagctggccctgtaggcagaaagcagcccattaagtccagatccagttttaataacttacctggttttgaggctagacagtccagagcaccccagggaatgagatgtttcatggatgagacttttagggtgggattctttgaaaatgggtagctatagtctgcagtgggcagtgtattttttttccgggaactaaaataaacactctggttccctagggagaagaattaaagggcacctcagttttctcttctgttaaatggagaaaactacgtagaagagttgtcatgtggtttaaataagataaagatacataaaaaggcctagagcaattcctatcacaaagcaagttcttagaaaatattaagaaacgtttattgagtgcactattagaagaagcattgactactgctgggacctcaaaatgaggcaagtttggctctcttaatgccatctactctgccttcaatatttagggctattattttcctgtggaagtaagatctgatgacacttcccaacacatactaaaatatcctgacctgcctgaagccacaggtcatttcaaaactagctagcactcctaagcaatttagagggaaactgaaatgaaaaacaaattgtggcccaagtttcaggggccagttaagcacatttctcaaagttttactgtaatataacttagaagtggtatcttaatgaagcattgggaaatagcagatgatctgggcctagacctgcagaagtcatcagctcttctgagattgcccattgttacttggttttgaatggtttattttcttcgcccagtgcctatgtctccttgtttatctctcctcttaattttccttagtttggaccagagcttcattacacctactttcttgcaaaagtgttggatgtgattcttggatggaaatataaaacattctaattgcatcctacagaaataaattgaatatgtcttgtatataagccatgcacattgcagtgattagaaagggggaaagaaattgggtgtcacatt

SEQ ID NO: 118766 - DNA, 1185 bp, Homo sapiens
gggggtgggggtggttggcaataaagctgacctttactgactatattggttttctgttattattgctgtaacaaattaccacaaggtagtagcttaaacgatactaatgtattattttataatcctggaggtcagatgtccaaatgggtctcagggagctaaaatcaaggtgtcagcagggctctaaggaagaatctgttcctttgccttttgcggcttctagagaccacctgctttccttggctcatggcctccctttctccagcagcgtcaggccaaatccttcccatgctgccatctttgtggttctttgacttctgcttccctcttgcacttttaaggacccttgtgattacattggacccacctggataatccagaatacttttctgttttaaagtcagttgattagcaactttaatttccctttatcacataacctaatatacttacaggttccaagaattagaacggatatctttgagagggtaattattcgtattctacctgccatattgatttatcacaattgccaaagtgtttcacacagtacttatacagtaaatcctcagtaactgttggctaccatcatttacagttatcatatcatttctattacttgcttctccttgcccacttcccccaactccccagtaatccagctgctatttgcattcaaatttaaggaaattagaagtttcactgttttgtgtacatttcggagggggagcaaacccagatttttgttgttggtattattgttttagattcacatgccataaaattcacttttgtaaagtacgtaattcattggtatttagtatattcagaatattcataaaattgtgcagccatcaccattatctaattctataacattttcatcacccccctcaaaaaccctgtaccattaagtaattgcttctcttctcccctcccccaaaccctggaaaccactaatctgttttctgtctgtatggatttgtctattctggacattaatataaatggaatcatacaatttgtggcctctgtatctggcctcttccacttagcatgttttcaaggcacattcatgttttggcatgtattaatactttgttcctttttatggctgaataatattccgtagtttggatgtgccatattttgtttagccattcattagttgatgaacatttgagt

SEQ ID NO: 118767 - DNA, 1002 bp, Homo sapiens
ctctgtgatggaaatagaacaatttccttcccagggaacttacgtcctaataggataaacaacaaatgaataaatatgtcaatgaatggccagtatagtaagtcccataagaaaagtaaagcaggttatggggttggaaagtgatgtggcgggaggggaactgtgattaccattttagatagagtggtcagggaaggcctctctgaggaagtgacagttaagtagaattgctgttcacattactgtatttatagtatttgctccttgacttctccctgcacattttggtggcttgtctcttgtgctcctgctatccttgtttgccttaaaatttgaatggagaaagagacggaatcagaaagtttttttatctgtcgctcagaatattaagttaggagttgaaatgttaaaagtctgaatttgtctttgttctgaacaagcatccttaccttggaaaactttgttcccaaaggaagggcactgggctggcaatcttgcagttatactttttttgatcaccgtaatcacctctctaagtccatgttagactcaagacaacaatagtgctaatggctgtcatttattaagtaccagacactgagcagggggatggggcgagggggtggttacagatgttttgtcatttacttaattctcatggctaactttatgaagtaaatattatgtctcttaattacaggtgagcacactaaggctttgatgactaaagtgactttatccaaaaccagacagctaacagtggcagagccaggattcaagcatagataaacttttttttcttttttttaagagacgagatctcactatgttgcccaggttggtctcaaactcctgggcccaggggatcctcctaccccagcttccaagtaggtaggattataagcattcaccactgctcccagctaagcttagataaactttgtaatttcaaagcatccattctttctagcaccattacatgcctgcagtggtagttaccac

SEQ ID NO: 118768 - DNA, 2203 bp, Homo sapiens
ggatgacagagcaagactccgtctcaaaacaagccaggcaaaatgctatgggaatccaaagggagaagggagataacttgattgggatttaggaaagcttagcttagacattgggaaagatattatttcacctgggccttgaaaaataacatctgtataggtctatgttatcaccagttaacagagaagagtgtatctaagaggagtcacttggtcacacagccagttgacagagaagagattataatttggtctgccttactctttactcaggatactgaccttcgtttagaacggcacaccagtaaagatttgttggccctttggcatctgtttgtaacaaagctaagtccccaattctgttgtactcctgaaacaatgtgaaattgaaggaaagagataaatcacagaagattagagtcagccagatcagccactccttaagagtcaaaagatcttgatcctgccaggacctccgttactttgtctgaaaaatgactatagatgccagtgtttttcgaacattcacaggcatctgaatcatctggagggcctattaaaacaaaattgctgggacccacccccagagtttctgattcaatagatatgggatggaacctgggcatttacatctcacaagttcacaagtgatgttgatgctcccaggtcaaggaccaaactttgaggaccttctctgagctcatttcctctctaatactctattgaaaaactctactgttagaatagaaattaggaggtctgaaccatgtcgttccacctccaactaagtattccaccttaagcaagacacttaacctttctctgcctgtttcttcagtagagtgcagctcgtagctccctgtgacttaggatgaatgagtgaattcaatctctcatttaaaagaaaccccttttgaaaaagaatactatataaattatcaattgtgcatatccatgtgtgaagtgaagattctgctttgacagaatccttgaggaaactgcagtctacctttaaagtaaaaagttaataggaaatgtctcttttccctcttctctatttaaaaaaaaagagaaaaaaaaggaagcttagtgtaagaagtgtacccatggagaatgtatttaaaatccaaatgacccataagggaccccatcctttttggcagataaaagtttccctgccatttatttgataaattaattaaaaagaacataaataaaagagaataataacttagagctatctgggcacctgagtctttgagccctttagggccttggcacccaaagagaagggggaaaaaaaaaacactgcgtctctgaggctttgaaagtggtcttccttgaggcattagagaagctctaggggccctaggagctaaaggactgagatgcctggggcatgagtctattagatccactaaagaaccaggaaaaaaaaaatggctggtaagtaattttgctatttcatttgatgcaaaagagaaggcacaacaccagaatattcagtgagcaaaagtacaaaatgtggcatggatgtgaatgcaggctgaccccttctcgggaatatttctaagcctaaatgaagcactcaatgctgaggacaatgtacaattctatgcattttaaaccgtagtgacccttttgtttctctgataggtgaagatgaggatgaatttgagaatttcatgctgcctcttacagttgcttttgaaacagtattacaaatattcaacaacaactttaaacaagaagatgtaaaggtgggtttgtttccaaatatgaggaatgacagttttgttttttctaggatatctagatccagaaaagggctttgcatatctgtgtgtactctttgcctcctcagacctgctttcccaattgcatgtctttaatttttacttttatttaagcatttttctagtttcttagacaaatggactttgaggtcagcaaatagttttggacagtcagttcatgataagatgacatagatttgtttcctctggcagttactatctttaataggatatttcttgtgggtacaccactttaaacacccctattccctcatctatcctgcactgttatgttacaacagatctatatggaggaatgcacaaacatacacatactaaaacactacatctctaaatatttttttaaacaagaatttatataaatcaagactttattaaatggctag

SEQ ID NO: 118769 - DNA, 1061 bp, Homo sapiens
atgcagatttcaggataaacttaaacattaaggacctgtgttgccaaattgaaatacagttgttagaggaggaaatgcagcaaaagtgttaaatttatagctttattttcttacttattcttaataaaattgaagaaaacattgaaattttgtcttgggtttttctcttcaaagtaaaggggaaaaggaaaaaatactctgacaaatcctagctttagagtactctttcaaaacgtatgtttccccctataattatgtccatggtaaaatatagtccagtactcccctgactcgtgcatcgtttttgatttggtcatgacatcatcagtttcaaggaaaatgaatgaaaacttctcagagaaagagaagcagttaaataggaacctgctatctttagtccttttgtaaaaactccacaatgttaaattatttaaaatccttgattttcagcatgcgcacattaaaagttttcgcactaagtgccaaatgttgcaaacagcactttaacagaatgattttgctttgatccctgtagcagttcctgaataatttatcacaggttattgccttaattctggagagggatagagcaataaaggcagatgaaaacactccagttgaaacaccttggggcctgctcattcctctgacacggctcttttgttggaactatttagaggttattaagatgtgtcttcagaattaagagtatgctgtaaggatgaagacagccatcttaattctaaagacaaagcacaatgacccttcaccttctttttctttgttgttattatatagtagaattatgaggataatattatagctgcccccagtagtgccactacagtaaagggtctgtgagactttccattagaaaccctgttttgggggtcagggtggaaggagcctcgtttcagctgtttcccagcccattcgtctcacacttggcacacagacaactgttcaccatgcagcagactgaagaactcagcagtttctccctaactacccaaaaaggaatccatagggttagatctccagacatatcccactccccaaaa

SEQ ID NO: 118770 - DNA, 1057 bp, Homo sapiens
gttgaccaactataggagagaggcaacttttaaaataaaactctttgcactattttaaatgagatggtaaactgtagctcctcctttcctcaaattcaataagatcacctcttacgctcaaattacttagtaggctggttgagctcttagttaacagctttcctttttcatatgggggctggatatgttttggctattgagaaaacactctctttagtgttgtttgtgtatccatgtagattattgcagtattatctgctgctttgagataaaagatattgtttgagcataagaaatctatttcttattcacattaacactgaatttttctgttcagttgaattcatttaaaacattattatatgcttcctctgtagtaacattttctagaatgaaacattgatataatttcatagccacattttgccactttaaaaaaaaagccaatagatttgagtcctatagaccacttctattaatttgatatcgtttaaggaatgaaaaaattgtgataaaataaaaattaatatttttgtataacgaggatagtctaaaatatttttagagccctttgtactagacacaaagaaagtaaaactcatggttcttgttgactaatttagacttaaatggtagatatctcatgtgtatgtggaagcttaaaattatttgaagcatagcctgaaacttgtaagtgtacctaataaaaatagaacaaaaagcctactttaatagaaacactgcaaagccaaggagtcagaatagaatagtttgaagaaggcttcttagaagatgtattttgttctggaggcttccaggagtgtgaaaagctgagaaagagaggaacaggcttcaggtggtgaaaaaaggctatataaaaaggcaaaatgtttaaaaacaagcagcaggttacatgagggaactacaaggaggccagctggttatagaaaaataagaactggtgagagtatgagaaaaaaaggagtaagtaatttaaaggagcagaaacaaaaattcagagttttcaagattcagaaattcagataaccatcattct

SEQ ID NO: 118771 - DNA, 1833 bp, Homo sapiens
agaagatgagaaattctagatacttctgagagttaaactattatttgctactttgaaattaaattaattgaatcagccattaagaggagggtcaggattcactgtttgcttaataataatttgaactccttcctaaagaggttttcatttattaccaaagtgtgagaaaggagaaaatctggtagaaaaaaaagttcagagaccattttctagctgagtatttgcaatgaaacagtatctttagaagtcacagttgtatatctcaattatcgcacccccttgttttgtaattatgtttatttgtgctctttgttccgacattctagcatctgttcatgggttttctttttctcttcccaagcatcaacctaaggacagcttaattaagagtccagagtacaagtcagatctcttctattcaagagtcaagtttttgttttttttctctaaaactaaatacttatggaacatttactgtgtatcaagctctgctaggcattttcacataaatttatcacatttatttggcacagtgcctctgtgagaaatgcattattagccccttttatagatgacaaaagtaagcctgataaattgccttgccttaagttttaaagctgggattcaaattcgagtcttatgacatcaaatatagaactcttttccttacatcttcctcacttggggaatgtgactgccattctgcgtatatcatagtacatgtaggtcacttggccagttttattttgtcctgaagttattaaggatattcattaggaatttttaaatgccagtgcctttctaggatagactctaaattatgttgtggggccgcttgcatgcaagccgatgttcaagatttgctgttattaaataatgtctagaccctgtacatatctgttttgtgtaattatcaatcctcatcttttttttcagatttggcattattcagaaacaaagtatattaagactctaaatgcttagctacactactggaattatgacttagctaaatttataagaagtaaagtggagttgatcagcagatttgatggtctgtttaaagagtctgtgcttttctgtagaaagaggtctgaacgagacattttagctaatgaatcaaaatcagatatgtggtcattattgcctgattattactccatctgctctgcgctaacgtgaaaatcaattactgtgtctctttcccactgacagcgtatgttgatcgggctggcaagagatcttcgagggattgcctttgcactgaacacaaagaccagctacaccatgctgtttgactggatgtatccttattacactgtgacaataccagctctgtgcacagagggatgccaggcccctcgctttcgtttaatagtatggcacagtagggaagaggaaacaaagctaaatgaactaatgtgtaatcagctaaaaattacagcacagtggcagcagagcagataactgagcacagtatttggagacccagctcagagaagtcacttttttggtgccgttaaatattgataacttaaaaatgacttcccccaaatgattgtttatgttggagttgaagggataatctggctaacatctttagggatcaatgaatcctaccatttgacatttttgaggggagatttgaatctccatctcaattagcaaggctgggaagatcattttatctcttcaaggcctaacccatcatgccacagtttttcattatcatgaagataatgaatggacatggaaagggaaaaataaataagtcaaggtttgtcatttggtgtaaaatttgaattgacctttgccaagggttagtacagacag

SEQ ID NO: 118772 - DNA, 1207 bp, Homo sapiens
tcatgcacatggtttttatctacatataatatgtacagagattatgaaatttcaacatggaaagtcttaaaattctcttaacagtgacagttaaactggaattatatatgacccttttatttctgccttttttttaatttttaagatacggggtcttgtatgttgctcaggctggactcaaactcctgggctcaagcgatcctcccacctcagcctcctgactagctgggactgtggtgctacaggtgtgctccactgcacccagcttgactcttttatttctctaaacataaagagcaactctcaaaatcaaaattttcattatttgaaaaataataaaagtctactttgggcactgtaatatcgatggtgatcttgaaaccagtctacaactctaggctatctagtgattaacatttcatgtttttctcttcaacagtttcaaccaagagtcaaggtcagaaaccttcccctcagtgtcaaagaagaactatctgccgtaattgatactgcccaaaatttagagaagatactgtattgttttccatttccttatttagctcctttgggggtagcgggggaacctttctgaaatgaaacttttgtccagcagatggcagaaaatagcaaacggaaaatcttgggacttaatgttttcttgtgaactagaaacctttgtctcctccatttgaccatagatgttgaagttatcagggtcaggggcggagagaagtgtcagttatgccagaagctgtgttagattgccaaatggggtggtttggtactggcgttgcttataataattgagtttcagtagcaaatcagcttccttgggaaaaggccaagggcttttcataattgtattgacaacaaaatgaatatgataaatggtgttcattcagttgagacaagatttatagttttcctttgggcgagggatgaagagcaaatatttataataatagtaaaatttgtttaaaagttatattatttgataattcaaaaagctttattaaaatattttgaaatactttaagcagtttcaggtgataaagtacagattcttttcaaagtattcaagtaatgcaaaaatgaataagtatgataaaaaaatgccatggatatgaaagtcatttatttttcctgaaatattgatatgtcaaaccgtcagtgatgatttccacattactgctggggaaagtttatt

SEQ ID NO: 118773 - DNA, 1916 bp, Homo sapiens
cacttaaactgtgggtcttgagtaagctacttaatatcccagaatcacaatttcgctttccataaaacaagactaataaaacctatctcacaggtatgttgtaagaagtgtcatgattctgtgattatgtaaagggcccagtacagtggctgacataaagtaaatactctacagctgttgttagttctgttccctgatacataatgagacaaaggaatcccatttgctcacttattcagcaaagtgggctaagggctgtgctaggttcatgaggagtatagatactaccccaaacaaagtcagtttcttatttacataaattactataatcaaatatagaaagtgctaagaaccataacaaagatacaaacaggacagtgagtgcatttagctggggaatcaggaagggctctctggaaaggtgaaggtgtttccttgggtcttaaccaaataagtaggattggaccatatggaaataggaagaaatacaggttttcggttggcctaggcatcaggtttagggagtcagtagtgaagatgttttgttacatataccactcatttcatggttggaaatgtagtttgtttgggactcttgaatatcagtctaaggaatttagacccttattccataggtagtataaagaaactaatggttttgattgactaagaaaatcagaattgttttcaagaagaaagtaattggcagtatcattttgggcaaactgaaatagagaagaaagtaaagctgaaaattcactgttcagcaagctatttttttttagttttatttctgtgccagacaaaaggaatgaaagaatgaataaaatgattgctctttagaagcccactctctagttgatcacacatgactaataaacaataaaatgtcagtgcgttataacagagatgcatgcaaagggctatatgagcatgtatgggaaaaagagcagtgctttttgcaagatatagaaagcttctcaagagaagtgaaagttgagcaaagccttgaaagatggataggcatttgccagacataagaggaaaggcttccagcagcagtccccttgtgaacaaaggtccagatgtttacatattcatggagtacctttaagctctgaactggcaagctatttctattctggaaccacatccccaaacccttgtctcctaacacttttaatgaaaattcttttgccttctggtattaacaactgatgaatagatggacggacggacagacggacggatggatggatggatagatattgtaaagaagcaaacttgatacttttcacattttcatatttggtatcctgtaaggcagtgtcacatcattaatgcctttgatttttaatttatctgatgtggaccttagaaattcatagagaagatctcagtgaaagcaattagatctgtgcttcttctacctaagggctcccattctcttcttcctactcatatgtacatagtcctcacaaggccattggaaaattaaactcctagagtgggttctggttctcaccctgtaattgagcctggcactctcactctgcagcccttttaacctctctattgtgctttccaataatccctcattttctctgtggcagtcacctctgtcagaagcatattagaattggcaccactctcattccacacagaaaaaggagcatccccttatatctccctgccttatcccgtagtgaatactgtgtgctctgaaaaatatcctggtcctaatgccattataggatgccttgcagaggcctatgtgtgcctctgatattcttaggttctgagatttgggttgaatccattttctcatgagccttccagatgcattcccactaatgagtttgtgctcaggaggtcccttggtggaatattttctcacctgtacccctgtggcattg

SEQ ID NO: 118774 - DNA, 1024 bp, Homo sapiens
tcaaacaatgcttgttatagaataggacttcagaaaatagttgataagaaaactgtttcagtatatacaaatgcagccttaacatggtatgtctgtctaataggagaaagtgttgctttttgcacttttaggaagcataccactcttaaagttatagatgccttattttcattgaacatcatgtgaactgttttctaaagctcccaagtgaaatacacaattaaatagttctaatcaaataagctacacttcatttttaggttgcaagtttatagcaacaagtatgtattgaaatctattttgtgtcaggccatgcattcaataagtacttagtatatgccctcaaaaagcttataataggagagatatacaagtactatgattgtgctagcaccgggttccaccaccatacacaggagacactcctaacccattagggagaggtaggaggcaagtgcatgtgatgtcagagaaggcctcctgggataattgacacctatattgaaatctgacattcaaatagaaattagcaggaagatgatagggtctctgctctttagaaatgcactatctaatggggcagacaaataacacaagcaaccaaccctaacatactgtgttgtaagagagatatggtcatgagtgctcattgaacatagatgaggaagagactgatgcctttggataaaatagagaaaacatcccatgggaggtaaaacttgagctaggtattgaaagacagggatatgttagagagaagaagtggtttataagggaatggagataagagctggcattagtggttttgcagggagttatgaaaagctaaatcatagagcagaaatgctaagagatgaagctggaggtagccaagaaccaaatcttaaaggaccttgaacaccgtgctacggagtttgaaatttattctaagagcaaggaagaaaattgtgatgacctcaccatggagatttctacccggaccacactgaaaagaaacaccattaagtgatttagttgagcattt

SEQ ID NO: 118775 - DNA, 1061 bp, Homo sapiens
cagagcattcttgcaaagaaaagccagtaaggagttttcttacacggaagaaagatgagattagagtaaggctctgctcctcaatttagactaatagtattggtagctttcactttgttataagcttttatagtcctatattagaccatttaccatacattaccctgttgaatcctcaaggtaggtattatatgctactcactagttaatatgaccttggttaagttgtaagcctctcttgcttcagtttcttgttagagaaaatacttcatgcctcaaagacatggttgtgagaattcagttaggtaatgtatggaaagcccttagactagttaacgactgtgattactgttgtgaagaaattgaagctcacagaggttaaaaaaaattgccaaatattacatagctagcaagtagctgaattggaatttcattcagtcatactgacagtggtcttttcatattctttactgcctcttgggagttgccaaagtaagattttaccatggatatttatgatgaagcactgttctttaaagtatggtgatttctatctcaaaacttaaaggaaatcaaagtttcaatgaaaaaaatgtccttcaactgggtcaccagtgactttgacagtgactttgatacatgcactttacatagaataatagaaaaatgtttcttaacctctactgattctcttgctggtccacatcagccatctgatttgtctgtctttaccttctgtaatgttttattacccaggcttttacctctggaaattctaatatacacattggaggaagatcatgtagttgccattcaggagtctagaagatgagggaaagagtgactgggagggcacagaagagccagcactgtttatctctttggtaagcccaggtgaaggaaagggaagccagtggaggaaagaggccagaacattctgtgatcccttctgtttccatcctcactgggttcttctctgatcacctctcctgagcagtttttggttatgatcagggcggtgcagagagggaaggaagcatttccaaatgcaactgacttgt

SEQ ID NO: 118776 - DNA, 1023 bp, Homo sapiens
gggatttagggacatgttgcattattagagtggtcaaggtaggtctcattgaaaatatgacatttgagtaaagacttccagtaaatgagggagttagtcacgtggattccttgaagaccagtctaggctgaggaaacagcaagtggtagagtcttaaggcgggagtgtatctagcttgtctgaagggcagcaaggaggtcagtagctgaagcagattgaacaaaagggagagtagtaacaagaacagtatcatataaggcctgtagcccactaacatcactttgactttaactctaaataaaatagagggcctctagaacatattgagcacaggaatgacatgacctgacctaagtttttaaaaaattactcacgctgctatattaaggatagactatagaggattaaagttataagcagggaagtcagataggacaatattgcagtaattcaggcaaagtttgatactggctttgaacaaagtaatagcagtgggagtggtcagattctggatatattatgaaagtaagacaaatcaaatttcttgattcattgggcaaatggtaggacagaaaaaatgtagtcaagagatttgagcacaagcaactagaaagaagtagttgccatcaactgagatggagaaggctaagatgggtgtgggggaccaaagttcccttttggttatgttgaatttgagatgtccattaatacccaagtagagatgttgaatgccaatatggatttttgattctggagtttggaaaataggtctagggagtcctttgactcatagatgatatttaaagcgcagaactaggtaagaactaggaatgagtgtgcatgcttcagcacacctactacaactaggggtgagtgtaaatatagaggaagacttaggtttgagctctggtgcactccaatgttggaaggtaagaaagaaggaactggcaaagaagagtgagaaggagcaaacactgaagaaaatcgagagaatgtgtcttggaagacgaggtagtcacctat

SEQ ID NO: 118777 - DNA, 1052 bp, Homo sapiens
aagtaaaggaatgtcagcaagttgcagttctcttcgcataactgctccttccaatgataagtgaagacattcagcctgtacagttgtcagctagctatcaaattcactttaaaattttagagattaaaagagaaaaagaaaaggtaaatcaatgtgattgattgctttgtaagccaagaaataacattgtttatactgttagtttctcctggtataagatactacggtggtatatcttatcccttgcatcacttttctaagtattttgaggcgtagcaaattggtggaatgggaagcaaatagcaaaactgtaatcccctgcagctaattctctattgaagaaacacaagaggctgtcaaatgatagagtattgaccttactttgaattgtgtaaatgaaaaggactagagggaagtgacattattttataccgcacacactcagcttcacctcctcctctttttgaggctatagttcctccaaatgtgaacttacaggaaaaaaaaaactgagccccaagtactgtgtattgtcatagtttacatttatagagcactgtgccagctactttacatatgctgtctcctttactccacgtaagagccttgtgaattataggtgttattatcctcattttgtagatgaggaaactgtgaagtacacaagttaataatctgctcagatacctagatagtaaggaaagatctaggattcaggccaggtcagtatgagtcaaaagcccacactgtaaatcagtaccttctgtactatatgtttatcttctgttacaatattatcttattatgtagttctccagctgaggcctgtgaaagaaagccattcttctttgggtaatgggagtctcttctgaagaggaagacatcctggagtcagtcactcagcaaaaaggatgggtctcaggagaaaaaataattttaaaaaaatacacctgagagtcggtcgcagatgagcaggagatgtgacatcttcctatgtgtatccctctttaaaagtacatcttgcaagttgtctagaagggtacttctgagtg

SEQ ID NO: 118778 - DNA, 1234 bp, Homo sapiens
ggcttttaatgtatgtgattattgagactatcatcctacaaagggggaaaagatattgtgaacccaaactgaaagattataattattacttgcaagtgggaaaaatgtatttcttcatattttgatacatagtcagttatgttttaatcagctttactgaggtataatttacatacaataaaattcagtgactttaagtggatagttcagtgagtccttgtacaaatgtgtacatgtacacaaacataaccaccacgaccaatatgtagcacatttttatcaccacaaaaagctcctttttttcctccttctaatcaatcccttccccctacctctcaccccaggaaactaatgctttctctcacaatagttttcttttccagaattacattcaagtggaattgtataatatgaagttatttgcatctggcttctttcatttagcatagtgactttgagattcattcatgttattttgaaaatcaattagtttattcctttctattgctgagtattattccattgtatgtattattagtttgtttattcaccagctgatggacatttgggttactttcattatttgactattttgaatacagctattatgaacattcctatacaagtatttatgtaggtaaattttttttatttctcttgggtacatacctagaagtgggatttctaggttatatgctaagtgtatttttaacattataagaaactaacaaactgtttcccagagtgacagtgacagcattttgctgtcaccaacagtatatgaggattccagttgctctgtatactcactaacattattaacatctttttcatcttagccatgatagtgggtgtgaagtagaatcttcaagttgactaatcttttcttctgtgatacctaatattctattaatactgtatttggggctgggcgcggtggctcagcctgtaatcccagcactttgggaggctgaggcgggtggatcacctgagatcaggagttcaagaccagcctggccaacatggtgaagccccatctctattaaaaatacaaaaaaaaattagccaggcatgatggtgggcgcatataatcccaactactcaggaggctgaggcaggagaatcacatgcacccagatgcacccaggaggcagaggttgcagtgagccgagactgcaccattgcactcagcctgggcaacaagaatgaaattctgtctcaaaaaaaatattaa

SEQ ID NO: 118779 - DNA, 1326 bp, Homo sapiens
ggtttatgtttttttaacattgatcatatgtataagatttataataggccaggcgcggtggctcacgcctgtaatcccagcactttgggaggccgagctgggcggatcacgaggtcaggagattgagaccatcctggctaacacagtgaaaccccgtctgtactaaaaatacaaaaacaaaattagccgggcttggtagcgggcacctgtagtcccagctacccaggaggctgaagcaggagaatggcgtgcacctgggaggcggagcttgcagtgagtcaagatcatgccactgcactccagcctgggcaacagagcaagactctgtctccaaaaaaaaaagatttttaatagctgttttaaggtccttgtctactgatgtgatttctggatctgttcctatggatttttctccttatgggtcatgtttttttcattcttaatataacttgttatttttgaatgtgtgccagacatcatgaattttacatgttgaattttatttctgtgctagattttggtttttattttttggagacagagcttcgctcttgttgcccaggctggagtgcaacagcacaatctcagcccactgcaacctccgtctcccgggttcaagtgtttctcctgcctcagcctcctgagtagctgggattacaggcatgcaccaccacacccagctaattttgtttttttagtagagacggggtttctccatgttggtcaggctggtctcgaactcccgaccttggatgatcctcttgcctcagcctcccaaagtgctgggattataggcatgagccactgcacccagccaattttgatttttttaatgtggattttattctatcctgcagttgaataacttttggatcagtttgactcatttgagatcggatggcaactcttattttggagtaactgggccccaccactaaagtgttaaccttatgacattccagtgctccatgtgttatgaagttcctccacaaatgacttccagcttgtaatcttcaggaattatttggcctattgcttttcagtggttctttacccagccttgggagtttcttctcatactttttttttttttttttttgagatggagtctcgctccatcgcccaggctggagtgcagtggcatgatctcggctcactgcaacctccgcctcctgggttcaaacaattcttctacctcagcctcccaagtacctgggattacaggcatgtgccaccacgcctagctaatttttttgtatttttagtagagacagggtttcaccttgttggtcaggctggtctcaaactcctgacctcaagtgatcc

SEQ ID NO: 118780 - DNA, 1540 bp, Homo sapiens
gacgaaggcagtggcggcccagcgggctcagtgtgtgggtccgtggcggctcggggtccacccgcgggctgcggtgcgagcaggtggccccgttcccctcctcccgcgcccgcccccgcctctgtgattgggtggaagatggtgctggccggatgtaaatcctaatgacagtctccaaattcgcttccatctgtaccatgagtgccaatgcttcggcattagagaaggagattggtccagaacagtttccagtgaatgagcactattttggattagtcagttttgggaatacctgctactgcaattcagttcttcaagcactttatttttgtcgtccatttcgggaaacagttcttgcatagaagagtcaacctaggaaaaaggagagccttcttacatgcttagcagatctcttccatagcatagccactcagaagaaaaagttggagtaatacctcccaagaagttcatcacaagattacagaaagaagatgagctttttgacaactacatgcaacaagatcccccatgaattcttaaattacctactaaatacaattgctgatattttacaagaagagagaaagcaagaaaaacaaaatggccgcttacctaatggtaatattaataatgaaaataataacagcaccccagacccaatgcgggttcatgagatttttcagggaacattaactaatgaaaccagatgtcttacttgtgaaactatgagcagcaaagatgaagattttttagacctgtctgttgacgtggaacaaaatacatcaattactcactgcttaagggctttcagcaacacagaaaccctatgcagtgagtacaagtattactgtgaagagtgtcgcagcaaacaggaagcacacaaacggaggaaagtttaaaaactgcccatgattctagctccacacctgaagagatttaaatataaggatcaacttcatcgatttacaaaactctcttaccaggtagtttttcctttaaaacttagtctatttaacacttcaggtgatgccaccaatccagacagaatgtacagccttgttgctgttgtggttcactgtggaagacttatttgtagacttgcttcatatgaaagtgtggagggtgtgtgcagcctcattgtcagcattggtcccagtcgaggccattgtattgtaatagttaagagtcatgatttttggttgttgtttgatgacgacattgtagaaaaaatagatgcacaagctattgaagaagtctacgggctgacatcagatatctcaaagaactctgagtctggttacatccttttctatcagtctcgggattgagggggaaccgtgatgaagagatactttctgccgcatttcttctctggttattttggaaaggatcaagcactgatttttcaagaaaagagaaaatgcaggaagctctgggggcagtagcacactttgcacacgataaagcaaagacgatggattgacaagcccttccgatcacagtagttgatttatttgctcaggtatcatgctgtctgtac

SEQ ID NO: 118781 - DNA, 1001 bp, Homo sapiens
tgtctggaaaatatcatgatttgaatctcacatagtagcttgagctgcaaataaagaaaaccaatagttaacacatagtcttcagcaccattcattctgtttttgaccaaatgccctgtgatccttatgattccacactttaaaatctaccttgaaaataacatttatctttttcaaagtcctcaaccataaatcaaccataatggaagctcttcttgcttttattgcgaggatatatgctccaatcttcgtggctaaagtgtttacctggctttttcacagctgactcagtagatgggaaccttttaatgcaacctgcatggcatgtggtcaccaaatctatgtgaagtctttataatttttatatgattgatagcatattgcttttcactggtgaggggaaccatatctgcttcctgcttatctttgtagatgtcgagttacataatccatttactttcgtgactgggacttgaaatgtagaaatatgaaggaaaagagaaaagcaaccaggctcaacaagtctgtatttgacttttaggcctagacattttccatttatactatgctacatcccagagttgtaaaaccaaagctcccttttctacaaagtaacccagttaatacggagagatgcagaagaaattaactaattaatcagttattgattaatcaatcaaatgccatgtctttaggagggaaagctctatttttggcttttattatttttaattgacacttgataattttttatatttatggagtaccatgtgatatttgatataggtatacactgtgtaatgaccatttagggtatccatcactgcaaacatttatcatttgtttgtgttgggaacattcaaaatctgctcttttagctactcaaaaatatataacaaattgctcattatagtcaccttattagtgctacagaacactgcaacttattcctcttatctggctatacttttgtatccattaaccaacctttggaaaagctc

SEQ ID NO: 118782 - DNA, 1007 bp, Homo sapiens
ttcatcctgttttcagttgttttcttttgccaaattacatccataatagtttgtaatttgcaaatgtaaacacatcaatagtgtgttgctatatgaccgttagggagcaaataagttgcctgcaatcatcagaaaatgttggccgggcgcagtgactcacgcctgtaatctcagcacctttgggaggccaaggcaggtggatcatgaggtcaggagttcgagaccagcctggccaatatggcgaaaccctgtctctactaaaaatacaaaaattagctgggcatggtggtgtgtgcctgtattcccagctatgtgggaggctgaggcaggagaattgcttgaacctgggaagcagaggttgcagtgagcgagatcacaccactgcactccagcttggcgacagagctccatctcaaaaaataaagaaaaagaaaaagaaaatgtcactctatatcagtaaatgatgaaaatagaatgagacagctatgaaagaaggttccttcctggctgccattttttgctaatatttaaatgaaattatgtaaactttatttgtggtaatgtttcagttaaccaattattttccagggataatggatgtcattcatattttgtgtaactaggcaaagggctgtagacttataattatttggtgtgaccctggaactgttacaacatgttggtaatataaaggaaaaaggaaggtatctcacatttagtgagaacttattatgtgtcaggtgcaagagctattaagattcacgagatataatttctctccttacaaaatttcttgccatgggacaaagagacaagtaactcaccagttatttgatcatttcattaatatagtgatgacaaagaaagtaaaattcaaggggagggagtattgtcaaagagttctcctcatttagaccccacaacaaccctgaaaaatggatatcagcatccccattttacagatgaataaattgaggtacagagagatcaactggaaagtggtagag

SEQ ID NO: 118783 - DNA, 1129 bp, Homo sapiens
agtaatgtggttgggcaggagacaaatcaagtttgtctttactcagaattagcgtgcatttgttggtttaagtaatttctgtgtgttaataatacttgttaatccttcactttatagcatatgactaagtagtgatatatctttattaacagtggaatactttctatttatttggaatgtaggctttcagatagcattttaaatattaatgactgggctctggtagtcagcataaatatgatttgcattagcactaggttatatcatcttgagtgcctctgatgtcagctattaggtatagtaatatctgacatcatctccttaggttactgacaactttgacctctattcttatgcacagtttctgtcgtctcaaaagctcttttgaattgatttgaaattttgactcttccctttatgaggcagtaaaattgataattattcagatgggaacagagtgctgagtgaaaaatcaattccacccgctctctgctgcgtataaaattacttctgagtcggctggactgaacggatggccagagtaaaagcggcaggcaggagtagtgggaagaattagctggacagaactaatagcctgaagggatggacttgaaaaagagggagtgggccagttgggggttattattagcagggatgggtcccattgatcatctgtttacatcagctttccaagaccttataaatcagccctgaagaggagcagaacccaagattcagcctgttaccagtgggattttgtattggattattttcattttcacactcagatgaaaagtgagccattgattattcattggttgcccattaaatgctgtttttaatagatgatttgcctattgcagaaggtaatgaacaaggttgctgctttataacttgaggtttcagttttcaaggcatctgtgtcggttaagtaatgcctaaccctattaaaaggaatggattacaaattgcttaacagtgctgaaaaactagaccctaatgactaattgtgcttggagtttagagagggtttgtcagctctttaaactaaactgatgcaatgatactgcaattatttactagtttgaactgtttttccccccaacctggtcctattttgctggaagca

SEQ ID NO: 118784 - DNA, 1091 bp, Homo sapiens
tcctgaaagcttctctaaatcagaattccagttaaaactaattgctctagaaagagtaacaccttccacagaaattagcaagaactattacgcaattaatttgttaagagtgtatttttagcaattatcgtcttgaaaaccttaatatattgcataaaggaattagagcagttagggttgaattcatcttactcttgtctatttatctattttgctcaaatcaactgtactgaaatccaaaagaaattctaattgtgattttctttctctcccttttctcccttttctccctcctttttatgttatttctttttttttttttttttttttttttttttttttttttttttttgctaacatggcatttaactacaaattgtgaagagctgtcaggagctataaaaatcatacttcagtagggacttaagctgaaagaacattcacccttttcctcaatcagtcagtcagtcaatgaaaattgcttttgtatagtgctcttcatgacatgcatcccaaagtgaattacagcaaaagggaaatcatctgctcttttttcatttctgtgtttagactgaaatgatattgctcaacattttgacatactaaccaagacatctttcatacttaagattccattccataatactgagtaggagaaaatgcagtcgcatatttaactgatgttgagattttggcctacaggaaccttagcaagactattacagtcaaaaacacttaagcagatgaaatacagtcatatctcttgtcctcttaaaaagaatagtcagattttctaatgttaataaagacatttccagtgatccttaaataaaaaatatgctctttatgtaacccattagctctctctggttgatttacaactttattctcaataatacagtagtatattgatatcaaaaacaaactgaaagaacattcacaactggatcaggtaataacggatttaaaaagtttaaaggaagccagggatatgtcattagacactgaaattggaaaataggaactcaaatttcataacagaatttttgcacatggtgctacaatcttggttttaacagcaatcaatgcat

SEQ ID NO: 118785 - DNA, 1022 bp, Homo sapiens
ttacctatataacaaacctgtacatgtaccccgaacctaaaataaaagctttaaaatttagaaatttaagaaataaaatttttcaaatgtaagtgcttactatctgcaagcactagcttaacttacttacatatgcattatctggtttaatcatgacagtatctttgtgaaggtgtagtattatcattaccattttacagatatagaaactgaggcacaaaaaaaaataggaaacattcccaaggtcacaaagtcagtaactggaagaactaaaattttagctgaaatctgtttaactgtggggttcacatgcttaaacacaaagctatctctgttcctttgtttagtggcttctaatctaaagtatgtatgttttgagcacataaaatgaggcaagttgagcttccagtaagtcccactggggccatccttaaggtagaatggtttaaagcagtcattctataccccagcattatactacagccaggacaaaacagatgggcagtgacccaaagaggcagcgggcaagagagaaggaagtggctttgcagttgctgcagaaaaagccctgtggctcccaccaccaccaagacagacctaaccaagcttccactttcttacgctacacccacacccattcattaattttatagccagatgttgaaggtatataatttagtaggacacgtagtcttgagaaggtcagaatctagttgtacagctgtgttataatgccctttgtgacttttctttaatgcctccgaggtagctcttgaggtttaacctgatttttccaggacagaatcaatatggcagctgtgaaatgatgatagggaagcaccatgtgctttgcatctctctcccgtatccagcacatctctcttcattgtcctgactttcaccactgattcatcagcatagaatgccatttttaacctctttctggttgtaaactgcttctgttttctaaaggaaatttctgctgttgagtaccattaactctatcagtggtcattcttaag

SEQ ID NO: 118786 - DNA, 1012 bp, Homo sapiens
cagtttaaggatgtaacccattgatagcataacttgccttattaattgaaagggatggaatccaccagatgtacccaaaccagcagagagttgggtgactaagcaacagcaaagacaccatattgagtgagccagaatccagtctccaagtcatttatttcagccagtgacaatacatttaaactcctgtgcctcagcagtgattgatggtttaatatcatatataatttttttaatgaaggaaaaccatttaaatatgttaccatttgcactggtattctcctatgtacataactgcatttaatcattatggggattgtttttatacttgtgtaatttgtatccaagaaataactgtcaaagtcatctcatgctgttgctggaaatggtacagtgtgcttcatacttgaatagattcattcttcctgtacataattaagagtattggagctttcactattaccacataggaattccatgtttacatttcggagaatgaaaaattagccacaatgtgctttttcaggttcccattttctgaggctatgatatttaagcaccttagttttgtgccagtgtatgatttgaagagtttgattttaagacttttaatattaaaatacataataaaattttattgtctaattacaagagggtttagcctcttattaaagttgctaaatcaggcctagattagcattataatggcacagtttgacatggaatactcaaaagtcaagttcgagggagcagagggtttttttgttgttgtttttggtggggaggttcccctacccccacccctcacacaaaataacatggatgaaatgcacgtatggaaacaaacaaggagcaatttggaacgctgaagaaggagtggaggtgtcagtctaggatggtacccttaggcaaggcagctggtatatgtagccttttgtttatctgctactggtttatgtagcctttaggccggcaccagaaacaatcactcctacagggtcagctgctggtc

SEQ ID NO: 118787 - DNA, 1235 bp, Homo sapiens
ttgcttttatctgttgacattcagtgatttttggtttgtctttttttttttttcttaagaattctcagaaaaagaagcactgcagagaacatctgtgtctttatgctaacataacacagatagcagcatttatgtctatttcacacatagaagttatttaggatttcacttgcactcccaagttttgatacaagtgcagcctttctactcttattgtttttatgacataagaaaatgacacctaggatcgtctccctgcatcacacgaagctagcctaagacttaccagacagatcctaaatctgtatgactaccacaaaaaggatggctaccttggccagaaaataatgattcagtaatgttttcttaccatactattccaaagaaccttcatacatccttcttgaagacctaagcatttccttcattctgtaacagaagccttatttcctgcagggtttctgggacataagatgtcgctatagaaggaaaacctcaggctcgaacagagaattttaataagaatgattatgatgaaaaaaaaaaccactagaatcaattatatgctaggctgtgtgctaagtgccttacgtatacatatatgtatgtatatatatatatatatatatatatatatatttatgtcttacagctctgtgaggtaggtattttatctccattttgtaatcaaaatattgtaattatagctctgagaagttaaaaaactcacccagtatcatacagctaataagtagcagaacctgtgctcttaaccactgtacagtactattaactaactggcctagaaacaggattggcagtgatggaagagtggcaggaagagccatacagcattcttcaatcaagaactgaattgagtcttcagtccttgagcctaggacttctttctttttttttttttttttttttttttttttttgattttttagaactgattggacaggaggtagacatttgacccaagctggctcagtttgagtcgttcctccctagatttagaaactggcacttaacagatgctggttgccaggcacagtggctcatgcctgtaatctcagcaatttgagaagctgaagctatttaggatttcactaaaagctgaagcaggaggattgcttgaggccaagggttcctgaccagcctgggcaacatagcaagactctgtctctacaaaaaaaattaaattggccgggtgtggtggctcacgcctgtaa

SEQ ID NO: 118788 - DNA, 1838 bp, Homo sapiens
ctactaaaaatattcaaaaattagctgggtgtgatggggcatgcctgtaatcccagctacttgggaggctgaggcaggagaattgcttgaacccaggaggcagaggttgcagtgaggcgccattgcactccagcctgagactccatctcaaaaaaaaaatttataaagatgctggtcagccactagtcctcacctaaattgaagacgtgaaaactcaagagccatgaggcagccattccctgccatatgctcagagaaatagccagtcctagaggagagaaaaaagaagcagacatgccgaggatctcaaatgagaggccaagcagccccagagaaagaaaaagactgagaaataccctgccagctgccttgtccatggttccaagcccttgagagacttaactgcactgccttgtctgggggtgaaactaccccttatagacttaagttttatcagagaccactcttgactcgggagagttgtgaggacaaaatgaaccaatgagtatagacttacctaacacaaagaaagtattcgataaacacgtaaaattcgccttcactttgaaaaacgatatgcaggtaccacttttttgtgtccttgaggggaaaatatccctgctatttatactataaatgtgaaaaataccctttcaggagattccaagcccaagacttcttttcaaagataatttgattttgaagccatatcactgagatctttcctggtcccatccctgtgttttgcctttcttaatgttctttctgtgataagcattctcaaaatcacactcactggactgggtgagggcatggtgtggtgtgagtttgaaattcttggccccaaactgacttttttcttacctgttcctcctgcatacttcaggcattgccttgcagtggccaaaatgaaataaatctaatttcttagtccattatgtgctattatagcagaataccgtagattgagtaatatgtaatgaacagaaatgtatttgcctcacagtcttggagactaggaaacccaacgtcaagggtctgcatctggcaagggccttcttgctgtgtcatctaatggaggtgggtggaagggcaagaaagagcaccaggaggccaaactcaacctttttataaagaaccaatcccagaataatggcattaatccaagcatgaaggcagagccctcatgcctaatcacctcttaacgctgttgcattggggattagtttctaacatattctttttgggggacacattcaaaccatagtacctcataattcttcccattcatataatgtcttcatacctaatgtctctgattctcacaataaccctaacagggagataaggccaacacggattttttttttctaactgaggagtctaggtacatcaacaaatttaatcctgcagtgactgtatgagagacctatgcagagattcagagatgtgtgaaagaacttgcccaagtcacacagctaggaaatagtagcatctagattataattaaggcttcttatcactagatctcacacagtttttataataccacactaagttttcgcagggccttaacctactatttctctgtggcatttcttcttaccttttcatccctgtctaagagagacagcagagtaaatgagaaggtttcccctgccttcatttctctgcatggaattgtgagtggtgtgagaagctctttgaatttcttcaaagaatggcacagtataaagtaagagtgggcttaataaatcacatgacttatttattttacagttattactggtttttcacatacttgcaggttagattatgtgattcccaaagtgtagtgt

SEQ ID NO: 118789 - DNA, 1029 bp, Homo sapiens
ggcgtgagccaccgcacctggctgaaagctgcatcttcttgggaaaaatcagatggcccagacctcctaaaggctcagaccctgtggagaatggttaaaccagcagttcactaccacatcactgccagaaagatttattcagctttaatggcaccccatttcctgcacacaagatctgcgcccaacctatgtaatcaccctcatctgccaccagtactccccatccaccctttccattcccacagaactgctcctcattcccccagactcctctccaaacctttgcacctgcttgcccttcttcctacctgactgtcaaacttctcttattctcaacaacagatccaaatgtcaccttctctatgaagccatccctggctgcttccagccctaggcagggttagcctcctctggtttctaaaagccccttgtgtaagcttctgtttatggccacttaaactgtatcttctgccattgtttctatactgtgtatctcctcccctactcaactgtaagctctttgagggctgggactgtgacttgttcatctgtatattcccagggtttgacacagagccttgcccaaattaggtggtcagtaaatgtttaaatgaggaatgaggttctattcccaacgctttcagtcactagcattccttgggctatgtaattattagggaaaaagagcttccaaatctcagtagcgtctttgaatcatctccctggcctcttggccagcactttctgtgccattagataactataaataaaaactctcaaatctgaaaattctgcatggtttaaatataaactctaatacttaatggaaaatatttctgaagggtcccatgaattgtccacaagaataattttcccccatatgaaaaatgaaaacattttggatcctttcgtagttcatgagcatgatgattgggtgttcacgtgcatatgtgaaccctaagcagtgtgcatatccatgacagagataactataagcacatgtttgtattattcagtaataaactctaa

SEQ ID NO: 118790 - DNA, 1036 bp, Homo sapiens
agctgctttatgagatctgcagccacttgaaatatgatttactactcgtaaaaagtttcaaatggataatgaagattcaggaatgagactcacagtggtgtagtgtagtcaattttgttgctgttgctccacagtacatctctgccattgaaatgaattatttatcataatttatttcaaccatggaaaataaaactgctttcattgtgatgtgtgcagtaacattcagaatagacacattacatgcagtactctcaattaattaatcctgaagtttcattctaactttatcttctttcttacaagctaggagactgacaggtaattctttccccagtaaactgtgattaaaatggatgttttgagaactaggggtaatgttggtaatagagtaaattgaaacagcaaaactaggttgtgtttttccttagatgtaacaatggttggaagagtttcttaatttttgaagcaattaatcactttgagcaaaagcatcccttagctttccgtaaggaggggatggcagagtgggggatgcttttagttgagatgtggaagcatgcagtgctaatatatgaccaaaaccagctgagtttcctggtcctgaggtgcttttgaggtaaaaagcttctttttttaacagcaagactagcattgtgcaaagaacaagttggcagggatccccagtgattccaggggagagcaggtcatctgtaattgattgcagtcttgtttttttaaaagagaggtgcacctcatcctgcatttcatttgacttttttttaatttaaaatgctaaatacttttattataaggctacaaaaacactataagcagttagtaatgttatttttatatatagataattttaaaatttaatgtaacttagatggtagaacttagttaatccaggcaggaaaatataactaattatatgcttatttatccattatgttcatttttcatagcattccactaatatcacataggcgaatagcagacagagagaacaattgatttcttttccctaaagata

SEQ ID NO: 118791 - DNA, 3106 bp, Homo sapiens
tccagcctgggcaacagagtaagactccgtctcaaaaaaaaaaaaaagaaagaaagaaaaagaaagtatgacacagcgtatttgggtaggaaagtccaatttgctttatgcttgtgctttacatcccatgttagggtagaagaataagagaagagttggggaatgaacagagatacagatcacacaacattgctttgttttacttttccaggtcagatatttgtagagtaattttgtgttttatttagaattacaggttttcagaacaacagaaacattgtcattcaaaatccttacaaataacatgtgccagatcaaataaggatgctttctgaactgtttcctattttggttgtatatgtgtctgtgttttaccttaaccctcaacaaagttagatagttgtgaagagactataatctcatttatctgtatctaatcaggacatgaattggggcccttcattgagcgatgaaattccactgggctagacctgagagagtagctgcagtagcagtgaaggagcagtagattgaatgcctactatgtggcaagcacagtatcaaatgcttgatatatatcagagaagttattcctcacagcagccctttgaagtagctgttattgtcctccattttatatgtaaagaaagaaaggctcaaataagtgaaatgactcgcccaatgtctcaagttaagtggcagggccagattggggctccattctgattggctccaaagcctggctttaccataccacgttggtttctcttcattgagagaaatttcctaaaactcctgccaaatcctgtgggaagaatggaggagaatgaggaagcagctgaggcggtgtggggcatgcttttcctaagtggaccaagtcatacaactctgcctcagaaatgggccctttcctggtatggcagaatagctgctcagggtaatgcagtagatatcgtatgtgttttcagacataggccctagaaaatgtagcctaggttgggcacatttgtttaattttattttatttagatatagacctccagaagctgggcagatttgaaacagccattccagccatccctgtagcagtattggaagtgagcagaagttgaaggattggagccccagctcacgcagccattccttgtaccaaatactgatggtaccttgtgactcaccgtgggccgggtggtgcagaattgccaagagctgtctccttttagtattcctgtatttgtgtcgttaaccacagaaagcctcccaccagagatttcatatgacctgggaagtgattctgtgcttaagcatttcatccagtattcttccacatgccccttctccagaggaatttgcccccattggttggctgtttcccccataccctactgtaagatattacaaaaaataattctggatatgggttgccatgtcagtaccatttaagctgatttgctcactaattttcgtatttccaaaagaataaaaaagaaaaaaaaatcacccattttagcacagtttatttttagaaaagtgttttattcaaacatatccttacttattacagacataaatacatgcattcagacaaatgaatacacaggagaaccatataaagtaattggcacatcacttcaagatgctttttcagttactggaggaatttgatgcctctaactttaatcttttccattaaaatatccgttctgccttcagattgtgaagcccataatattttagactgtctagatggatctgttagttttgcttgtcagtttaatttgtggctctatgactttgggtggcttgttagattgtacatggaaactcgtgatctgcaaatgatgttcaacatcccaagcttaagtcctctccccagagagactggacataccataaatatgcaattggcagatttcatttgcaaccagcctaattgatatgatgatgtatagaatggcagacgtttagaacggcaaagaagctcattgctgttactatatcccttaaatgtttatagcactttttactctttgcaatgcattttatgtacactatctcatttgattctcagagcttccttgtgctggattattatttccctccttatagttaatgaaactgagacacagagagaagttcagtaacttgcctgagatcacaggataaattggatttcaaaaaataccagaggacaaaaccaactgtgttccaaacaagccaggccaccaaagcccagtaagggatggtgtgtgcagtggtctttgccacgtaattgccgtttcccctgccctcttttggggaaaggagttctggagctgtgggaacagaagagcttagaggtaggaggtaaagagtccaagaagcagaaactatcatcagctccacatgaatgacagaaacctgtttcacagccacttgcctggactatcgcagcagcctcatccctggtctttctcctttagtttcacctgcacagtacacattctacatgtccccaaagagatctttcttaaatgcaaatcagagcatgtctcatctgtgctgcaaacatatcactagctccccactaccatcaggatgaaatccagattcctcagcagggtcttccagtctggcactggcgtctcacctctggcccacctctcttctctcctgtcatgctaagtttcttaccatggcagaaccctttgtgtgcatccccaccctccttttttgatgccttctttgcttagaacacatttataatgaactctttaaatgttaccttctccgtgcagtcttccctgacttctcctcaaggacccagagtcatccctgcctcctcgcatgcccactgcactttgcccagccctatttcctgttatttctctcctaagtagtctcccccaggaggtttcaaactacttaatgtcagaggttgtggtaaatgcctgtataatcttatctcccctatggatcttacaggctgaatttaagagaacggatgagtaatgtacatgtaggaatgaatgagtgagtgagggaattagtgaacgaagagtgaagagaaacctcgaacagcctaagccagcaggaaacatgatgttccaggatcacatggaatgtg

SEQ ID NO: 118792 - DNA, 1071 bp, Homo sapiens
aattatgtgtgttttttgatgtaagctgttttaatgtatgatggaaattaaatatcatgcttttggggctgggaagaataaatgcatgactggcaaaatgttgtctttgtgctgaaattaggctgtttccaatgattaggagctgtgtttagtatcagaacttgtgtgtgtataaaagcccacagtcctcagcagagaagaaaaggctgtgcaggtgtttgtgagcaggcctgacagacattttccttagtgccacaaagctctccccaaactaaagcacgcccctctagtaccccacctcagaggagtaaacccattctaacccccaaggacagagacttggaaaaaagcccaaagtcatttaaggagtgactcactgaagccaggaaagatgataaggcctgaggaaagacccttggccttgccttcagtcacttaaaatgctccctgggcatttttagttattttcttcagtctgggggcccctcccatttcagtctttctgtggttagtagagatgagagtcaggaaaagcatgcattcagtcccccacagaggaggcaaggacttcatcagcctaagcagtgacactagaacaattacagcaagacattttatggaaggcatcatagaattgataactaggagtgtctctatggcatggattttctctaagggcttaaagttcaaagtggacctagacaaaaactcctctgagcattagtgagccctgagtagatgagagctgctctatccatcccctgccagctgtcttcaggcgggacttggagtcggagctctgacactattctgtctcccatcagtatttcagtgaactgagagcaagtttgataaacagccagcccctccccaagcaggaggtccttgcccagtgcttcagaaacctaatggaaggagtggagcagaacctgtccgtcaagaacagagacaggtgagcattgcccagtagtgtgtcactgggggaagtagacattccaggtttgttgaaaataactctctcgtgcttgacacagctcacacatggatgtcccttttctgttacaccttgtg

SEQ ID NO: 118793 - DNA, 1055 bp, Homo sapiens
tacaattctcatttcctaatctctttcagtgtgtatgcctcactgatcaagtgacagcaggtaaattacaagggcagcaagaaattacaacctcaggaacaccaaatacatatcagaacatacctggccaaaacagtgcttagaggaaaacgtatgcccttgagtgcatttatttaaaaagaaagaaaattgacaaattaaattttcaactcagcaaagaaggaataaatctttttttaaaccgcaacattcacgaaagaggtggcatcttaaaaggggataatgacatcaaaggcttttttaaaaaccaacaaaataacaaacctttggcaagtatgatcaggagaaggcatgaatgagcgacacggggaatgagaagtggaaggcattagtacagattcgtatgagagttgcaaattctgagagaatcttcccacaatgttacaacaacacatttgaaaactcagatggaatggaccatattctgggcactggcttccagagttgagcaggcatcagaatcacctggagggcttgttaagcacagactgccgagtcctaccccagagtgtctgatgccgtaggtctggcgagggtccaataatttgcatttctaacaaattctccagtgatgctgatgctgctgctctggaaacacactctgagaaccactgtcctagggactaaccaagttccccccattcctgagctgcctaagagctatctggataggaagtgaaaggaggcttataattagtggcccaaagctccttcatctgtatgacagggctggacgatgagggaccgtggatctcaggaagccggaagccaagcagtgaagcagagccctgacccgtgccaggctttacctggggcgcttatttaatcccatgaggtttatttaccagatgagaaaactgaggcataaagaggatgaataattccctgagtccacagctggtaaactgaggtgggaatcccattcttaagcacacaagctgggagcagcgctgtgccacccacgccttaattctgtgccacaaacctctgtgcgg

SEQ ID NO: 118794 - DNA, 1749 bp, Homo sapiens
tcctgaagtgattacgcctgtttggaggcttgcagggcactaggggatggggaaaggtgaatcgaggtgctctctggctcattcgcagccggctaacccgccatatcttacacagctaagggctgccgacgccattttgcagggtgggctgcgcagactcttggcgggaggccggcgcgcttgagcgggagaggacgtggaagggttggaggtggggagtgcgcgttacgactggaaagcacgcgtgcgcacaggcgacagcagcggaggggtggggccagtgtacgagtgcgcgtgctcggtgggagcccgcggagtacctggaaggaggtgggggcgaggtagaaaggagtggggttgaaaagcgcttgcgcaggacggctacggtacgggggtgggagggcttcggagcacgcgcgcggaggcgggacttgggaagcgctcgcgagatcttcagggtctatatataagcgcggggagcctgcgtcctttccctggtgtgattccgtcctgcgcggttgttctctggagcagcgttcttttatctccgtccgccttctctcctacctaagtgcgtgccgccacccgatggaagattcgatggacatggacatgagccccctgaggccccagaactatcttttcggtaactgctggggggagctggagcgaggccgagcggggcctggtggcggtgagggtgggggtgaggggcgggaatccggctgcaaccgggtctggtggagaccgccagaccgacgggaggcctgagcgggtgggaagagctgcctgagccctggacctggagggattggagccgcggggggagccggtggcgtgaagggggaggagacgagcggcctgaagcgtctggggcgtgagcggtccgaggcccggggcctgaggtaaagtggaaccggccgcctggaagttcggcctttgccggggatacgtggcggagctccaggcgtggtttattttctaacggcggtggttcataggcttctgatgccaggccccgggttggtggtcctggaggctgggttcaccgggaagcatgggcctgcttgttggagcgggtagatgcacagcctggcgttattctggcctcagagcctggagctgccggacgtagacttacctcgcgtgcttcggccagttactgggggtggggaggcgcggcgcggcgtgaggaggccgcaaccgctgggagcacgtggttgccacgtggttgggggagggaggggggtgtgggcgctacatccgggactcaccggcgtgttgccactcgtgagccagggatgctgtggctctgttgaagtgggaaatgttaagaggctggtagcactagggttctggaggtctttgttcagtgcttacagcatgtactgtgatggcagctctcatttttttgagccccttttctgtctcactgcggtaggtggagctagccccactttgcagatgaggatactggtgcccagagataaactcacttaacgaaggttgtacttagtaaaggcaataagagactaaatctaaaccaagacgcttgactccgtagctgctgcttcgtgaatattaatgaggcttcgttttagggggacgtcctcgcatgccgccatttgtgcggcattgaccaaactgcttttctaaatacaagaaacacgtagagtgttcggtttgagtcagatcaagacctaagactattcgcagaattttgggagcaccacccccctcgacttgcgg

SEQ ID NO: 118795 - DNA, 1196 bp, Homo sapiens
tttgtcatttttcttttgtaatagtaagctattcatgtttgtaaccgttctcatttcgaaattgccatttgggaatttaggtaggtaaatcagctgttttaaatagtgggaaacttaacattggacattacatttggtttcagataattgcttcaggttgagatttactaaaccattgagcttgtttatgcagaataacagtacctatcagcgtagttagagatgaaatatggtatgatgagagaatggaattatagtcttttatgggtgtctgtagaggtttctgttcaagaaatctaggaattgatcattctgctttgccctctggtagctaaaatagtgaaaaactagttcaaaagttagacctgacctttttggttacccacacttaagtttcagtgttatttttctccttgttagagttgcttttttcttcatttacaggttgtgaactaaaggccgacaaagattatcactttaaggtggataatgatgaaaatgagcaccagttatctttaagaacggtacttaaactttcaaaataaactacttaaccctacttgatttcagccttttagtttctattcatgtggcttgagactttttttcctttgctgactgcttataaaatactatttcttacacctgggtattgtgtgtacctcactgtctgtacatctttgaagaacttggcatctataccactcatttggtaaccatgtaaattccagtcacactgttcaacttgccttattttcttcagttgaattacaaagcccttgtaaaaggcatcgataatctttcatgtctaccagagactagccttctgctcaacttagaagttgctcaataaatatgttaggtggtctatattgtgtgtatgcatatttatgcatttcttaaattttctgaatatgagaaactgatttgccaagatcacaaaacctgaggacaacattgcacaaatttgttttccagggtaatagtgagaggtttatacttgttttttaaaaaaatcacagtcatgtgcctcattgcaactgctgggtcaacagatggatcgcatatacaatggtggtcccataagattattataccttatttttaatatacctttcctgtttttttttttctttggaggcagtctcgctctgtcacccaggctggagtgcagtggtgtaatctcggctcactgc

SEQ ID NO: 118796 - DNA, 2426 bp, Homo sapiens
gatttccgagttcaagtaattccctgcctcaccctcccgagtagctgggattacaggcatgtgccaccacacctggctaatttttgtgtttttagtagagacgaggttgttaccatgttgtccaggctggtctcaaactcctgacctcatgatctgcccgcctcagcctccctaagtgttgggattacaggcatgagccaccaagcccggccctttcctatgcttagatgcacaaatactgtgtttcggttgcttacagtattcagtacagtaacactgtacaggtttgtagcctaggtgtgtgtagtaggctataccatctaggtttgtataagcacattcttatgattgtacaaagatgaaattgtctaacaacacatttctcagaacctagccctgtggttaagtgacgcatggctgcatataacatttagtgggggggtgtaaaataggtggaactcaaaagttgaagtagtattttttttttgttcacaggtcagtttaggggctggtgcaaaggatgagttgcacattgttgaagcagaggcaatgaattacgaaggcagtccaattaaagtaacactggcaactttgaaaatgtctgtacagccaacggtaagggcacttacatactttggatgttgtgtcaaggtttaattctgttttaaggtaggtttggtgtcatttagttgtgccaaggagatagaaagtggttctttatcttctgtcactggagttcgatggtcaactcttgaacatgggggcttctgctgctacttttatcagaggtggaaaaacaggttcactggtttgttgatttggcttatgtgtttgcctgtaatgtttattgttcattttcttcacatgtttagtgatgaaaaatttctcccttctaggtttcccttgggggctttgaaataacaccaccagtggtcttaaggttgaagtgtggttcagggccagtgcatattagtggacagcacttagtaggtatgttatttttatatattatactacttagtttgtcctctttagtgcagttgcttggttcccagtttggacttaaagcatgggtatagtactactgtctttttaataggttccaatgtgagtctagaaattggagaggacaaataaatttttggggcgggggggagaggaaatcttgctgtcacccaggctagagtacagtggcacgatcttggctcactggaacctctccgggattcaagcgatcctcctgtctcagcctccccagtagctggggccacagacgtgcaccaccaagtccagttgcgtttcatagttatagtagagaaggggtttcgtgatgttggccaggccgatcttgaactcctggccttaacgtgatctgcacgccctggcctctcaaagtgctagtattacacgtgtcagccactgtgcctggcctaaaaattattttttaataaagacagtctcattataacggctggagtgcagtgatgtgatcatagcttgctatatcctcgaactgctactgggttcacctcagcctctggaatagctagaactacaggcacactccacgcctggctaattttttttgtatatgtgcagatggggtctcagtatgttgcccagattggactcttggcctcaagtggtccgccttggcctccccaaagtgagattacaggcatgagccaccctccccaggcttcttgcatttaaaacctggcagtgaacattaggcctcaaaatacttttgttaaaaagttccttttcccatgtgctctttttttttttttttttaaatagaatagaagtctcagtttttagagtatttactatcagtgttctttttttttctgacttcttgctgcttgagttttataatgtctaataaattgtattttagctgtggaggaagatgcagagtcagaagatgaagaggaggaggatgtgaaactcttaagtatatctggaaagcggtctgcccctggaggtggtagcaaggttccacaggtagagatggcaattttattataggttttgtattatagcttttagtttggtgatagaacagctcttgttcatgagtacgtatcttttcttttaaaagaaaaaagtaaaacttgctgctgatgaagatgatgacgatgatgatgaagaggatgatgatgaagagtaagtatgattttagaaacttgatatacttccggaatcttgacaaaaaaaggaatttgacatagttatatgcatgagggttttataaaagtcatttacaaaaagccatcctatgtaatagtttataataaaagggcaggtggtcatctgttgtcagtttaagttaaatgagctgagttgaaaggatattgggtctgtgagcctttacaatgctgtgacttgtgactcttcagaagggtagactatagtgtttgtga

SEQ ID NO: 118797 - DNA, 1769 bp, Homo sapiens
gaacatggaatgtttctatttaggtctttaatttttttttttaacacaaattcactctgagtgtacagtttaatagaactatacattacttaaatatacatacattatacagtggtatagtgtgtatttatgcaaaactactcattgagcaacttcatttcccagcccctagcgatcacaattataccttctatttctttgagtttgactacttttagatacttaatgaatagaatcatacagtgtttgttcttttgtggctggcttatttcactttgttcaaggttcagtcatgtagcatgcaagaggattttcattgtgtgtacatatacattttcatttagtcatttaacacttgggttgctttcacctcttggctgttgtgaacaatgcttcgataaacatgggtgcacaaataatcacttcaaggtcctgctttcaattcttgtgtctactcccaaattttgaaagtgcttaatgtcttgacatttcatttgtagtgatgatgatgatgattttgatgatgaggaagctgaagaaaaagcgccagtgaagaaagtgagtagatacaatgctacaaggttgttaaactaacaatagaaatggtgattttttagtgctatttgcttgttttgtagttaagggaagctggtgtgggagatcatctcatactgaaaattagtcctgaggaggattacagaaaacttaagagtggggaatggtctgttttctttatccatgtggccctccacccagtttgttagtcttgtgtaaccttttgtccaagtggttgctgctttttccttccttttttttttttttttgagacggagtctcaatgtcacccgggctggagtacagtggcgcgatctcagctcactgcaacttctgcctcccgggttgaagcgattctcctgcctcagcctcctgagtagctggaattacagactcatgccaccacacccagctaatttttgcatttttagtagaccaccatgtcggccaggctggtctcgaactcctgacctcgtgatccacctgcctcggcctcccaaagtcctgggattacaggcatgagccaccacgccaagcctgtggttgctgcttgtcttacatggcttggacagctttgtttgcactgttgttggggtcagggacagtgattaagataaatttctaattgcagtctatacgagatactccagccaaaaatgcacaaaagtcaaatcagaatggaaaagactcaaaaccatcatcaacaccaagatcaaaagtaagtggctacatttacacgtgggtctcattgatctagttggggaaaaagattctactgtggaagaatctagtgtgtctgaaatttgataggcctttatagaacccctgtaattgctgtttaaaagttaaaatcagcttgctgcagccaggctcagtggctcactcctgtaatcccagcactttgggagggaggccaaggtgggtgggatcacctgaggtcaggagtttgagactagcccggccaacatcgtgaaaccctgtctttactaaaaacacaaaaattagccaggcatggtggtatgtgcctgtaattccacctactcaggaggtggagacaggagaattgcttgaacctgggaggtggagtgcagtgagattgcaccactgcactccagcttgggcaaaagagcgagactccgcctccaaaaaaaaaaatcagcttgttgtgtgttgtaggtacacacacacacacaaacatactaaatgtaaggtgg

SEQ ID NO: 118798 - DNA, 3855 bp, Homo sapiens
ggcagaggctgcaatctcggcactttgggaggccaaggcaggcggctgggaggtgtaggttgtagtgagccgagatcacgccactgcactccagcctgggcaccattgagcactgagtgaacgagactctgtctgccctgatttccttttttgaactgacttagtactgtgcataaaagcaaactcccaagttactctttttttttttatttaaagagatgggtggcctactcttgcccaggttgaagtacagtggtatgatcatagctcactacagcctccagctgctgggcttaagcaatcctcctgccttagcctcctgagtagctgggattacaggcatgcaccaccatgcctagctaatcatcttattccttccttaaaggaaagattttaagaacaaaattatatggcgtgaatttattgatgataattccagttgtataattagctttataagggagttttgtgagaatatttgaggaaatccagatagaatgggttttaattaggaattgtatttattcttatgaccttttggaaattcatttctttttcagggacaagaatccttcaagaaacaggaaaaaactcctaaaacaccaaaaggacctagttctgtagaagacattaaagcaaaaatgcaagcaagtatagaaaaagtgagtaaagttatcttaaaaaaactttgtctcccccctcaaattgcacgtgtctggtttgcatagacttgaatgtttcttgtttttttgtttgttttggtttaatatacttgcctggttcgtggtatgaattttttcaaaaatttcttataaaacatttataatcgtgtctgtggtgatttttgcatatgcaaaattaaatatgccttattttccattatgcaaggaacgtagtgcactggttgcaagataacattctgaccttccatgttaaaatagatcagtgaaaaccctttgcctattctggttgtaagatatgctagagaaccaacagagggcgtatgagacttcattaaaattacaaacagctggaaaagtagatgctggctgttgcttggtattatagttaatattcatgattgaccctagtcagaagtgattttcagcagattgagacatttctctttgccctttacaccaagttgtcaccagttaatacatgtagtaatagctagatttcgtgaatgactaataggcttaaatctagtttccttttgtcttaaataatggaaatgtgggaagagggttaggtctctcatctgcttgactgggggatttgagtaggatatggaataaatggtttaaatgccttggaagcacatttgagagaagctttaattctatgaataatacttttagactccaactattgagagcaaatgtggggtggtgaaaaattgccaactcatttccccatgtttttcttgtaatctatagatttttcgtggcttcagtagattccttgtacagtgataagtccactggaaaaagaattttagaactggaacatatttcttttagtcacactgtaaaccctttagccttcctggttatcactgatttttgtcccttggatacaatgctaaaatgacatcttttagatgcccctcccctccattttaatatggtcctatctccttggtttaattgcaggcgcattgaacagtcctgggcactacatgtaaattaagcccaaagatggggagaaaggaaaaggagagacaaatatagtccatactgagtgtcatcaacaatccagactgaagtcttctattttaatctcaatccccttttctgatttgccacccatgcctcttcaggctggaaacaatctcttggttccctaaagcactttcttctgactgctgtgattcagtgaaccttgccctttgctttctattacttgtgcatttgcctcacctgacaatgttttaaatcgcctttgtatctccttagctgctcaataaatatttgaatgcatcaattaagaatgtatgtgacaataattttgaaatggaaattgtgaggtttattttactaggttattggaggcagttaagtttcttaatgctatacctgattctgccaaagtcccttggacatttgaaaaccttttcaatcttttaaaaatgcataaaagatacttagagggaaaggtattaattaaatttagtaaaaacaaatatattcaatgctttaaattccaaagtagtgataaatacaaacatttcaagatatttgcaatagtaatgttttgaaattttggttacaaagtcacaggtcttgccaatactgttgtagtttcttgcctatatccgtaatttgaaggaaatggtgagagtgattagagaagtgtaattactgtaattttttcccctattgtagtttcttgcctgtatccataatttgaaggaaatggtaagagtgattagtgaaatgtaattactgtaattttttccccattcaactttatatatctttaactgatgaccagatcattgttgttctgaaccagtttgtggtcagcaagtgttttgtggggttttgtttgtttgtttttaaagaacagtttgggtcacttgacatggttctccaaagggatgttatgggttgtatttggttctgggtgataaccgacttgttagataatttagataagcaaccgagttgccatgtttgtttgtcgaatctcaagtgtagcttatattttatgttcctagagaggttgtcagggaagatttgaccctttggcaaatctgtttgaatagagatactagccatgctgcccaatagggctttctggccctgaaaaagatacggagtattcttggaaagttgaagggaaaaagaataaactgatccatgtagtagcatgcagattattgaggaattttctaaaggtatctctctcggtgtatttctctacttacctgtaataatgcttttgtcttaatagggtggttctcttcccaaagtggaagccaaattcatcaattatgtgaagaattgcttccggatgactgaccaagaggtaactggattttctggggacatgattaaatccaagtttttttgtgatttattatgattctgcctttaccctttttaagtgttggctctttttaaaaagttcctaaccacagataatatttcatttaatgaaatacctgaaaactcatgtatttaatgaaatgcatgaagaatacagttggcagtctgagatgataactttagtatatttttcccagatttcctatagttggtaaattatttcttggttattgaattcagttttacttttttggtactatgttggttaaggaaattgctgtggttttccttgctgttccatttgactgcttggggcagtctggtcttggcttttttgggagttggtagagatcttttttttttttttcctagatcttatgggaaatacattatgccaaaatcatcctaacatgaaatctggaagcaagacactaaattgtggctactaccagatacataagcttgagttagctgttagattttacagttagtacatgtgaaagtcttagtcaacataaagattatgcatttatttttgctcttatttacagttgactcataagtgtaaggacaatgtaaaagtggttaaatagggatgttaggtatcgtgtggagaacggatgctgcatttaatggtctttaggtttcctgtggtcagcttttttcaaaaaattaggaaaatttggcaattagctggttttttttctgccatagtattttgcacttcaattatttaattgcacttcaatttttagttttcgggttcgtaaaaccctgataatggttaattttgagtttagct

SEQ ID NO: 118799 - DNA, 1350 bp, Homo sapiens
tgagctgaagtgatctgcccgcctcagtctcccaaagtgtagggattacaggcgtgagccaccatgcctagcctcagcatatagttttttctaaatgtacacatgcccaggcacacatgcacaggcaattcagaataagtttctggtgtttatgtaactttatttgccaaatctggccaactctaaagctgatctcgggagatgaagttggaagtaacattggccatatgggtctctgttctttctgttgatttccttaagtaaataatgctaaactattaaataattattagtatattgttcacatttttatgactgattaaagtgtttggaattaaattacatctgagtataaattttcttggagtcatatctttatctagagttaactctctggtggtagaatgaaaaatagatgttgaactatgcaaagagacatttaatttattgatgtctatgaagtgttgtggttccttaaccacatttctttttttttttttccaggctattcaagatctctggcagtggaggaagtctctttaagaaaatagtttaaacaatttgttaaaaaattttccgtcttatttcatttctgtaacagttgatatctggctgtcctttttataatgcagagtgagaactttccctaccgtgtttgataaatgttgtccaggttctattgccaagaatgtgttgtccaaaatgcctgtttagtttttaaagatggaactccaccctttgcttggttttaagtatgtatggaatgttatgataggacatagtagtagcggtggtcagacatggaaatggtggggagacaaaaatatacatgtgaaataaaactcagtattttaataaagtagcacggtttctattgacttatttaactgctttatactttgtcaaagaaataattaatgtagttaggaatggcaaatagtcttgtaaaattctatgagaatgtccctgccctccccttcaatattctctctggagctaaccactttttcatcataaggatttagtgctgtgttcccacctcctgatgatagttaacaattattataactatgcaacatgtttccaaatgttccattagacctcctatctgcctattctagcctcacttgcaaagaaaatgtggcatgttaaaacagcttaaaagcagcctttcaacctgtatggttttttcccctaggctggagtgcagtggcacaatctcagcttattgcagcttctgcttcttgggttcaagcaggtctcctgcctcagcctcccaagtagctgggattacaggtgtgagccaccagcccggctaatttttgtatttttagtagagatggggtttca

SEQ ID NO: 118800 - DNA, 1024 bp, Homo sapiens
aaagggagccgacttcagccccgattagaaccagaccagggctgcctctgcatggtgggggtcggggggcggcgggcaaagggaataggaagcgtcagctccccaagcccccacccacctagtgctgcaaggggccaggccaggaggaactggacacaggtcaaaagagggttgtctgacccttccccctcggtggaaggcaggtggctttccgggattagagaagattcttagaccttagccttctggattgtggagatccccagagctagccttgagcacaggaaattggtggttctcccggttttctggctcaaggagtgttgtgtgccttgagcactgcgcgactcaacagccactcgcagtgtttggcggtggtgggcctgctatcttccttccacgcccaggagagggttgttaccctcctgataggcactgagctgggggcatccattggggcttggggatggaagggtggacggactgatgggttctttcctcctgttggccaggctggggtccccagtgactccttgaatcaatataactggagtcagtaacttaagactggctgtttgccaaagcagatgtgacctgtgtggtgatgggggtgggggtggggaacggctggtgtcaaagagggaggccagtgccaggcatggcctgcctggtctgcagctgagtccccaagcagagggcaggccctggggtcactccagggggtctgcttgtctgacctgggcaagagctcttttccagagtgctgtgcctgggggcaggagggatgaaatgggcaaggagtagcagggaggcctgcggatgtgtggctcaagcctctggatgcctgctgctgttggttcttcttgaagtagggcccaggaggggctgctgtgtggtctttgtgttctccgtgggagctggagggagggagtgtggactctgcatcccacctccacctcctggccagagctagagccagcatcttgggaaagagctgggtggtctgccctggttaggtcaagag

SEQ ID NO: 118801 - DNA, 1369 bp, Homo sapiens
tttgatttgcccttcgccattgtttccaaagatcaaggaatgtcaataacattttaaaggaccaataaacagcctcctataaagtaaacctcttcccgtggaagcacactctactactaaagggaaggccctgggctctgatttgtcctttgcattgagaacggtgtggggatcagtgtgtgtgtatgtgatttgtttattgagttggctttgcttttttagtttttcttttaaaaataaaatccttccttcccatgttactaaattaatttatgtttttgagaggttgagtctcaaagtgtaaacaataaacctccattcataaggtggatgttgtaagcttgatggtggttgtgaaagtgatttagctttgaccacttttcatcctacagcttcaatatcaaactggttaggaaagcccagggggaagggagggggcaggggaggaggcaattctgaatgaatgaatggattttttgttgtttttgcatgtttaatatagaagttcccctcgttccttgggagatgatggcctttgaatatgcagacaacctttgaattgtgcctactaaattatagcaggggactttggcacccaaggagttctgactttctgggattataatagtaattcccagccatactctggactttattttgctaaccataactgagcaaatgtaaattactgctatattaatgttttaaagcactgggatagtctaattctaacttgtaattaattatgtttgccaattatctgtttgaaataaatttgtgtctgaacagctattgaaactgttaaattgtacagatattattcatgacagctttgtactgtggaatgtgcttaataaaaaacaaaaaagtttgacttttgtccagtaaattgctaagtaatgtcaataaatcgagtatgggtattatgcagtgcacctaatctggcttcatgcaattgttacttcagctactgattcaaagccaatactcttaataaagtgttgcaatactctgacgttctgttaagaaatttttcaaagaaactgttaagtgctgttaggaattcagtgacatacaattaaaatttatagatctttagaatcatctgttctgtaaaatgagtttgaaggcaaactggttttggcgtgtgagaatgttgtagtagatgatatgattccttgtcttgggcttttgccgaaagctagcttgaacttcaggagttagctgagggctagctaagaactcttgccctgcaaatctgcttcccacacataattaattgcttcacaagttactgtcaacatgaaaatggcctctgagacatcccaagtggctttcaggtgtgagtggatcctccccttcttgaaga

SEQ ID NO: 118802 - DNA, 1065 bp, Homo sapiens
tgattccggctctcctttgagaaggagaccttagcttccccggcttcaagtagaacagaagcccgtttccttccctcatcagtgaaaaaatctaatgtttcaaatgtaaattgttcatagaaaaggaacatagaatctgttttacagaagtaaatcgaccgtcaagagaagacttggcctctaatttatattgctttgcactttggtttgatattaagaaacagcattcttcttcagtgaaattttgggtgccaaacacctacccagaatgtccagggctttcattttcaaaagttagcattctccttttgaccgtccaagtcattatgaattctgacttgttgtattaggaacatgttggacagtggaaaattttctctggattgttttagtaatatttttgggattatacttcctttctgtaccaatttcttttaatttaaagaactataagtcagttatattatctaccaacaggtaatatagctctttcttttattaactgttctctgtcccccaaccatctcctgatatttggtagagtaacacctttatacgtgtgcttgcctcctaatttaaaatactgtattcgcatgtagatataatgtacataacagtttaacctcaaagttgctggagtcagggccccctgtgcttgagacactaatacagagtgtgttcgcacttagccatgggctgggctcaagaacctgatacctgggttgatgtggattacctagaacccttcctgcagtattcatacagtgtttttattttgttgttgtcattgcgtgtgtgtggtttgtgtgtgtttttaatgagaatcttgttttaaaatgtaatttctaaggtttaacaccaaaatgttttatttgttgtggagtatatattatacaatagagaggtaccttaaacattttttgttcttattctttttctcataagtactcctgagtacaagtggtcacctcccatagtattcatttggcttcgctgtcaaaaatcattattctgtgcagtcgtggccctgggaaggggaaataagaaggccctgttgacgggctg

SEQ ID NO: 118803 - DNA, 2070 bp, Homo sapiens
ttccagatgaccttatatatacttcccaaatgggttagttggtctgtttgtactcctattactaacttccagcatttgcttaatttggagaaaggtatccttggaatttcacacagagccctagcttctgtcagcagcacctactcagccctagagagtcccctgatgaatgaatttggtgacataggttatcaagtccggaactgaatttagataacctgaagttgttttcttatctcccttaaaataatatttctttaaaatttcagcaattctgagaatgtgtaggttcttaatttttccaaaatcaagtgtaattggttcagatgatttgtaaaaacataagcatgttccccattagcttttataaataggcagttcagatgcactactttttttcaaggaaatgtttgacagcatataaattgttcacttttccactaatcacatctcattttcctttctaggaaaattaaagtttgggacttgcaagctgctcttgaccctcgagccccagcaagcacattgtgtttgcgcacattggtggtatgtgatctcttgagacgggaattggttccctgtgctggaggatgaccatttgcagatagtcctgtctaggtgtatcacaggaacgcttgtgtgtctcacaagatgccttcagagaatttcagtcttcattttgtttagccaaaaccagagaatatttgatgtttacattactgtgagcactttcctaaggggagacataatgcagcttaagatatgaaggcaggcttcctgatttgtaggtggactggtttcctcatagggcaagcaatatttccttcttgtaggtttggaagatttcttaatatggctatttgtggttatgttttaataacagcacatttttatactatatataaatttttataccatttataagtactgttatatttttgaagagatagtcatttggaaatattggtagatttaaaaaagattttagtagttttatttctgtttcttcacttcttgcatttactagaagatgcagaactgtcttcttgattttaatgggaactcttatattattatttcaccatgaattttgatgctggcagcaatttgaggtagatcctggtcatgttaaaacaaactgtctttctggttctaggttttccagtggatttttagagtgtatcaagaatgggtattatgtattgttgtttacttttataaggccctttttgagatgatctttgaaatattggtagactagagtctaagatacaaagtttaatgaaagaaaaggcctagcaggaaaagaaagaagaacatttgttcttgggatgaaggacacagttcagtgagctctgtacagtcgtttaggaagtctgtttaagtggctgcattttcatcttctgcccagtttctcattgtgagatatcaggggctgtaaagatctcattttattcatgaagttttgtatttcataggaacattctggacgtgtgtttcggctccagtttgatgagtttcagatcatcagcagctcccatgatgacactattttgatttgggatttcttaaatgtgcctcccagtgcccagaatgagacccgttctccctccagaacatacacttacatctctagataacagtctgcactttcacccgtttcaggtgagtactatcctctccccttccaattttgctgattgaattcaccttccctttggggaaattttgtgatttgggttccttggtgatgtgtgaaccaaggtctctcttagacgtgtcaacttttgcagagttcaagtgtaaggctggatctttatagtcacatccatacaaggcttgagttggaatcctgcctattgtgtgggttttcatcttggcagatgatgaacatggttcctgtttttaaaaactgttcctaaatgatttcttaggtcataatcaatttaacaccagtaaaatgtcttgaattttattttggggtacaagaatcttctttttctctttctttcctgtccttcagttcttttattaaaaaaaaaaaaaaaatcaccatctgacaaaacattc

SEQ ID NO: 118804 - DNA, 1008 bp, Homo sapiens
ccctcctatgagaatggcaccaagccattcatgagtgatacaccaccatgacccaaaacatctcctgccaggccccacctccaacattgaggatcaatttcaacatgagatttggtagagtcagacaaactatatccaaaccattgcagacccagacagagctcagataccagaatcatttcctggctgtctccataattaagcatcatgcttttctcttctctcctagagtgtgggatgtgaacacgggtgaagttcttaacacattgatccaccacaatgaggctgtattgcacttacgcttcagcaatggactgatggtgacctgttccaaggaccgctccattgctgtgtgggacatggcttctgcgaccgacatcactttacgccgtgtcctggttggccaccgggctgccgtcaatgtagtagactttgacgacaagtacatcgtgtctgcctctggtgacaggaccatcaaagtaagtatgtctgcagtcataaccctacctgttcctgtcccttttagaacagagacaaagcagaggtggcttataccaacctggtacctggcaagatctttattctcctctgtgcttatgaacccttgaggccatcccactctgtatatctgtagagttgtaggcaaggtaggaggaaaagccatcggtccagaagagagaacagtcttctgtttcatgacatgaaattcttgatcacctttttaaggggaagagtgctaacgtgttgatcatgtattgtgtgttgggagctttacattatggtctcagttaacactcagcacttttaaggtaggtgtggccccattttacacatctggctcagagagtaaaggattgtgttggtgatcatcacagctagttagtggcagagcttagatgttttatttattcacctaattttgaggactcgcagtgcggtggactctgggccggatgctagggatatgatgatgaagaagacatgtccttgccttcaagaagcttagca

SEQ ID NO: 118805 - DNA, 1645 bp, Homo sapiens
cttttaaaatgcagaaacttatttgagaaaagtaggctttttataagtgttgagaagctaagccatttgctaacttctgttcaacttagaatgaaagtctggtatctagcagagcttttgagaggtcctgttccctagctcttacttgagggttggggatagagggtatagcccagcctttaatgttgttgtcgtcctctgtccagacatctcaggggactgatgtatcacaggctgagtatgtacctgaccctggctcctctgtgtagtcttctctgctgcgtcttcagggttttgggtacagttaaagattgtaaccacatcacccacttctaggaaacattttagagcagcggagagcatggagaaaattctttttggtatagagattcccccccatcccctcttttaaattaaaataattgtttccccctcagactctcatgcggtagtaaatgtgctttttctagtcattgaaatatagagcataacaaagctacttactgcttcagtgtcattttaaagcaattgtatacctcttaaacctaagaacagcttgataacacttgacatatatgtaaagacatattatgtattcatctctgtcatacttgtaatatgacatcatacattctgtagcaactctgtgggcccccagagggtataacgtgaacattggtaactactgccaagagtcactggccacaaattagacttgttaccagtacatctgcctactaaatcagcattttcctggagtgcttagcatgctgagatggcacagtcactatctaaaaatacattgtttctctaaatgattccatgcgttgagttctgcttaagaaatgcctgtattctggacctctttttaaaaagtcgcttatccggacagatctgttgtctactttgatagaggtagcagagatggttgggttagttttttttttttttttttttttttttggttttgaagtgtgcttttgtatgtctaatattttaccaagtcactagagatgatgacccaggctaggaagttctgatttggtggcagatggacaaatgagtatttcccctctcctggcatctccatggcacctccttgtatctcctgagcattggaaatataccatcctgccctcaggatgtgtatgggagctccttgagggaagataccgtatttccaggactcttgctgagcactggggccacaaatgatggaaataatcgctttttaagtatacgtgtatcgatatctccaaccctccatttccttttctataaaatgcgaacaatgattcctgcttcagagtcacgattaaattagctacaaaacatataaagtgagtggtatagtgttagaaaagcatagtgcctggcatgtagctttcagtaaattgtaacattttagagtgcacagaaggatactatcttcaaaataagaagaaatacagtttgttagatgtcagcagagccagtaattaagtactccttcaacaaagcaaataattagacttttagctgtacagaaataattagctactcagagagaaactatatcctgaactgaagtgtaacaggttatagaaatccctgttgtcccctaatttcaaggatcaagaattcagactttagttactcttagtag

SEQ ID NO: 118806 - DNA, 1064 bp, Homo sapiens
cagaccccaccacccttccaggcagatgtgaataatggaatcattccattaatggtaaatctgaatgtgactggaatatcattatttaaagcccaaactgtcttgaatattctgctctctgaaatgatctataaagtaaccctttaaggaggttaaataaaaactttcactagataaatcataaagtttaagaattaattgaccattggcagttccaaacttagaataagttgcccctacagtgctagtggctgagacatggtgttaactttaatcttaggttgatgtgtgtgtattgtaggggagatggggctgtctcttaccccaggtagttgtactaaggcatttcttatgtacacatcttataaactacattaccctctgtttttttttttcacttgatgaggggcaactatttacaaagttatttccagacttctttgaataattttatcaaaaaaattctttgaaaagaatgatgtttaaagttaattatgaacaaacaggaaccttgaagaactctgatcaggttgaagatgtggcaacatagatagtttgattgaatcctcatgactgctgttagaattgacaatgtgaattcagtattctgtggcatgacagtatctgacaccacctgccatcatcacttcttcaggctgaaatgatagtttaaagtaggagaggaggcaggtgtgaggggaaacagctctgtgggaaaaccctgtgcgacacagcctctacatcatggtggtctacccagtggttcttaaagtgtggtttggaaaaacccactggttggccacaaaagtcttctccagatttttgtgggctagacctcttgatataagggatgatgtttatactttgatatatgtgctactagtaataatcataaaagtaatgtaccactaatagcatttacttatgccagatactttgttaactactttataatgcattttctcttttaacattttggacaaaacctgaaaggtaggccaagtacttatttaaatttgaggaaaccttagaaggttaaaaaggttaaacagtttagtcaggat

SEQ ID NO: 118807 - DNA, 1792 bp, Homo sapiens
acatgcaggaaaggacagtggtcccagtgtagtctttattcttagaccatagcttgggtctttgatctagtccagagtaagagaattttagtatatgaaggacctggaaattataaccaatggtataataatagtcattcttagaattgaaggaactttagtttgtaaagcatttttcatgcatcatctcattttgatattttcagaatcaagtagagattatcgtaatcttatacagatgaggaaactgactctgaaagtttaataatttacctacatctggcctttcaacaaccaagtttagtgctattatactacttctaattattttgagaaaagagaacagatattaaccttgtagagtgcttgtctataaaatgttttcataaaactgttgaatttgattctgacagacagtgtaagaaaggatagttgttactggtgattaccattttgtatgttagggcacaaaaattcaaggcacagggatgtttcagtgtttgtttcatgtcatagaactagtaagtggtgaacctgggacttgaaatgggaattttctgatgataagttctgtgttctcgtccctacacagaataagcttggggagaagctttatttcttgcaactgtagaagacatacttaccgccacaggatgggagtttacaggtggcaacagtggtggccatgttgatcatcttcccattgtgaatgtcaggcagaggctgaaagtggttttctttgagagtatccttgtatcgtgggaggttgaagccaatgacctctaagattctaggatttgtagacatggggctattgcttttgaggattgtcccatctgtttaggaacagaaaatggatactcacgaaagggagatgaaaagattgacaaaaatacatttaagcacaatcgactttaattcttggattgccatttaacttttcataagtttttcaagatgagtcggtgttttgccttttttgtcttctgatctcccagggattcacaccgggtatggattaatggggatatgatttgttatgagagacagtgagtaagatgggaatgaacacaaactttgaagcaagaaatccgagttccagtagtaaagccaagggagtgtaaaatcttgagttctttacctttctgtgcttcatctgtcaaacttggggcgtcattgccctataggagtgctgtgagagttatataaaagaaaatgaaaagtcttatcttaatatttgacaaataacagaactgtccaaggtcagcttttacacacagagaagagttgctatcaattgttttatcgtaaaaaatcagaaccaaaaagaagtgtatatgtttatgtactcatggatttgagtatctgtagaacttttgatatgactaaaatattttacttggttcaggatttctttattcctcttatctttaaggaaatgatggctggtacctttctatctctcttcccgttccttcattcccttttctgttttgtagagcaaggcttagatcacatagcagaaaacattctttcgtacctggatgccaggtctctgtgtgcagcagagctggtatgtaaagaatggcagcgagtgatctcagaaggaatgctttggaagaagctgattgaacgaatggtacgcactgatcccctatggaaaggactttcagaaagaagagggtggtaagtacttgggttgcttgttcccttgaaaaaattttattgacatagagtcagcttgattactcaaaaatgcaattatacttgcaaatgtgctggcctattttta

SEQ ID NO: 118808 - DNA, 1276 bp, Homo sapiens
tgaataatttgtcaatcctagtgatggagaggcacaagcagaaccccacgtgattatccttggatttccctgattttaagtaaacatagaagatggaagaaaggcagccaggcgcagtggctcacgcctgtaatcccagcactttcaagaccaaggcaggaggattgcttgagcccaggagttggagaccaccccgggcaatatagtgagacctcatctctacaaatgataaaaaaaaattagctgggtgtggaggcatgtgcctgtagtcctagttacttgggaggttgaggtgggaggattgcttgaacccaggagtttgaggtggcagtgagccatgattgtgccactgtactccaacttgggtgatagagtgagtccctgtgaaacctttgagaatggtaccaagaagaccaaactccaaataatgttaaattgtccaaaatgttgaagtaaattgaaagagttgaaaacaaaataattaactatttggagccagattataaaggatgaagggatagtgtgcttagaatagatagtatagtgataatagaaagaaacaacatattttcactcccattaacctaatcccaccatccccccaacccaagaataatggctttaaaacaaaggttagcaaagttgtgtttgagaaagatgtgaagatatttagcaatcacatagctcctatagacaagtaggcctaaatacattgtatgcctggatagtggcaaaacctgtggttgtgatttttcaaattgtagaacattgtgaagcaattgaaaatcagtatgcagaactattgggtacaattgtgccctgtacagcttgtacagttgcacatggtagtcttgcatgatagcaccagagatgattgatgagcagacttcctggttttaagaactggagaaggtgtttttgggggatttagctattaaatttgatgttgtgctttagcagaattcttagatgagtttcaaaggctaatcagcctctgaaaagattgtgtatggttgtgtaaacctagaaggatgtatacagaatgtgaaaagtggttcccttctctgggaaatggggtttagggatttaaaaatttttgctcatctacactttataaattttctataatgaacatgaactagatatgtttaaaagggttaccaagcagctagtgtcaacatgtaagtgaaaaattgcaatacaactttatgtagtaaaccccagcacgggaacatgaaagcagccataccctcctcaccttatttcctttttggat

SEQ ID NO: 118809 - DNA, 1323 bp, Homo sapiens
aaggaaaattccttaaattggccccaagtactgaatgtaaggattacaactcagttcaataattctcacttttaattatgagggagggatccagggagggggagatggagacatgcttttgattgcgtgagagagaattacaggtgaatggaagtaagatgaggcatgtacatatgatgcagcttctctgtatgtgcagaactcaaacccagaaacctatagaatcagactgcatctcacaccaagaaaagacagagtctttttttaagttggtgattgtatttgtccctcataagtgattttaactgatgagaggatgccttcatttttctcaagcaattcaatttattgtttgttttccaccgttttggttttattttcttccctgtaatttgcttctcaaacgttttagagggccagggaactcaccttgtatttgcagagtagccacaaggtggcactgttgaagttctcttgatttttcagagtatagttcagaggcaaccccatctcttagggagtatacagccttggagaagaagcagaacagatgaacatgtgttatgtatataaatatggttagtataattgcatacaattcagttttcattacagcgaatgttaaggcattgtccatatctctgttaaagtggaattttgtggtattgaatattacatgaaatgaatggaccattggctgggacatggaaatactttagttaaaatgctatttgttttaacaggacttgatctgaacatatatacatatgtcagtgtatatcatacatatgaatctaatagctgaggacgagctggccaagttgattgtgttagttagtatctagtagacctagattaaacatggcattagttccttaacacagactctgctttaagagcatcacaggagaaacaggtctgtgtccatgttcatacttagatttaataatgtgtggagcaacttatgaatcattatactagtttggtgtttcatttttactgtacatcatcttgagtttgaggtttttacactattgaaattgacagtcaacttacgacttcatttgattgtgaaaaccattaattctgtaaaaattataattatagcttttaaatgcttgctgtgaatatcatacctgtcagtatagggaaaatggaaaatgtttgtggtctctggctccttttggctcagtggaaaaagtgataattatgatatgcctttctaaaaatcatagtaaatgtttagtctgcaatgtcaatttctgcaggctgagtttgcggtttgtaagaactgttgttaatgggaaaattcataccatgtaa

SEQ ID NO: 118810 - DNA, 3232 bp, Homo sapiens
gaaatgcattgttagtataagagtctgtgagttgtccataaaccacctacgtaagatgcagagcttttcaggtatacatggtttatttaccttgggtcactttctgagaaggtaatcaaaagaaggatgggaaagtctaaaccgttctgccagattagtagccctgggaaagtatggaggagattgaaactgttgggtaaaatgaagctttttggattgaattgctttcaggtttcaacacaacacagcttatctttgttatatagacctgtggttctcaacatgtggtccctaaagtgtagtctctggacgggtggcatcagcattgctgggaaacttgttagaaatagaaattcatgggctccactccagactaataaaaccgaaacctctagggtgggacccagcaatctgtgtgtttaacaatccctcctgttattctgatgctagctcaagtttgagaaccattagcataaatgtatgtagcattaactttgaactttgaggaagtaaaacaaactgttaataatcagttgccactttgccaagttgagcagtttctctaagatggttatctccagcattagctatctttggagatgataattcatatatatcccgtgtatagagatacccagtatatacctttggagcatcattttgtagtaagcattggaaaatgataatttaaggtgccttttagaaatagctacaattttggcatttcctgtagtgactaatttgaggacacagaccctgaatacatttttaattcctgaatgaattagtaaaggaatgagtttggctttagggtaaaagtggcattttaagattaaatacacagggtgaaaaatatttctaatgaaatattaattaggtttctttccttgttaaactaattttttttttgtttttctaaaatagataagtaatggaacatcatctgtgatcgtctccagaaagaggccatcagaaggaaactatcaaaaagaaaaagacttgtgtattaaatattttgaccagtggtctgaatcagatcaagtggaatttgtggaacatcttatttcacgaatgtgtcattatcagcatggacatattaactcttacctgaagcccatgttgcagcgggactttattaccgctttaccaggtaactgtacttgtcttttcaaaagctgagcagttgaagaatgcccggcccaaggacctaggtggatatttatgaaatgattgaatgagtactgtgtgaggcagcatttctttgggacgcatactttaatatatggaactcgaggaattataatttagtatctatctaggaaatataggcagtatctttaataatgttcattcctggccaggcgcagtagcttaacagctgtaatcccagcactttgggaggctaaggcaggtggatcacttgaggtcagaagtttgataccagcctggccaacatggtgaaaccctgtctttactaaaagtacaaaaattagccgggggtggtggcagatgtctgtaatcccagctactcaggagggtgaggtgggaggatagcttgaacccaggaggtggaggttgcagtgagccgagatcataccactgcactccagcctgggtaacaagagcgagactctgtctcaaaaaaaaaaaaaaaaaaaaagtgttcattattggtcataactgttgcttcatttggtctgttgaatgagttaatgatatgctttttattttgatgtagtttagagtctgcactttgcctttgtatgtaattttaaaaaaactggtactcttttcccttcaaacatagtttgtatgtttgggaagtgtcccaaaagtttagggcattcatttgtatctgaagtggcacttaaggaatggcaaaaatacattgggaaaactggtagcatgtctttattatatttctcaaaagctgtttctgcatcctctccctcactactgtcttcccatatatgtctcatacacacataggtgtgtacatgcacgcgcgcacgtgcacacacacacacacacacacatctggttaaatttactttgatttttaaaagtagactttatatttttagagcagtttgaggttcagatcaaaattgaagggaaaatgcagagaattcccatattcacataacccgttccctcagcctgccccactatcagcattgcacagcagagcagtacatttgttacaattcatgaacctaagctgacacatcattattaccccaaattcataggttacattagggtttactcttgctgttattcattttgtgggtttggtcaaatgtctaatgacatatatctgccttaagagtctcctacagaatggtttcactgtgctccacctatttatttccctttgatttttaaaaaataatttaaaatttgctgtgttctgtaccacctttttgtttttctcaacgaggtggcatcttgctgtgtgggccaggctggccttgagctcctgggctcaagtgatactcctacctcagcctcctgagtagctggtactacaggcatgcaccactgtgctgaactcccctttgaatatgattaatcatgaatttttttctgtttctatattgttttttaaaaaattctcaatttaaatttggctaggtaagatatagagatttcactcctatagagaatgctggccagaatgttttcctctgatgtggccagtgtagtgtgtggttaaaattgccatgtcaaaataagcctagaagtagccagggatgagccagtaccattaccacaaccctagcccttgtcagagctacaggatagcttcttaaagagtagctcctcccttagcctatctgtgatttatagaacatcaggactccgtgttctaagtacttccacagcaaacaagactcatgttctaagtacttccacagcaaacaagacccaggctcaggcctcaggcctgaaacctgaggctgcaaattgacaaaccagcttctgatttctaatctctcttccaaaacgtgtaagtttaccttctacaatgggagttttaaggatatttgagagttagcttagaaaaatttgacactgccgttctttttatgctgaaatctagcatgacttgctcatttcttccattagaatctctaggaaagcaaaacgtaaatcctctctttctagaatcatactatttaattgctgaaggggatcttagccatcacttagtcctgtttttcattgt

SEQ ID NO: 118811 - DNA, 1048 bp, Homo sapiens
ctgagtagctgggattacaggcgcccaccactatgcctggctaattctttttgtatttttagtagagacagggtttcaccatgttggccagagtggtctcgaactcctgaccttaagtgatccagccaacttggcctcccaaagtgctgggattacaggcatgagccaccatgcctggccaaaatcttactttatatgctagttttagtggcttacattatagctcttaatggtgatgagttagaatttgttttaaatagttgcctgtaattgggcagttatttctaacttttccttgttatattgtggtggacattcttatgcttaaagcaacttagatgccccttattcttgccaatattcatcacagcaaagacttttcatctctgttttgaactcttattttttggatctgttaagactcaaatgtcttagtaaaagcaaaatttcaaaatccttgttcaatgcttccccctggtggtacctggtgtcagtgagcttttcctcacccaagatacaagggaagaaacattcctcgacagtggggcgctaggataaattgagtggaagatagatgccttcccatctcatacctctaaatatggacataagaacttcagacaagattttgtgtgaaggaaaactgaagactcctttggatatttataaaggatgttttctctgggatggatttagtccactttaagttaggggacatactgatagtgaaagctcttggttcattccatgtaagactcctgagataagttcctaacggaattaataggtatttgtaattcagctcttcagttcttagaattatcttttgtgttattttttctggtattatgtatgaggaggctgtcagaatagtggtcaatagatagcttgacaaatgtttgacaaaagtattgaggttattttgtttttagacagggaggttactgcacttcatagtagttgtggtttgagtctagtgattgagattatttttaatgttactgtccagatgcagtgtatgtagtttcagttttaaaaaatatgtact

SEQ ID NO: 118812 - DNA, 1750 bp, Homo sapiens
tctaattgcggattccttggggtgcattactgaatagcagaccttctagtaaatgttttgtgcaatcatcggaaacctcatgggtctttggaatttcttgtcacaagtacaaaaacagtgatgacggaggttgagcctcagccttactcccacaatttagcctttttttctaagcacacccaacctttgtaaataatgactttatgcttgcttttgtctaaccactaactttatcgatttatgaaagatgagcacatctcccttgacccaaaatggcatgtgttagccacaaagccaaatagttcttgggtttgtattggtacactctagtttgggttttcaaaattatttattgtagttatttaggatttgcaaaacttggtataattcaaataacctgtttttccccccctagaacacttcagttatggaagatcaaaatgaagatgagtccccaaagaaaaatactctttggcaggtaggaatgacggcgcacagattagatagcaactgacttactgtagataggatgctccctcagttaatgtcctcagtggaatcaagagccaagcattttgttttcttttgtgcagttttgctagtttcagaatccaccctaatttatcttcattccatagggaattgtcattacaaatatgctaaataattttggagtttccacaaagattctgaagttggctgtagcctaaaatgttctgtctgtggcctctgcctaagccaaagatggacagtgatggcatcctttgtcaccagaatggcaccatgccacacaccagtgtatacatggatgaccttttctccttttgctctcaacctttactcttctctcccatttccattggtttgccttttccttttaagcttgtctccttctcccttggctctagtttaaggtttgccagttttcttcccaatttcccaggttgtgtgtgtgtgtgtgtgtgtgtgtgtgtgtgtgtgtgtgtgtgtgtgtgtgtgtgtatgtgtgtgtggttgggggtttggggagcaagcaaagtttcacgatttggtggtttatcaaccatgctggtacacatggctttccccttcatgaagacaggattaaaagcaaaacaaatctaaatctgaagataataatgtaaaaataaattctctgggttcatttgatttgaaactgaaaagatagattagttagcaggaacaaagtgcatccaacacatttaagaggaaatgaagcaaagaaaaacaatgctaggaagagcttgctgggctgagcacgtggctggaaatagcatattgaaaatgtgctatagaatagtgcacatgctgttattttcttcttaacactgtgtacagactgagttttgtaccctccacgtttattattttgcagtgggatgctcttcatttactatgatttttcaattggcagtggttcttcacactttagctttcagtttttctttcatttatctttcagtcaactagttaatagttatacaaacactctagggaggccagatgattaggaacttatctgtaaataaaataacacttttgtttatcaaatgaattaatggctgtgaaagtactttgtaaattataaagcagtacacaaatgcaagttgttatcattatatttaacctgttatgaaccattattttggcaagttatttggaatcaaatatagaaataaagggggaaggaaagcatacatagttttttttcttaagataaggcactttt

SEQ ID NO: 118813 - DNA, 1049 bp, Homo sapiens
ataagctaggcactattctgtctgttttatatgtgaggaaactgaactgagggagagagagcttgtgacctaaacaggggtatctaccttctatgtagtggagccacgattcaaacctagtctttctagttctattataccttactgcctcttaaagtagaaactattttcatagggatgatttttatattttaagttgtaaacagacttttctaaatcccaggtcaattacgcaataggaatgctatttatgttgttataccagtagcttgcatgatcagatatctcctcttcagagagaccttttctgaccacccaattgaaaatagcttcctgctttccactgttattttatgttgctttatttttttccttcatagtgcttagcactgtatgaaattatattccatgtttgtttgttttcctcctgtctgttgtcttttcccccaccagaatccaagttctatgagaaaacgggtcatgtcttctttttcactgcttggtaaacacatctgtttctaaaacagtcccagcaggtagtaggtgctcaataattatttactgaatgaagaataagcataataagctggaatgtgaaggaaaggctatttctaagcttggttaggattatctggtataatattatttgctgtcatagttaggactactttggacttctttctttgaattctgtgaatgtaagtattcctgtgagttgaaagattatcttgaaaaaaactgattttgatttgaaagtcttcaaatcagactgtattttgttttgctttaaaaagttctcttttgattgtaaaattaatactatttattatagaccattggggtaaaagtggaaagaaaaatgagaaaccacagtttatggagtaccattcttaatatttttggcatgttttcttttagttgttttttttttttttttttttgagatggagtctcgctgtcgcccaggctggagtgcagtggcgcgatctccgctcactgcaggctccgccctgccggggttcacgccattctcctgcctcagcctcccg

SEQ ID NO: 118814 - DNA, 1034 bp, Homo sapiens
ttcaagcgattctcctgcctcagcctccctagtagctgggattacaggcacgtgccaccatgcccagctaattttttgtatttttagtagagatggggtttcactctgttggccaggctggtcttgaactcctgaccccgtgatccgcccaccttggcctcccaaagtgctgggattataggtgtgagccaccatgcctggcctacatttttatttttaaaaataaagtttctatttttttaggcggggtctcattctgttgcccaagctagagtgcagtggtgtgaacatggctcactatagcgtcgacctcccaggcccaagtagtcctttcacctcagcctcccaagtagctgggaccacagacacacaccagccactcctggctaatttttaaattttttgtagagatggcgtctccctatgttccccaggctggtacatttttaataactgcaatttcattgtctgggtatacaataatttaatcagtctcttattaatggacattaaggtcattaaactttagtgtacattcatgcttcataccttagattatcttattcactgaaaaaattctgagtcaaaggaagtggaccttgtttttttttttttaataattgagatggggcctccctatgttgtccggactggggtcttgaactcctgagctcaagtggtctgcccgctttggccttgcaaaatcctgagattacaggcgtgggccaccacacccagccctggactttaagccttttaatctactagcaaaaacattattctagtttttaatatcatcagcaatgtatgattataatagaaataaatgcccaatgtagaaaactgggaaatataggaaaacacaaagagtaaattaaaaatcagtcttcactcttttgttttttcttcaagcaacaaatgacttatgatgttcttactatgtgttaggcatagggcctggtaatagaggagtgcacaaaacagacaaaaagccttgttgtctcagaacctacattttagtggtgaaagaaaat

SEQ ID NO: 118815 - DNA, 1044 bp, Homo sapiens
atatggtttgtttagttattaatattatttgaaaataagaaaagaaaaacctgccaaattctgtagaaaaaaaaagttgccattctttttgccaaaatgagccctcctgaatcttacagctagtgaggttcctgagtggactttctgcaaacttaattccataaatatttactgagcaattggtatgtgccagggcctctattggttatctctcaaccaagctgaactgagtcagtgtttcatttgcctcagatgtcctgattcaaccagttgattgttatagcaaataatcaggaattcagaccatgtggattattgatttgcccagattcctgtggcatgagaatcataccaatgttaataatagtatgtatcatttattttccacgttctttctatgtgttggactctaggaattggattatctcatttgatcttttatggaaaagttatctaccttgccatttttgtatatgaaattatagaggtgaattgacctgcctaaggttacacatttatttaagtggcagaactgggttaggaacataatctggatgactgcaaagccagtgctctagtcaccagtctgtagtgacaactgccattttaacttgcaactgccatttttaggttgaaacaaattccccttaatttttggagttaaaaatttaaagccaacacagcagcatgatgtaatagactggcaagttgtcttgggaatgtcatttgcagcctcagctgggggagagtgttagtgataagccttttgctggggtaggactgattgcttggaatgacagtgaggatcacgtgaattgagtttgagtgcctccttccaagctctagtgcatatagtgctgggcagtaagtagcacaacttcttgacagctgcctttcttgtttctttttttacttttaataggtgtagtgagccacagtggtctgagaatgccacagaacttatcatagcttttgatataagagaatattttttagaggagggagatagcttggtagaaagaaccctggctttggtgcagacaa

SEQ ID NO: 118816 - DNA, 1050 bp, Homo sapiens
cgacaatctcaccactaatcttgttttgcactcaaactttcacagttccctttggtgggtttttgtttaaacattctctctgtccctcttgattctattcactgtaccctgagaaattagtggttggcagcagaaacctcctttccatagaacatcaagtgggccctcccccaaggtttcagtgagctgtctgggaccatccctaacctccaaactgccaagggtgcaccccctgccccaactaacattcaagttgcctgtgtgaaggagtgatttgttgcggcctctaactgcttcttctcttccttcctttttgtcatcctgcagtgttctgtgccaaggtctttgtggctaggctgcgccaacctggtagagagcatgtgcgcactgagttgcctgcagagcatgcccagtgtcagatgtctccaggtgcctctcttctttcttgttgtaaatgtgtttttacgtatgccatgaacatttgttgaaacttgcagtagtgtgtttaatccaatgttaagtctgctaaatgttctgtgtaaccctctgctttcctccagcctgggtgccccacatggaggagttagtaccaagaggggcccttttgagcaaacgggtctttggctgggccctgtcctccccttttctgctcctgctttttactcttttcccctcaccttgaggttgtaattctcatgtttaatagttgcgcatgtgccaaaaaaaactcctgacattttccatttggctacctttaacagttctttgttgagttgggagggtttcataattaaagtggtgatttttttctattttgaaactcatccttttggcttgctttctctcccctcttcaaaaaaggagcggggagggaatcactactggcataaagcctcaaactgaagtttataaagatcatagctttatgctgccaataatttgtcagtttgggccacctcccaaaggccagatctgacacctgtcctcagggtccacccagttttccaggccgaggccggcagagaattccacagataaaagtaaaacttt

SEQ ID NO: 118817 - DNA, 1091 bp, Homo sapiens
ttggtattattaaggtattaatatgagtactaggtggtcattggagaaaaatcggaaaatatggatgaataaaaatttgaaaagaacattacccttcatctctctaccagagagattacagtgaagatccattttagttttaatgcttttgggtactgatatctttttttttttttttttatttttaaagacaagagtctcactctgttgcccaggctggagtacaatggcatgatctcagctccctgtaacctctgcctcctgggttcaagcaattctcgtgcctcagcctcctgagtagctgggatcataggtgcgtgccacctgcctggctaattttttgtaatttttagtagagacaggctttcactatgttggccaggctggtctcaaactcctgacatcaagtaatctcctgccttggcctcccacagtgctgggattataggcatgagccatcttgcctggatgggttctaatatcttaccttagaataattcaagatgaaaattgtttggacattaattaaaaaaattatagtggtgtttaagcaaagtttggcctctgactttgagtcctgattccactacttttgggctgttcttgaatctaaaaacttggcagatagtaaattttggttttcctcattcttctcatccttattttttttctccccttcctgcctacttctctgcatccccttttcttcccttaacatatatcccagcctgaatataccctgtgatataatattatgacaagaacataattctagaatacagttgctaagaattaaaatgtaaactttttggttacatgtcacatgtttactatcaaattctgttataataaaatgccattataaggaaaagaaagtattttgcacattagggtaatgggccaatattcagttctataaaaggttatagaaaatgccttaaaccgtgaattaacttttatttaacaacctgattgctacattgtgattcttggttttaaaaacaatgcatttatggtggtgagagtgctctttcttataggttgccatcagacattaatagtggaagcctaggttctgaattttagaagac

SEQ ID NO: 118818 - DNA, 1651 bp, Homo sapiens
atggaggagagtgtctttgttacctcaaagtgcaaccaaattctttttttttttttttgagacagagtctggctctttcgcccaggctggagtgcaatggctgatctccgctcactgcaagctccgcctcccgggttcgcaccattctcctgcctcagcctcccgtgtagctgggactgcaggtgcctgccactgtgcccggctaattttttgtatttttagtagagacgaggggtttcaccgtgttagccgggatggtctcgatctcctgacctcgtgatccgcccacctcggcctcccaaagtgctgggattacaggcgtgagccactgcgcccggcaaccaaattcttatagctgtcctaaccctacctgctctccaccttcattaggagaatggtctactacagtcagggggcaagttgctatgataagatccctaagtaactgtggaaatgccaatattctgtttagaggtggctcagaggagagggaatggagaagtttgagctgtcaattgtatggcctcatctgaaaaaatatggcagcccaaaagaataaaataaaaatcacctgtgtttaattccagatttatatgtgtgtgtgtgtgtgtgtgtgtgtgtgtgtgtgtgtatatatatatatatatatatatatatatgcatttttttttttttgagacagagtctcgctcttgttgcccaggctagagtgcagtggcgtgatcttggctcacagcaacctccgcctcccgggttcaagcgattctcctgcctcaacctcctgagtagctgggacttcaggcgtaccccactacacccagctaattttgtatttttagtagagacggggtttttccatgttggtcaggctagtctggaactcccaacctcaggtgatccgcctgcctcggcctcccaaagtgctgggattacaggcatgagccaccatgcccggcctatgtatatattatatttattaaatgaacatgggatcataatgtaagtcctggtttgttgcctttattcacttagtgtttcttgaattctttccgtgtattgtaactttctttctatgcattaaacttcctttagtgtctgtaaatatattcgtatagcatgatttctatttagcagaaacacaatagtttgtcttatgggtaatccctaatctgtggaacctgtccctttggttagcattttccctttgctattatgaacagtgatgtgaatgacatcttcttggctatatttttggacatttctttattttgtctccttgataaaatttcttacatgtgaaattgctgagtcaaatgatgtgcatgagtttcaagtcttgactatgtattgcagagttgcataccagagattgtatcaatcagcaatatagatgagtgacaggtagataaaatttgaaaataaatcagggaaacttgctgctctacggagtttaatgtcaggtaaaggaagtgacgggcaattatagataagggaagaaagcagggattttagagtcagatagaatgcagttttgccattcttgacctctggcaagtgatttgatgtctgtggtccttagtttttcttgtctgtaaaactcagctgcttgtttggccagaggtggtatgagagttaatgagtacggtatagc

SEQ ID NO: 118819 - DNA, 1051 bp, Homo sapiens
tttgggtggggacatgaagccaaaacatagcagaattcaaaagattttttaacagggccaacttttattctgcaggtactttttcagagctctcaatgagacaagtagcatgttagatggactttcaaagtctttggaagtgttaagtctacaaaagatgttaaaaataccactaattaagccaggcgtggttgctcattcctgtaataccagcactttgggaggctgaggtgggcagatcactggaggccaggagtttgagaccagcctggccaacacagtgaaaccccgtctctactgaaaatagaaaaaattagctgggtgtggtggtgcacacctgtaatcccagctctactcgggaggctgaggcatgagaatcacttgaacctgggaggcagaggttgcagtgagccgaaatcatgccagtgtactccagcctgggtgacagagcgcaattttgtctgaaaaacaaaaacaaaaaaagctgctagttaagttttaatactcttgaaggcagtggaactgcatttatttaaaatgtttcatactttaggaatttagccatctttttccgtttagcaaaccaggaaataatttaagcaatatggctttatttgcagaaataatttttaataccagaatatatagttttgagaatttttgtctatcaaagcatttagtatacttgatgtttagtaaacttttttaaatgactaagcagtttaaaatgaaaaagataaaatagaaatatgatgtagtctgactataattgggtcaaacctttattgagagaagatacatttctcaggtcatcttccagaaagtggtatctcttcttagaaaaaaatgagaatgttcattacatcaggagaaaaagttttcccttccatacattcttttttttggggggtgatgggggacagagtctcgctatgttgcccaggctagagcgcggtggcgtgatctcagcttactgcaacctctgcctcctgggttcacatgattcttctggctcagactcctgagcacctggggttacaggcatgtgcca

SEQ ID NO: 118820 - DNA, 1037 bp, Homo sapiens
ttataagacttttgtaaccttagatgataaatatattcctttgtgagaagttccagagtgttgttttctgtccatattcatgtgtacacatgcaaaaagcatctgtaaacctatagattgactttattgttgcaggtgttaagccataactatctgctgttaagactgggtgctttcaagtggtgtgtactgacagcacagtgtgagagatttagaggaactagactagaaaaatattttaagaacatggacaaaatggtctataaagtctgtaaggtccctttcagctccagcatttagcgaaattccttgcttcaagtcgtgagaactccccttttccagttgcctgcaggattcaaacaatgtgaagggaatcaaagacatccttgctgtgcagcaagcagcaggagtcccttactctaaggctgtcctagcccctgcctgaaagacaaattaatttcttagagcccagtggactgtaaggcacacattttatttttatttgaaaccaaggtcagcttaggatataagaacaatgaactatatgaagaagagcaagtgtaaactttactgtaaaattaagggatgataaaatgtgccactttattatctttgacaactcgcttttcatgctgttcttagctaaagaagcaaaatttttattaccattgttttccaaatctctgtgtgggcgtatgtatataaaattaaaacactactaacttggaacatgtatttatttggtgtaggggcctgttaagtctttgaaaataaatgttgtatgtattcaagaaatgagtagtgtttataaaatagtagagggcttgtttaaatgatgtaaggtttgaatttgtattagtttgttctcatactgcataaagagctacccgagactgggtggtttataaatattaagaaaagaggtttaattggctcacagttctgcatggctgggaggcctcaggaaacttagaagcatggtggaaggggaagcaggcatgtcttacatggtggcaggtgagagaggaggaactgtc

SEQ ID NO: 118821 - DNA, 1051 bp, Homo sapiens
gaatacagaacagaatcaaatgcataccttgcttccagaagcttgtagtcttttacataaaaaagtataccatagtgtgaaaacttgtaaggatcacgggaagtagacaaacagtgttgtaggagttagaaaaggaaggaaatttcataagggatattttaaaaacttacccttggccgggcgcggtagctcacgcccgtaatcccagcactgtgggaggctgaggtgggcggattacctgaggtcaggagtttgagaccagactgaccaacatggcgaaaccccgtctcactaaaaatacaaaaaaagtagctgggcatggtagtgggtgcctgtaatcccagctgctcgggaggctgaggcaaagagaatcgcttgaacccgggaggtggaggttgcagtgagctgagattgtgccactgcactccagcctgggcagtagagtggcactccgcctcaaaaaaacaaacaaacaaaaaaaacccaaaaaaacttaccctttgaggctcgagcagaagttagacgtaaacatggatgtattgggatagtggagcttcatagcaaagggaaccaagtgaacaacggtttgcagacagtggtgtttgttgtctatctgggagacaagtaagtaattctgtgtattgccggagtattgcttgtgtggaagggagtatgggtgatgaatttgaaaaggcaggttataactaaatcttgaactttatcccgttaggtcattggtctccaacctttttggcaccagggaccagtttcctagaagacagtttttccacagaccaggcacggggagtggggatggaactgttccaccttagacatcaggcattagctggattctcttaaagagcatgcaacgtagatccctcacatgcgcagttcacagtagggttcctgcttctgtgagaatctaatgcctgggctgatcatctgacaggaggcagagctcaggtggtaatgcgagtgttaggggacagctgtaaatacagataaagctttgcctcctgctcatctcctgctgtgaggcccagttctt

SEQ ID NO: 118822 - DNA, 1834 bp, Homo sapiens
gtcactttaattgccttacctacaatatgaacaatcagaacatctttaagagtcattgcctgtggactgtcaacaaatcttagaatttaaaaattacttgggttcagctggatttgagattctttgtcacagttacaatctttgctgctaaacacaaagactacttgagtaccattatagtatgtcttgccacagtcttttttttttttttttttttgagacggagtcttgctctgttaaccaggctggagtacagtggcacgatctcagctcactgcagcctctgtctcccgggttcaagtgattctccttcctcagcctcccgagtagctgggattgtaggcatgtgccaccaggcccggttaatttttgtacttttagtagagatggggtttcaccatgttggtcaggctggcctcacactcctgacctcaagtgatctgcccgcctcggcctcccaaaatgttgggactacaggtgtgagccatcgagcccagcctataatgtgttttgttttagcattaatattgtgggctttaggctgggcatgggggctcacacctgtaatcccagccctttgggaggccaaggtaggcagatcgcttgagcttaggagttcgaggccagcctgggcaacatggtgaaaccctgtctctacttaaaaaaaaaaaaaaaaagacaagaaaaaaatatcatgggctgtagaattgcatggctctttgttaattaaatgcttttttaagtggcaagatctagggaattaccctttcaggatggcccaactgattcatgtaggctgaaatatttactcttctgtattttcattgttctccattttgatgttaattaatttaggacctttgagagtaaagcttgatttcttctcctctctcagaaatcatgggctttctgacccttgaactgtggagtccatagtgctccatgaaaagggcatgggctctactacctagtagatgtgggactttggataggttacttctttctgctcatctttttttgagaattaaatatgggtaattaatgtaaagggcttggccagttagtagcttttcaataaggtaggtattactataattactgcaggagcattttggctataatgtagcaattgtggaagtagcaaatttatgttcgagtaagttcagtctttttgtttttatctttgttgttctgctgaatgctttttctctttcccttttagtttgtttagaatttgcagtctaatttgatatggtagaaaaagaatattgatataatatggacaggacttaatatttaatggtgtcacctagtaaattgtatattagcgttctttatgatttttcccagtttacgtgatcattggccattgtacgggactggcctttactgagtcagaagttcagtcttcagttatatgttttgaagcacactatattttagctaagggtagaggatttgggtaatatgtagatatgatgtcttatatgtagcaaaccaaaacattttgttaggtacgtaaataaatatctttatggtagatatttgagccctctcgtatcattctttttggctgacaaactatttttctaatggtggaggagctgtcttagaaaatggataaggaagttcagtgtagctgaatggtctaggacaatttatatggatgatagggtaggtattttttagctgctctcatttggaagttgcatgctgtttatcatgagtaaatattaacattagggatgttccattatttgttacgagttttgtatcctttcaacacagaggtgaggaatgctgctgcaggcattttatgccaaatagctgactc

SEQ ID NO: 118823 - DNA, 1008 bp, Homo sapiens
tctacaaaaaataaaaaaattagccaggcatagtggttcactcctatagtccctgctactcaggagcctgaggtggggaggattgcttgagcccaggagtttgaggttgcagtgacctgtgattgtgccactgcactccagcctgggtaacagagcaagacactctcaaaaaaaaaaaaaaaaaaaaagaaaagaaaaaagaaagaaacgaataaatgaagttactggaaatgttgtctttttttctttttggatcttttttttttcttcctgtcattgactttctcggggtgagtggggttgtttagtgacttcatcaagaaattggatattactttgtcaccacctttctcctcatgtagcacaccactaggggtgctaacttactgaatgcagactcagtggacacaggtttcaatagggtccaaatgaataaaccacacacacacacacacacacacacacacacatttatataaaatatatggacctcactgacctgcctaaagaggcattggctcaaatatatcaatttttgcccctgattttgcagtaggttagatatcctttcagatttgacatggataaacatgttcctgcacacaagtcttggcattctgggctcttgactgctatagtctgtctcctgcaaatagggagctagcccaggagaatcactcagccattacatagattcacaacagcacatatatgcctcttactagtgttgtttgagcctgtgaattctagaaacaaaattatctgccctgtaagatctgtgggatcctgggttctaccttgtgatatttgttcttcatagaaaacaaagcattttaagtcctagtgattccaattccagtcttcctttgtattccattctcccttatggcttttctgcctactttccttgcttactgtatattctagcacatggaggaccatggtcctccagattctgctcacacgtttcctttgtcagcactgataggaatggacctaagcccattt

SEQ ID NO: 118824 - DNA, 1238 bp, Homo sapiens
ccgcctgggcctccgcgtcctaggagaggtctcagcacccactccccagcctaggtctgtgtggatgccaggataggccctacagagctgggggggcagggagctttcgggtttgaggctgtggcggataaggaggcctctttcccgggcccttgtggtgtccggcttctcggacaaagggtttcctacccggcggagagggatgtttgcatagcaagggcccaggtactctggattccatcctccaggaaagagaaggcgcaacttcacgttttccagagctgctttgggaaattggagatgactggggagggagccatcctcatcactgccgcgaggtctttcttctcagaaagaaaaaaaaaagaggggaatccttggcccccgggggaagcgaccactcttctgttagaaaccactggcagccaggccagactcccggtccgtggacaccctccaccctcctccgaagctttaggatttgaaaccagaaggggtttttaggaacaggacagtgagagagtggctagaagtgaagaatttgctaattgatggatgatttggtggaagaaataaaatatggcagatattacctgccaacgtgaacatgagggaaatcaaattgggctctggagagctgggaagaggaagtctgcatcagcaaatggacatgtccaggatttcttcctatggaagccttgacagtttctttgtatctttcctaacacggtaacaacttcttccccagggttgagaggagaggtggaagaatctacttaacccagcaaaatgttttcctagccagattttcttcagtgtgaaaatgtttattgagtcagtgattccactgggtagggttggtgacatcagagccacttcccccatttaacgctataaataataaatggtgacactgaaagtctgttggatagctgcatggtttctgtggatgatggtgtctggggagttgagatgcttgttttaaaaatggaagtacagtagcataaatatggaggcagcttaatgtttgctgtcctttgcataattcacagaactggacttctctagcattcttgaaaactaggagggaaaaaaagaaactgatagtttttgatttttgcatgcgtgtgtgtgtgtgtgtgtgtgtgtgcacgtggggttgttttcaaagggatgtcacatactgagtgatttttccttttcagcataatttatcatacttgtagtcaagtgtttgg

SEQ ID NO: 118825 - DNA, 1408 bp, Homo sapiens
aacctgtatatattttgtatgtgatatatatgcccatgtaatgtgatatatggatgtatatacacatatgcacgttaaataacaagatctagtaataggtctaatagctactgtaatttcaaagtgataaaaatattttgagatctctaccacagctgcaatgtgatatgaaatatctgggatttctactggtgacagtcacagctactgctaatactactacagtttgtagtaaaactaaagaccaaatcttttgccatccagataccaagacaccctgaattctacatatggatccattgtgggaagagtctatggacccaaagttaagaaagcctgaatcgtgtttcagaggcatggcagacagattcttttaaatacggcagggatggctagtggctaggcatctgtacgacccttgattagttcaagtggcagttgagtgagacacgggaggtatgccagaaacacctctggcagaaggtccaggtttgaaccttataggcgtcacttacagtgttttgagaactggcttgacccttccctttgcctagtgcccatttcctcatctagaaaatgagaatgagcctggtgtggtggggggtggctcacacctgtaattccagctgtttgggaggctgagacaggaggattgcttgaagccgggagtttgagaccagcctgggcaacatagtgatcccccctgccctgtcgcctgtctccacaaaaaaaagccaggcaccgtggctcatgcctataatcctagctactcaggaggataaagtgggaggatcatctgagcccaagagtttgaggttacggtgaaccatgatcatgccactgcactccagcctgggtgatagggagaccctgtctctaaaaaaataataaatacataaaatgggaatgatggtgtcttcctccgattgttgaaaggattcagtacattaacaggtgaaaactttttggggtcaatgaatgtttgttgttaaatgagaatgatattaaatgtctgtagagaacatgccccatgacatgctctctctcagccaagcataatgtctttccaaagagaaacccgaagtctgagctgccgtatgacctgggaggcacctgcgtacttggaagataagccctttcttgccgggtgagtatggttaagtgtgccctgctttccaccccaatccaaaagaacaacctgaacggcaaataaccttgttattttattagaagcatatttacattcttgtagttaactttccagagaacattttacaaaaattttgtataaagtctggaaactacataaaaataatttctatctttcataaagggaaaataaaagttagttacatttactctaaaaccagacagaggaaaaaaacccagttctgtctgtcccttatac

SEQ ID NO: 118826 - DNA, 1040 bp, Homo sapiens
cccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgccgttcaggttgttcttttggattggggtggaaagcagggcacacttaaccatactcacccggcaagaaagggcttatcttccaagtacgcaggtgcctcccaggtcatacggcagctcagacttcgggtttctctttggaaagacattatgcttggctgagagagagcatgtcatggggcatgttctctacagacatttaatatcattctcatttaacaacaaacattcattgaccccaaaaagttttcacctgttaatgtactgaatcctttcaacaatcggaggaagacaccatcattcccattttatgtatttattatttttttagagacagggtctccctatcacccaggctggagtgcagtggcatgatcatggttcaccgtaacctcaaactcttgggctcagatgatcctcccactttatcctcctgagtagctaggattataggcatgagccacggtgcctggcttttttttg

SEQ ID NO: 118827 - DNA, 1069 bp, Homo sapiens
cagctggagcaaatgcataaacgttttgaacaggaaatcaacgtgagtgcgagaaaagatgggaccctgcagggcttcttgcctccaggtgttctctcagtggaagctacatagtgggaatgattgggtagtggagagtaattcacaacaattgcccaattcctgggggcttcccgatcttgttaggcagtgacttgttaacacagaaccccgtgaaggtcacagcgatcctgagtcccacaggaggatctccagaggggaaataacctgtattgagcaccgtgcaacaacacatggtctggtctcccttttgcagatgaggaaatggagactcaggctaagtaacttgccccaggtcacacagcaacggggtagtagagctgggattcaagcttaggtctgatcacaagctctgagttctccccattccacttcccatgtccctcccaggtataaagtgacttcgctaagtttctcagaatttctgctcctttcaggccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgagtatgtgctcagtgggggcaggggcatctcggagtattaggggccttcttggttgcaagtgatcgtggcctcaacctcaccttggcagcagaggggtacggctgaagagctcgggagcaggtgagcctggatctgtgtgcccaagctgcgccatgaggagccacttctccatcttctgaactctgctttcctctgtgttgctatggctcagggcaggcctcaccctgtggcctcaggcagcttcctttacatcctcccagcttagcaacccctgccgagaaagagcggggaagaaggaagggctggtggtccgggggaatttgagatgctgttcccagaagggcgagtgggtgctgggtgggtaggcacatacaacatgccctctatg

SEQ ID NO: 118828 - DNA, 1067 bp, Homo sapiens
gcgattctcctgcttcagcctcccgagtagttgggactacaggcggtcaccaccacgcctggctaattttttgtatttttagtagagacgaggtttcaccattttggccaggctggtctcaaactcctgacctcaagcaatccacccatctcagcttcccaaagtgctaggattacaggcgtgcgccaccacacccggcccaccccttagtattgcttccttccagaaggctccttggtggggttaggtgccctctcccacaccccatcataagcatgctgtctcgtcactttcagtagagggctgtgtctctctagctagactttgagctggccagggagagggttgctctgtgtctgtattgtgggcaccctgtgcagggctggcccagtagtgctctgttaaatgtctgttggcatctggtcttagagacttctaagtggtggagattgtagggagaccttgtacagtggtggaaagtgcagaaaattttgacgttagaggatcctgatgcaaattctggtgccactcccctagttccaatcacatttcccctctaaacctggacttgcacgtccgtctgtggaatgggggaaactccaagcctcgggtccctgtgatgacaggaatgaatgctcattgtcatccatagggtgctagatgtgcaggaataacttggccagccggaatttccggtgcagtcaggttccagagttgttatggaaggcaagggtggagcgtgatcaatattatccttaggaaggtgccacggtggagactaagctataatatgttcattcagtccagaggagctcgttttccctgtgctttgcaatagattgctgtttaaggtctccagatgagcagcgtgcttttaggggccttttttttttttgagatggcatctcactctgtcacccaggctggagtgcagtggtgcgatctcggctcactgcaacctccacctcccaggttcaagcagttctcccacatcagcctcttgagtagctgagattacaggcatgtgccaccacacttggctagtttttgtactttttagtagagac

SEQ ID NO: 118829 - DNA, 1016 bp, Homo sapiens
tcagataatttgatcctgggctgggcgcggtggctcacacctgtaatcccagcactttgggaggccgaggtgggtggatcacctgaggtcaggagttcgagaccagcctggccaacatggtgaaacttcatctgtactaaaaatacaaaattagctgggtgtggtggctcatgcctgtagtcccagctacttgggaggctgaggcaggaaaatcacctgaaacctgggaggcagaggttgcagtgagctgagaaagcgccattgcactccagcctgggcaacagagcaagactctgtctcaacaaaacaaaacaaaacaaaaacaggtaagttggtcccttctgtctctgggctaatgatgctgtccaagggagtgttacgcaggctatacaggcaatggcaggtttcctagtcacctcattcaaaccagaggaaaaatagggaaatgaattttaatggtatatttatcacttcagcatgtaataaatgcagaattaaagcaatgtgttgtattctttttcatgcgaagtctttgaaattggtgggtgttgcacttatggcacatctccatctgcaccagccacatgtcaggtgctcgatagtgacatgtggctagtgactgccatgttgggcacgacagatctggcctctactgttgcctcctcaaacccagtggtcactggatttgggaagtgggcatgggccagggccaggccagatctgcaatagcatttgggggcgtggctcattcgggctgccgtgacaaaataccataggctggatggcttgcaaacaataaacattttatttcacatagtttggaggctgggaagtccaagatcaaggctcccacagagttggtgtctaacgagggcctgctctgcttcatagatggtgccttctcgctgtgacctcacatagtgggagggacagaaggacagctagccttctagggtcttttctttttttttttaaagactgcactccttcatccaggctggagtgcagtggcatga

SEQ ID NO: 118830 - DNA, 1024 bp, Homo sapiens
gagccctcccaggccgtcttgcccgtccctgagccagagtcttctcctttcacctcctctcctgcctactagtttgaaagcttgggtttccacttcctctggggatggggaaggtctcagtcctcccctcctcctccggaaagagatctggccccaggcagtaaccttgtttccgctcagccaagtatttttaaacccaagtccatgctattgtgagtgggtttctaactcgtgactcagccctcatccaagggggtctgaacttcccgtggatgacgcccttcggcttctgcgtggggccctgcccacagccctgcgggtctgatttcacactggccgttctgggaattttttttggctgatgcgaaagcaagctgcggtggaagggatcgaaacaaacagatggacccgccctccacctaggactctcctgtggcctggcctgccaaggttacctagattagggggactctccagaggttgtcaccccatagcccccagaacagccctgggtggtcactctcaggccccctgctgctgagggtagtggaacagggtggtggtgaagggaagagatttggggctcagtaggatctgggtcctagtcctggccctatttgaaccccaaataggtgaccacctcctcctctgaacctgaatcttgtgtctgcaaagtggagttggccacagggctgagaggagttgaggaggtgatgtgtttagcatctgattctcacccaggaagggctcaggaaatgacgatgaggtgttatgattgctgctcttggtgtcagatggagaagctcctgacctgtcactatgactttagggacaaggcaggaatacctcggtgttgatagcatagccctcataccagcgcttcctcacctggcactactggcattttgggtggggtcgttctttgttatggagctgttacgtacattatagggtgttccacaggatccctggcttcagcccactggatgccagaacacctccttgcagttgtggcaaccaaaag

SEQ ID NO: 118831 - DNA, 1051 bp, Homo sapiens
agcctgggccacagattgagactcagtctcaaaaaaaaaaaaaaaaaaaaaaggaaactgggtaagtacatactggaaatgtatatacggtaagaaaagacctcagaaggttctctgaggaaaaggatcattgaaggagtgaggcatttgagctaactggtgattctctgaaaatcaccagctagagcaagtgaggaaaggaatgccaagaagggatgcgatgggccacatctgtcctttacgagggtgggcagagtaggagggcggccaagaggctggggctgcctcagggagaagctgttgaaaaacctgaaccattcgggaaccaaaactcattttccccaccacccatcttttcttcctctttttagtgaaaggaggaaaacttctgatgcattcctaattcagtgctcccattagcaagaggatggcagcagccgcgcggctacttgcctggtgggccagcagcatgcacaccagcatgtagaacttctcaaagtcgatctcgcccacagcgttccagtccagcatgtcaaacacaatgttgatctgtgcctttttcaagtcagtcacatgatgaaggaagtgatagaacagcacatctgttaaggtgggcaggtgaggagatgtgttatttggatatagttccaaaatgctaaacagctagaagccatgtaaatggtagtgatgttggaagcttattgatctaggaagaatgatgataatattttgtttctggctttgccactgtactttctatagttcctgaaaccttcgtcgcccttgagcttgtggaaaagcactggacctggagttgtggagaatgagatcgtggacagggcttggctcctgcccccagctcacacactccatggagcagacagatatgtacacagcactgataaaaggcaaggcgctaacatataaaatgggcacaaagtgctccttatgtatgaaaggagagcttaattctcactggggactgagaacactttcttggagatgctgacatttttcctttgcctttcccttgagataattaaaatgagga

SEQ ID NO: 118832 - DNA, 1122 bp, Homo sapiens
acttacagagtgctacgatgaactggggaacagatatcagcttccagtgtattgcttggcaccgccaatcaacatgatagaggaaaagagcgacatagagactctggatattcctgagccaccacccaattctggatatgaatgtcagcttcgtttgcgcctttccacaggcaaagacctcaagcttgtggttcgcagcacagacacagtattccacatgaagagacggttgcatgcagcagagggagtggaaccaggtagtcagcggtggtttttttctggcagacctctcactgacaaaatgaagttcgaagagctgaagatcccaaaggactatgttgtacaggttatagtgagccaacctgtgcagaacccaacaccagtggagaactgaactgagccctgttggccagctcccacatccctctgctcctttttatggttcttgttgtcatttcctactctgcggcgtgaaatctatttcactgctctaaattccctatgaatggatttagttctgaggaattaccagtgaaaaattccatctgtgatggagaccaacaaaaataataaaacacaaagagccaggctttgagactcatgtaattacaatttctaatttgaaaggcagttaagaaatagataaccatttattttagaacactcaacaactatgtaatggctatatttcagtgacttggactgtaaatgaaacattgcatccatgaaggacagcaccaagcacctttttgaatacagaatttttttagaaaaatatatcaaattatataatttccagaaaccataaataatggatataaaacttaacctttttgttttgttttgttttgttttgttttgttttgttttgttttggttaatggaaactgaaaagagcagtatttgaggttgcttctattctggttttttattcttagctcaattaatatttagccataaatgagtagagactggcaaattgtgctttagtgttgctttcctcatccccacatcttgagctccttatttacattcacactaaattttggtgccttccagcacattagtggcaggcacccttctggaacactaggcaataatttcatcaatacagtcaggtct

SEQ ID NO: 118833 - DNA, 1116 bp, Homo sapiens
gagagcacagagggataaacagtgaggcctttaaatgctgaaaaatacatctttctttctaacctgaaagagtgcttgaaaaacagtataaagcattagtcctaatgacatttagtaaaggtattatttgtcagctaatttagttttatcgttcttattttctagtggaatattttgaggcataatttaaaataatcatagaagaaaacagttgaccaaggaaaacagaaacatctgagccaatcatctagataaaagataaatagaaacaacttcagaaaattatgtatgaaatcagaacagaaggtggagacttggcagctttcttcctaccatgaggagctttcagggcttcctggcctggggaaatgatgccctggcacttatttagcctggtggccatctgtctctgctaggacatgaagccaacaataggtttgtgagaagaaaaaaaaaaaacctgtccttccacagaggatgttaggtgagcaatctgagcaatcctggctagaactatgttaaaactagtaattgctaaatgaactgcacccttggtggccagtgggtggtaattaaaacgttttgtaaaattttttgtaaattttgtaaatgtagctaaaagtgattttggaaaaatagaaaaatccctgtattgtcaacttttagagtgttccttcccttttgtctttaaacatactgggtttctttaagcaaacctctctgtattagtctgttttcacactgctgtaaagaactgccggagactaggtaatttacaaagaaaagaggtttaattgactcacagttccacagggctgagggggccttaggaaacttacaatcatgatggggaagcaaggccccaaaggggaagcaaggcctccacatggcagcaggagagagaagagtgaggagcagagcgggaagagtcccttataaaaccatcagatcttggccgggcacagtggctcatgcctgtaatcccagcactttgagaggcagagacaggcaggtcacttgaagtcaggagtttgagactagcctggccaacatggggaaatcccatctctactaaaagtacaaaaattagccaggcatggtcgtgcatacctgtaa

SEQ ID NO: 118834 - DNA, 1048 bp, Homo sapiens
ccagctactcgggaggctgaggcaggagaattgcttgaacccaggaggcataggttgtactccagcctggacgacaagagcaagactctgtctcaaaaaaaaaaaaaaaaaaaaaaaaaagaatttttcatttggccaggcatggtggctcacgcctataatcccagcactttgggaggccaaggcaggcagatcatgaggtcaggagatcgagaccatcctggctaacgtggtaaaaccccatctttaataaaaatacaaaaaaaaaaaatttgtcatttaacaaagttgataagttaattcataaacataaagcttaggaatgaaggcatgaagatatatttacacaggagatgggatttttgctggactgttgtagggtttagaaatgaaacagggccttaatgaaggatctgatgactgattaaccataaaataaatgttatatcatttttctctctctatcctcaaacaaaaatagttcagggttataaattgtaaatgtattccagtttatctattcctctgctgttgtcaaccttttccttcaattagagcaataaaggcctgcaaacagctgaggtgagaggttgtccctgagtcagaaggcttgtctctgaaaaagacctcctttttatgccattctgggtagtggaggtagaggaacacagggtttctacatggtcccagggagtatgttataccaacttctacttctgtaaagccagatcagctttacacagaccactgtgttcaggtgcttctagtctgctccgttatcccttttagagcactgaaaattaaagatcagtgtcccccttaaaactgtggtgcagtgttacacaagctcttaatcatgatttgcctatcatatgacatcaacaatacgtatacaggttaagccacttttcacttatgtttactaaaagagatgatagacttagtttttctgaatgccacagtcttgatggctgatttggtagtttgagatagctagaccttctgcttctaaagcctgattgccaaatataaacttgatatatataat

SEQ ID NO: 118835 - DNA, 1036 bp, Homo sapiens
caggctcaagtgatcctcccacctcagcctcccaagtagctgggaccacaggcacatgccaacatgccaggctaatttttgtgtattttgtagagatgggggtctcaccatgttgcccaggctagtctcgaactcctggattcaagccttccttccacctcagcctcccaaagtgctgggattacaggtgttgagctactgcactcagcctgtaattctttttaatgatcctgtggagggtgtactgagtggaaaagagctaccaatttgttttgcatagagcagtctaatgtctctattcacttttgtagttccaaaatgtgttagaggaatttcaggatgcacaaattagctagcaggtaaatttctggctgtgattttgatgaaataatccaagagaggaatgaccagataacttttgatacatattttataaattttgggtttgatctcagtcttttatttttcttttcagttgctctaggtcgtaaccagcctttgaaaaaggagaaaccaaaatggaaaagcgattatcctatgacagatggacaactacgcagcaagagggatgaattttgggatacagcaccagcttttgaaggccggaaagagatttgggatgccttgaaggctgctgcacatgcttttgagagcaatgatcatgaactggcacaagcaatcattgatggtgcaaacataacattaccacatggtaggtttggtgttcctcaaggacagaggaaacataatcaactttgtttctgatagcaagaaaccaaatgggagagtgtttttccttgctatgaattattctaacttttttttttaatgtagcaaggaatagcattcctctttttttcttgtacatctttcagctggagacaggttttactttgtgtgtttgtgtatacgtatatattttttaaatatatcttaatttcagaaaagaactcttgatcatctaaaaagtttccgtgtaacctagtcctccatgaagacctcttccctccaccctcccacccccacctcaccagcc

SEQ ID NO: 118836 - DNA, 1078 bp, Homo sapiens
taaaatttaaaaattaaagaaaatgcatttggaatgattttccttaagcaacataaacgcatcatctgttctttttgtgggactttgttcatctatgcttagtacaaacggagagaggtgaaatgaacctacctcacatttgtaaggaaggtgttttacaatttttccaaggtactttgtacccttattatgattgtttttctgttggcttcctcttttcaaagtcctcttcctttcatttgctttagttttaggtcctgagattcttctgtagaggttttgttgtttttgtccatgctttgtaattctctcagaatgacaggaaaaattatactgagttatctctcatgcatttaatacatatgaggccagataattctgtagaaatactcagacccaaaactttattcagataaatatcttactgagtctacctgcttactgtgccatcttccacttcctggtcagtaagctgagtgttgtctgtaaactgtctctaactcatctaaatgataatgtagcagaaaataaaatcaaccttgcattccatcgtgttggtgcaatcagtgggttgtggttatcagaccagattctgaacatcttctagagaattatgctctagctgcattgtctgtattatttggaagaggtagggaaaaatcattagtatagactgtgtttctcgcatttgaattaaatgtaataggcacatctgtagtgttactcccagtagacactcagtacatatttgttgattaaataaagagacttggattctgtttccagctctgctactaaatggatgggtttcctattctgcttcctcaccctttcagaactcacctgttttgcatttcactaggacaagttagagggcaaaaagtatttgagttaatgctgagtgttttaagtggaaaacagctagtcttttggtgtgccaccctgaggggagaggacagaagagacctgacctggcagtctttattgagaatatagcctggagagtagagatagcccagggtctggagtcattttattttctgttttgcatagtccaaatttcatctggccctgggcc

SEQ ID NO: 118837 - DNA, 1055 bp, Homo sapiens
tggtgcttgtcccaaggggtaagttgaaggagattacatgaaagtgttctctctgctcttagaatatcagcatgtggtcatttggggtcaccttctggttttatagttgataaagggagcagagacattcttgcttcctaaagtgtctcacttagaagcgggggagggggaacctacagtggtcctgtaatacagagtttcattatcatagcttgtacgttttctgatagtcacccatttctgtcttgggcagttacctggataataattttaacttgatggtgattcaagagcttttaaggctttgatcattgttgtattgctaaacattaacacatagggcctattcaacaaaccctggctttcactgctctgggtttgtgatggctgcatcatgtcacagagatgctcttcctaaatgaatcggagtagttcatattctctttaaattctcataattttgaagttaaaagttgagatgtgccacaacatataacaagtaggacatagtgaaaaggaactttagaaacaataaaatgatacccagtacttctggaatggacatcgagtgagacacttaacctgtaacaagagctctgagaatgggaagaattgcttatctgttattgaatgaaatgacatgtaatagtcttggaagcaaggagactatctttctgcattgtatcagttgtagggtaggaataggttattgtgggtgtttgtatttttgttttttatattttaatactaaatttgctgactaaaacctatgatatacctgcataaggcaagcacgtaagtgaaaaaataactttttttctataacaagcaatccttaagcattttaagaagggaataatcaataggaacagaacttatacttcagtggtaaagataggtttttcagctggggacaaggatggatactaacagtcttatctataggaagtttcataattgctcgaagagggaggaaagaagttttcagataaaacattaagagagagtaaggaaaattaagatgtattaatagaataaaattcagtttccaccaa

SEQ ID NO: 118838 - DNA, 1150 bp, Homo sapiens
ggcagtactaggctgccagcaagcttttcttgagtcactggtagttcaaggaccataggctgagactttactaatgcatatgtacttaaagatgcatttgtgttggccaagaacaatcagcatgtatttgtcttgcatcagctactttgacatgccgtcagcaagaatcaagtttggtttttaatatatccgtatattgagctgagcggttaaatactgctgagtgtacattgggtgttgtgatgcctatttttgcatgtttgcagtgaaacttagaagtttccattattgctctgttttctgaagtggaatttctgttgaagttagacatctaagaaaaatgaaatatttacatgtgaaaatcattctaaatgaattttatttgagtgtgaggtcataattatatttacatttgctcaaagcttgactaagtaatgaattagtgacttgggcttttctcattgagttcttatcctcacagtaaaacctttaagttttttttgcatttattgtagtgggcttttaggtataagcaaggtgagactatttctttgcattggttcagatcatttccatgcttgtgggctatgtgacagtaccaaaggagtggagtaacaaatagttcagttcatttaattatgaatctgccttcaacttagggcaactactttatttcttgagttaagatgcttcttcctgaaactttaaaaaatagcctccattattccaactcccagcacttgacgctagctgtaattagagatgtaaataaggcctgctgtatattaagtaccttatggcctactggaggaatcatacatttaagtagaacttaggtaaaatttaaaaagtctctagagcaatgaatattatgtaagttcaaggaggagtggggggcagggtcagaaagcatcactgaaacagtgatacaagaagttggtcttttttttttttttttcttttgaggtggagtctagctctgtcacccaggctggagtgcagtggtgcgatctcggctcacggcaagatctgcctcctggggtcacgccattctcctgcctcagcctcctgagtagctgggactacaagcgcctgccaccacgcctggctaatttttttatttttagtagagacggggtttcactgtgtt

SEQ ID NO: 118839 - DNA, 1049 bp, Homo sapiens
tgacttcagtgcctgtgccctcccctctgtaaaagacaaaccaggcagggaagagatagaagctggctaagtggtggccaagtggcttcattgtgaggggggtgagggggcattcgtggctgctcccacacccaccatccctccagcccacagcagcctataccaaaggctgccctggactcaacagctgcatctccatgacaggagaatgccagggtcctggtggttgacacagagccctgttccctcttctaagctgttgccccctggggaatagagcttatggagcaacgggagctgaggtggcctcgagggccagcctggagggctctgagcatagcatgcagcggtcccatagggaggcaggtaaccaagggccaggcagagctgcttcctgtgcctctccggcatttgtaatgtttttttcttttttcacgcactgccaaatctgttttctcccttgaagaaacccagggcagatgtggtcatctgtcaaactgaggtctggagaggcatgactaaatcactgcagaagcaaaatcaggacccagcatttctagctcccagcccagagtaagagagcagagcagaaccccttcccattctacccgaccgaggcagccctgccctgccctgccccgcccctccccaccctgccctgccccagagatctccagttcacagtgttcatcaggcgagatacttttggacccacaaagccagttttttggggggatgctcagtgtctacctgcagtgccaaagttttgcttgaacagccctcttctgccgcgcctcccagctccaccccctatcacgtgggtgctggctgcttctgcgtgaggagcttcctctgatcacctgtagcatctttagtgccttcgtccagtcggcctgcaaatcccatttcccagagaggcttgggcagggcccacttgccacttggccctgtgcccagagcgttgggggcagatggcagccaggggaagaagggaggtggggaagggccgccaccgcttgagggtcccctcccttgagaggaggccccat

SEQ ID NO: 118840 - DNA, 1078 bp, Homo sapiens
atcttgctgcataataaattgtcccaaaagttagtggctctggaattcagcagtggcttaattagactcaaggtctctcccgaggttatagttaggatgtcagtaagggctgcagtcatctcaagatctgactgatgctagaaagtgacagtcaggatttcagcccattcccttctcaccccagagcccagtcagcactgcacatcgcctcccatcttatggctctgtgtccccaaacaatgaactatgtcaaactgagcgtgtgggttatatacagcctggcactttctaattaggatattccctctcagagcatattttaagattgatagacactaaactgcagatttctacctccttttaaatttgcttccagtcaagagagacctttttttttttgcattaaaacccaatgctatttagttcttaaattaattcttgacaagagattcagccctgccattgggtctgttcaactttccccaaaggtctggccacctgtttttttgggttctggtaaatgtttaacaaccagctctccaaggaaaaatactctgagttacagtgtttgccagttgccatggtgcaaatactgccaccatggtcaatttcaagctatcagtgtgatgtcactaaatgtagagattgggagagatgtgcccaactggctgtcacagctggtgtgactgactgcagcacacccctggtctagattggcccctctggtcattgctgttaaactgaattctggccaagcgtggtggctcacacctgtaatcccaacactttgggaggccgagacaggaagatcacttgagtctaggagctcaagaccagcctgagcaacatagcaacaccccatctctacaagaaataataaatagctgggcatggtggtgtgtacctgtaattccagctacgtaggagactgagttgggagaatcgcttgagcccaggagttcaaggctgcagtgagctatgatcgaaccactgcactctggcctgggtgacagggagaccctatctcaaaaactgaatgtctcctgcagaggattaagagatgatgacactcattgaa

SEQ ID NO: 118841 - DNA, 1084 bp, Homo sapiens
ggcagataaacagcacggtgaggattcgactcaggtctgaatccaaagcccatgcatgctgttggttatcatgcagaattgcttccctagccaaccagtcatccatcatggggacgtgagggactgactcaaatagtctatagcaggactatttggtcctactgcacagatcaattttgggagcacagatcccttgcctccaaggaaaaaaggtaatggccacttaacagagttcccagcttgtgctggatttggacttcacctagaatctcctatttattcatcatcgcagccccatgagggagggagggactgtcattatccccatcctaaagatgaggacatggcggttgttaggagttttaaatttattttcaaagaattaatatgtcagtgtgttcaattctttgccttctacttttaaacttaacttctggggaagcggcggcaggcgccatgtccggccgcgaaggtggcaagaagaagccactgaaacagcccaagaagtaggccaaggagatggacgaggaagataaggctttcaagcagaaacaaaaagaggagcagaagaaactcgaggagctaaaagcgaaggccgcggggaaggggctcttggccataggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaataaataaataaataaaaaataaacttaacttcctagtaaagcaacctttttcgattatctcctccaccctaactcattctgatcacccgctccactctaattcgttccgattacctgcttcaccctaactcattctggtcacctgctctaccctaactcattatgattacctgctacctgctctgccctgactcccgccaaagcactcaccccgtcattctctttaaattagccagtcagaattagtttaacctgcacagtctaatcctagccaatagggga

SEQ ID NO: 118842 - DNA, 1047 bp, Homo sapiens
gctctcttggccatccgctgccttgggtctgttgaggtgggtgcccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagaccttttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgttgtgtgttttgatttttgtctttttatctgttttatattgacataattttcctgtttaaaaaaatacaactttggcttgttaaaaaaaaaaaagtcttcagaactcaatttttaaaatcccacttacatacactgatggggagtgaaggtgaggatccaaatcattgccagtcttgaggaaataagttgcaaaatggctatagaaccccgacaatgtttgatgcctttgccaaataa

SEQ ID NO: 118843 - DNA, 1719 bp, Homo sapiens
gatgtcccactttacagatttgcaaagtggggctcacaaagttgaattgactggtctgagatctatctgctaagtggaaatccccagtctgagtttaaatcctgtgccatcctttgcacagtgcccacgttgcctccatgaacagtatccatgtgatggcatgtggtgatgttgaccatttctagacaagacacacatgacctttctcagatacactgtacctgggcttggggtggttctcctgaactctcaagtaaccagccgctcctttggttttccagactccatcaagaatgctggaggaagggtgtttgtccactgccaggcaggcatttcccggtcagccaccatctgccttgcttaccttatgaggactaatcgagtcaagctggacgaggcctttgagtttgtgaagcagaggcgaagcatcatctctcccaacttcagcttcatgggccagctgctgcagtttgagtcccaggtgctggctccgcactgttcggcagaggctgggagccccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggactccatgctccttgagaggagaaatgcaataactctgggaggggctcgagagggctggtccttatttatttaacttcacccgagttcctctgggtttctaagcagttatggtgatgacttagcgtcaagacatttgctgaactcagcacattcgggaccaatatatagtgggtacatcaagtccatctgacaaaatggggcagaagagaaaggactcagtgtgtgatccggtttctttttgctcgcccctgttttttgtagaatctcttcatgcttgacatacctaccagtattattcccgacgacacatatacatatgagaatataccttatttatttttgtgtaggtgtctgccttcacaaatgtcattgtctactcctagaagaaccaaatacctcaatttttgtttttgagtactgtactatcctgtaaatatatcttaagcaggtttgttttcagcactgatggaaaataccagtgttgggtttttttttagttgccaacagttgtatgtttgctgattatttatgacctgaaataatatatttcttcttctaagaagacattttgttacataaggatgacttttttatacaatggaataaattatggcatttctattgaaatttcaacgcttttatttctttggcaaccacacccaatccctctcccactagtgaactagggaagaatttcgacaagggcctgcagaatgtgttgagatctgatcccatgccctgtggtggcccgttggtcccatgaaatggctgggttgcaagggaggaagacaagtgagtatcatgaaacaccggacgctacagctgaactcttagtattggatcagtgtgtctgcccatgcccattttagcggctctgtaacctaccatgtcacccaggatgccaaggtgtccccagagccaaagctaggaggaaatagccacttgtctggattgccttcttcatttaataccctcctcaggttaatataaaaagtcgccttcccatctctgagctgtgctggagttat

SEQ ID NO: 118844 - DNA, 1712 bp, Homo sapiens
tctggctcggcggcgcctggcctggcagggcgggtgacgtcaccgccccgtcacgtgatcaccattcaaacaaacaccccccctccccctgcgcgcgggtctggcccgccccgtcccccagaggccgcatataaacgcgctccccgggccaggctcgctgcgaaggacatttgggctgtgtgtgcgacgcgggtcggaggggcagtcgggggaaccgcgaagaagccgaggagcccggagccccgcgtgacgctcctctctcagtccaaaagcggcttttggttcggcgcagagagacccgggggtctagcttttcctcgaaaagcgccgccctgcccttggccccgagaacagacaaagagcaccgcagggccgatcacgctgggggcgctgaggccggccatggtcatggaagtgggcaccctggacgctggaggcctgcgggcgctgctgggggagcgagcggcgcaatgcctgctgctggactgccgctccttcttcgctttcaacgccggccacatcgccggctctgtcaacgtgcgcttcagcaccatcgtgcggcgccgggccaagggcgccatgggcctggagcacatcgtgcccaacgccgagctccgcggccgcctgctggccggcgcctaccacgccgtggtgttgctggacgagcgcagcgccgccctggacggcgccaagcgcgacggcaccctggccctggcggccggcgcgctctgccgcgaggcgcgcgccgcgcaagtcttcttcctcaaaggtacgccctcggggaagctcggggcgggccgcacacccctgaggttttgcccggtacccctggctctcggctcccgggggatcgccccacctgcagcgcgtgggcgctggagtacatttatctctggaacttgtcattggctttgtttggctctggaaacaaagacttgcctgggcctttccgatgtaaacttccagcccttggtgggtgggggagttgtatgaaggtgccgtgtcccggtgtcactaatggggaaaaaaaatgtctttgtattcccaggaggatacgaagcgttttcggcttcctgcccggagctgtgcagcaaacagtcgacccccatggggctcagccttcccctgagtactagcgtccctgacagcgcggaatctgggtgcagttcctgcagtaccccactctacgatcaggttagtaggtgtccctgccacagggaagaagtaagaactggcaaaggcatggaagagtagtgccagggagaatatagaaagtgacctgcagcattatttataacggaggggacacagggatatgatttattccacagttaagtggtctgacggagccgagtctccaattgtaggctctacggaaatgaacttgctggtcctgcccaggcaaatgggcttagttccctatttatttatcctccagcaacagaactgagttcactcggtatctgaaattgacttttccagcagaaagtttttgtgggtatgggcactggccttggctttgagcaagcttgatgaatgttggatatttctggatttcagggtggcccggtggaaatcctgccctttctgtacctgggcagtgcgtatcacgcttcccgcaaggacatgctggatgccttgggcatcactgccttgatcaacgtctcagccaattgtcccaaccattttgagggtcactaccagtacaagag

SEQ ID NO: 118845 - DNA, 1036 bp, Homo sapiens
catccctctcctccctctactgagcctccttggtggaccccacctcagctgacaggtggggcagggcacctggaatgagtccggaggggcctggggccccatgcagcctgccggcagctggagggttttaagtttctatagcctgaggctcccccaggccgggcagatcgggaggcctgcccccgcccctccctccctcagccccagccctgtccgctgggtatgggggcaccatgggaaggggaggaggcgccttgggcaggactctgcagaagggccaccggggtctggccttggctttctgcagtcaccacaatgggtcctttgtggggtccagctgcctcatggtctaggttgcatggggcattctggaagcctgcgggggaagagatctccaccagaggttcccttgaggtgtggagccccaggggatgtcctggcctgaggcagccacacttggtgtctggctgggaaaagagcagggctttaatgcagggaggagctggattagaatcctggctctgccctttctactgaacagctcggtatattctagaagttaggggcaaaggctctgggttcagaactccctgtcgccgctcggctggctgacctcagcaagtctccgagcgccctcagtttcaccacctgcaaattggggctaaaaataaggtctccgcttgtgacgactgagtgcgtgaaacacccttagcagagtctggcatgatttagagctcagaaatagggcattagtggatggggggtgttctccaggaggggttttccacatccacaaaatagtgattcagatgcctgtgccacaggaggtatttcttcccctcttcttgcatgtgaaggcagtgtaaagtgacagtctacccagagagaaaggcccttagcctgccatgacccccatagcatgggatatattggggtttaggcccaaagaggacactggtcttggacctcttgattggttgacatggttttccagcctgtccgggtccctgataccagctagcaaatgtttgccggc

SEQ ID NO: 118846 - DNA, 1304 bp, Homo sapiens
gaaaagggagagattggaggggcccaccatcctgtcagctcttttaagaattgtggggagtggagaggggtataccgtgattagacctcctcccccagttcaaggccagggagaaaaccagccgtcctgctcgtgttccccttcttaaaatcagaagcaggaaaaatagtgcactcttgcccttccctacggatacttctgattttcttactgcctgtagagcctggtgcaactgagttctgtgttttcctgtctgtgaaatgggaatgaggagagtactcaccgaagtagaacagttgagggatgaggcagtgcggaaagcatttagacacagagtaagcgcctcatccattttggccgccatatttatttgtgtcattttatttaagcacccatcatctcctaacacattatataattcacttaattatcatgctgcttctctctccctcccattagtacatgagctcctgagggcaagaagtttttatcaggcttcttcaaggttgcatctccagcacctagaactgtgcttgagccaaactcgatccttggagatgcctcttgaaatctgtcaaggaagccatagacatgacgtgacttgatatgccagcttcagtgggcagattttcagccattagtggagaaatctcccctctccacccttgaatctgccgttcctaggttgtttttggggttaaggaaggaggcagaacgcaggggagggaggctgagctttcaatgatttattgtgtttgctttgctcttgttaaattgtttcactaatggctggctgttgcagttgtggaactagccttgtgacccacatccgtgtgtgttgtttcgagttccggctggcctggggccagtagcacctgctgccttctgcacaccagcccagggtgggtgaggagggaagataacagcatccggaagccctgtgcccaggcccagtggtgcctgagcactgccttccgggaggtgcaggtggctgctgtcccacagtgacagcccccatgttgaaaacccaaggcctcgggggtgccgctgcactggcactgaccagatgtgctctgggaccattgacttcccctctcggagcctccatttcttcattttaaggaggggatgtaaacttcgctgcctcacctggtagagtagatgtaggggcaagtgtgatcaatgcacacttgcaggatcaatgtgcaatgcaacttgcaatgcaggatgaggcccataatttgtggggcccagtgcaaaatgaaaatgtggagtcccttgttgaaaaagtattaagaatttca

SEQ ID NO: 118847 - DNA, 1063 bp, Homo sapiens
tcttctggtaggtggacgtggtaaaaccagggcctccggggtttgcagggcacagatacaatcacatgggaacacctgagatggtcagacccagagttagacccctctccctttgtggtacccacacagccatagacgtcaaacaccagtctgtggtaagggagaaagtggccagagggtcacacactcaggcgcccctacctatcagcaagtacctcagtcggtgattgggcaagatgtgggccatggccacctggagcgcgaggccctgtggggaagggacagctgacatgcagctctgttgcttactgcctacagatgccctgatttttcaagagacaatgaaaatctgataaattgcgtgaaaatggttggccactgatctcaattttatttctgttaaacaccaaacaaatccttctgagggctgacgatagcctatgacaggcagggtgccgcctctgtgtcgcacatggcagtgtgaccaggacaagctcggggtgggcaggaccttgggctcgtgggaggtggcctggtgggcatggacttgaggctggaggcagaggagtgagggacccacaagtcaatttctttgggcacaggcagcctcggggccccatcccatgctaagccccctcccacccggggcctggcctggccctaggaccttgattccttcaggtttcagctggggctcccctcctctgatggtgtgggaatggcaccactggcccctgccattggacctgctgtcctctttggtgatcctagggctggcccaggtccttttggagtgacacacccttcctgcacatccttcaataccttcgtccccggggtgtctttcaggtgacttcccagggctatgctgtgacaacagtagtgcccacaatagtcactgcttatcaagtgctagactaaaggcttttcttggattccctcagtgcatcctcaagtcaggtaggagccatttcccattcccatcttcttgaggaggacgcaggggtatataggggggacaggacttggccgaggtcacacaaacagcaggtgatgccgctaa

SEQ ID NO: 118848 - DNA, 1084 bp, Homo sapiens
tttctcatttgcaaaacaagagtaatgcgttgttagtaagcaccatggtaagcactccactcatgtcagcagctcatatgagtccatcccaagtaggagatttgcccgagatcgtctttgagagatgtctttctaaaggttcctggagagacaggcctgtgtctggaaatcccaggcagggactctgacggtgatcaggcctctacctgtcaatgggtgaaccagccaaaaggagaccgccaaagcatcaggtgcattgccaggggcattgccatgatttgattgggagggagtgtcagtgttgcattttttgtacccccactttgagccctgtgcttaaagacaccatcaaggccatcccctgatggtcttgggaatggatagagctgaaaagagtgaggcccagaggcagcttttcgttttccaaaacgcaggcagggtctgcccaggtgccctctgtgggcttgttagcctgcaggagctggtttctgctggctgatgttaagtcaaagaggtctcctggctctaactcagacacttcctcatacagtcttcttagtgggcttcctgctgacagtggatgccagggacccaggcagggaggtctcccttttgaaaggggccactggcctttgggaaatagtagagaccagtgattaagagcttgatctccagagcccctcataggccgtcagtgacatgagagcagagaccggctcagccttgttctctaccaggtccccagggccaaggacactgaaagccctttttaaaaaaagtgttgaatagtaaatgagcagggtcttcctcttgggtctgaacctcagctctcctacttgaagcctctcttgacttgccaacaacttaccgtgtcatcagcggggatggtaatggtaccttcctcctgggggacagtagagtttcagtgagataacgtgtacatcactcagcatggcacgcagccatgcgacgtgctcagcacatgtggctgtgatgactgtttggtttgcacaggcatttctatgtgtggaccttgacgcaggttcccacaaaggactctggccccatgggtgacggtgtcaca

SEQ ID NO: 118849 - DNA, 1031 bp, Homo sapiens
gctggagtgcagtggtgcaatcccagctcactgcaacctcagcctccccattagcagggactacaggtagcacaccatcacacctggctaatttttgtatttttagtagaggcagggtttcgtcatattggccaggctgctgtcgaactcctgacctcaagtgatccgcccacctcggcctcccatagtgctgggattacaggcgtgagccatcgtgcctggcctagtcttctttttactaaaaagtgagattattaagtgtaaaaagacctactagtaccaaatgagatttttttctaaactcgattatgagaattgaaagaaaagtggaaaaataatcacttcttctgtgggtgatttgtgttatttgctgcccaatctgggttccacctaaaaccgtctcaggtacaccactgcgcagcctcccagaaccacccacctccttcctgacggccaggagacaaaggacccttgggcgcgatcagccgcaccttcaggctgagtggccaggagtcctcccgtggcccagcccacctctctctttcaggaattcaagtcagcatttttgttggtccggatctgaagccacttcttccaggcagctgcccctgatctctcaacttcatagcattttggctctttaaaaaaaaagaaagaaaaaaaccaaacgtgtgactttctttgaggtgttagaattatcctcctggtatgttgttattctgacttaattccgagagcagggctttgtcacacggagctggtacctactgtgtcacagcactgcatgtggctcaacaggccagggcttttaatcgcttttgacatctactctctgaagaaatacatttatatcacaacccagtgtacaatacatgaaaactcaacatggccgggcgcggtggctcacgcctgtaatcccagcactttgggaggcagaggcgggcggatcacttgcggtcaggaggttgagactagcgtgaccaacatgctgaaacttctctctactagaaatacaaaaaaattagctgggc

SEQ ID NO: 118850 - DNA, 1639 bp, Homo sapiens
ttctttctaaatgtttaaggaatttttaaattgaggtattgcagattgtaaagtgttcttatcttaagtatacagctcaatggcttttttacctgatacccccatgtggccacccccagatcaaggtgcacaccactttcagtaccccagaaagctcctgcatatgcctcttcccagccagcacccccaccacggggtgacctatctcctgacttccctccccttgctttagtcttgcctgttcttcaggtcacacacgtggaatcatatgatctgatctgtgtgtgttggacttctttcatcccatgtcccatctgtgggattcattcatgtggtcggatcagtgcttcattcttttttattgttatagtacctgattggggtacttttgagcttattttttatttcatagactattttggacatatagaatcatatagaatcacacccacctcccatcctgagaagcaaaccttaagcccctatattcctcttctgtctgcactttccattttgacccatctccatcccatcccaggagaaatactctcctaaatgtggtatttatccttcccatgcaagttggtaaatttgtactacctatgtacaatttcttaacagatcctttgagtgagtataaactctctttttcttatttggtattgccgagtccaattaaattttaatttaaatgttccaagtgtttctgggattcagaacctcagctccatgctctagaggtcaagacagttggagcaaagtccagaaggaaaggccaactggggagaggcaggaggagagcagagtggggagagaagcggagggaggtgggtgtgggagggagatgctcacagccctcagcagccatgatctggtgggggcccctgccgctgccctggtttttctctcatcttggacctatggggaatgcaccgtgcccctctttctggcctaatttcctgtgtccactggtgccacctctttgcagaggcagccttcagagggatttgtgggggagaaggagcttctcctttgggaagaaaatgcttgtggtcctccatgtaccctacaccctgcagctgcgtcacaggggaagcactcccccatgggggccaggcgctgtgctaagccttttccctgtactaacatgtgaaccccctctgagcaagccagcgaagtgagcactatttgacagcctgagaaactgaagcacagggcagtgaagtgaattccccgaggccacagctagcaagtggcagagctgggacttgaacccagaaagggcagctccaggctcaccacctgtatactctccagtctattgtctagtggaggcacgggcggcccaggggccttccccgatgcttatctcattctgtaactctgcattctcagtggaggttttcttgactctagctccaggcaggcagagactgcctttgtttggctcccatttttatcattagcagagcaggtgctagtgatatttgcagaacaggtgctgaatgaatgcatgaaaaaatgcatgaatgtggaaatgaaaggggatgcagatggagatgatgcagatggagatgatgatgcagatggagatgatgcagatggagatgatgcagatggagagcagtggccatgcaga

SEQ ID NO: 118851 - DNA, 1007 bp, Homo sapiens
aggcaagtgggggtgaggggcccctctccagccttgcccagccagggcctccaggtgacacagcaccacagttccttagctccgtggaccctgcatccttcactcactcacccagtgccacggcctgctgtcagcatgggccctgcatggcacaggagagcagcgatgagtacagagagccaaggctcccagggcccagtggggagctttggggaggccagggaggatcagtgttcagtctccaggatgaggctggccagggttccagtcctgactctgcttcttgttagctgtgtgagcttaggcaagtggcttggcctctctgagcctcagtttctgcatttgttgaaggaacctcaggagtagtagggaagattctgtggacagagtaggccaagtgtctaagcagtgcttggcccatagggtgggagtccaggaaatgccagtcccctttcccgtccctctgttgacctgtggtaactcaggtgggtgcaggctaaaagtcttaggaaatctgcttgaagttagatataaacacatgccttacaccttaggaattctagcacgcatgggcatctcctgaactgtgcttttcagcaaagcagattcctgccctgcccacctcacccctcaccagtttagttcattctacagtggggccctggaatctgcaaattttttttttttgagatggagccttgctctgtcccccgggctggagtgcagtggcgtgatcttggctcactgcaacctctgcctcgtgggttcaagcgattctcctgcctcagcctcccaagtagctgggattacaggcacacgccaccacgcctggctactttttttgtatttttagtagagacggggttttaccgtgttggccaggctggtcttgaactcctgatgtcagatgatccacccgcctcggcctcccaaagtgctgggattacaggcatgagccaccatgcctggctggaatctaagtgtaaccagcttcccacagattctga

SEQ ID NO: 118852 - DNA, 1127 bp, Homo sapiens
taggttcaagcaccacccccctgacacagggacacacacataaaatgtaacagaatgcagcgttctgccttggccttttcctcttactgtatcctggagattcccctgtgacagtgtcattttcccatctagctgtatcaccctctgcgttatgggtgatctgtagtgtcccctttggctggatgtttggatgacctcccgtcatttgctattacagctggtgctgtggtacatagccttgtgtagatgtcaatttatattttcacctggagttcactgagtgctattaatgggccaggccctgcgtgacccacaggagattcaaggacaaatctgacccagcccagcaagagtggaagaccctgcagccagcctggggctgggccgggtatagtccccagagcctgtggagactggggagctgccttgggatggggagtgtggtttgtctggccttccggaagtcaagcagtcagatttactcttcttcctctttgtccagacttggtctttgtgggaaggaggggaggggaaaggccaagattttgtggtcagaaagggttatcacggatgggagaggtcacatgtggggatgattggggtagaagtggaggctgctggagctgggaggccatgccatgggcaccaaggtctagggagagagctgcagggagaaaaccttatatgcgttggtgacatcagcattatgtgctatgtagaccaggagtcgtcacccagatttctcataaatccaggccttcactccttcacctgccagcctgtttccctcttccaggcaggcatgtggcccaggggtgagaagaattgttctactgccagactgtgccagttcaagtcctggccctgcatcttgggcaagtaaaacagaaagaatgctactgtctaccatacagggttatgaaagtgatccgagatactgaacgcaaagtgtaagccgaggcttcgtgcgcagtaagccctcgcaaggggggtagcagcagtcatagctgtgattgttactattatattattattattattcctccctcaaagttgctccatctgggctggagacagagatggaccttttttcctttggacagagggagagagtggtatgaactcat

SEQ ID NO: 118853 - DNA, 1009 bp, Homo sapiens
gttctgctgaggactccctcctccactcaggctcattccactgaagtttgtgagcacacgctctgtgctgaggctcagggagccctcgtcctgggggtgttgacgggagtgggagaggcttgtgggacagacgcaactggacccctaagcacccctgtaccctgcaggcacctgggccctggtgggaggggacacacctgaagattatgaaaaaggactaggatgcctgcatcacatgtccactgagggccaccggcccctcagcttttcaccgattcccatcccatccaggcagtgcaatgccttggaaagagcatgggctctgggccccctgtccctgggctcagatcctgcctctgcctcctcttggtcctatgatcttggccagccagctgtgctcctctgagcctggtttcatcgacgtgaagggagaatagtacccttattaaacactggatcaactccttgagcatcgatattaataataatgataaaaaccatggacatttattgagcacttactgtttactaagaccacacttagcattgctcttgttctcatttgatcttctcagcaaccccatagcaacccctatgattgtccccattttacatctggggaaactgatggatgggaagccccttgcccaagtcaatcagccaagaggtggcagagccaggattcgaaccctggtagcctaggctttgaaccctggtagcctaggcttcgaaccctggtagcctaggcttcccctgcactgctgtattttctttaccaagaagggtgtggaatcggccctcaagagagagatgagtctcacacatacacacacacacacacacacattgactcacactaacatacacacactcactcactctcctgccctggggcagccaacagcttgacctggcagtcatccagcagccctgtgaagtagacggaatctttatccttattttcctctttttctctcctttcctctctccctccttcctttcctttctt

SEQ ID NO: 118854 - DNA, 1290 bp, Homo sapiens
ctccccctgtgctctcaggcgatagctgatttgactgtttctttacctcctgcttttagcctaattggtatttcagtgagctccctttactacctgattggtcaggtgtgagctgagttagaagcccggtgtttaaaggtgggagtggtcaccttccccagctagggttaggaattcttatttggcctaggaaatccagctagtcctgtctgtcataacctcctgggctcctgtttgcctctctccctccagctcctttgctcttggtggcctctgattggggccaacactacaagcaaggtcaagcgcaggtccgtgtctcccctctcccatcctaaggcttcccaggaccagggccctccttcattttcttccttgaccctgatgctgaggagagggctgggaggcagcctgagctgtggaaaggctgggttgagattctagctcggccatttcctagcatgtgactccggggatgggacacaccctctccgagcctgttccctggttttaagatggggctcagggcatttcacaggcgcacatgggacagcatgaatgcacgtagtaggcctcccccagcttaacgagtggaggcccatctgttgcactcttgtctctgggaatatccttgtgggccccacagagaagccccaggtgtcttttcagagcccaccgttccttgtgaacagcatcacaccgggtgctaggggcgcaaagatgtggtcttagtaaaaacgaaattcctttgccttggtctgactcattctttccctaagatgtggccatttacaaagctctcttggagtcttcattgcttagatagggcagttctcttttatttatagcctagggactggacccaaggggcctaataaatgtttaaaataaccacagcccagccacctgaagcactgccccttcagccgccccctaggccaggcctttagatttggttccctctgggtggggggcattatcggggaatcagatgcggccatcagacatccagcagctacttggggatgcctcaagacacctgggctcagcacagcttctggcactcagcacctctccctcctgctggtcctgttcctcttccaagggctctcagcccaaagaatgggtccaggaagaaacacagcagtgtgtctgcattcccccctcacctcaccctcctccgcccagtcccatccatcagcaagtcccgcctgctctacgtgggttcctacagccctcctcctctccattcccatcccaccccatccaaggcgccgccatcccctgcct

SEQ ID NO: 118855 - DNA, 1070 bp, Homo sapiens
tgggaggctgagggaggagaatcgcttgaacccgggaggcggaggttgcagtgagccgagatcgcgccactgcactccagcctgagggacagagcaagactctgtcaaaaaaaaaaaaagtataaaggcctcgtgcagcctccttacactgcaaccacggtgaccttcattcagttccccaaagcagccatgccctccccaacctccaggcctttgcacatgctgccaggatgatgcctacgcatcccccagacctcaatcacacctcagagaggtcttcccagccccttctccccaaaggtcagtggccctgtagtccctgtcatggccccctgcagctttctgtcaagtactaatcagcgttgggggtggcagcatatttaggggctgagtgatgtctggttcttgtgtctataagcttgaagaaggtagagacagcatctgtctgattcattgctgcttctggctcctgacaggtagtaggtactcaaaaaagtatttgttgagcaaatttggattgctaacagatgccaacactgtgctgctgacagcaaggtgacatggctgtctgtggagccacctgcccctaaatatggccgatgcggtcgacagaataatgaccccctgccccctgtgatgtctaggtccctgtccctgatgtgtgtggccgtgttaccttgcattcaaaaggaactttgcaaatgtgattacattaaggatctcgagatggggagaggatcctgggttagccaggtggactggatgaaatcacaagagttcctgtaagagagaggtggaggccaggcacagtggctcacgcctgtaatcccagcactttgggaggctgaggcgggggcggggggggggggagagaggggagggggggaggggggagggggggggtggatcatgaggtcaggagttcgggaccagccttgccaatatggtgaaaccccatctctactaaaaatacaaaaattagctggagtggtggcacgcacctgtagtcacagctactcgggaggctgaggcagaataattgcttggacctgggagatggaggttggagt

SEQ ID NO: 118856 - DNA, 2033 bp, Homo sapiens
aacagagtgagactctgtctcaaaaaataaaaaaagagagaggtggaggtcagagaagggggaagctgctggctttggaactgggagaaggggccacaagcctaggcagcgcctagaagctgaaaaaggcaagaaaatgcattctcccaagaacacagcccgttttagacttctgacctccaaaagcataagacaataaatgtgtgttggtttaagccattcccgttgtgataatttgttacagcagccacaggaaattaatacagccgtcaagtcgtttctcagaaccggttctgcccctacggatgggcatcagggaattcctggcttcccggctgggggaaggggacctcaagagaggaggctgtaaggtcctctgtgcctgctggcgccaggccctgatcccttataagacccctatttctcattttagtgttcaaaccaccttattcgtagtgggtggtgttatccccacttaacaggtgtgttcacagaggtgagcataggaagtgccagaaccagaatttgaacttgaatctgtctgaaagatatgctcttaccaccgtgctatctgaccccaccccttctctttcctgagccccagccctcccctcttttttttttttttttttgagacggagtttcactcttgttgcccaggctggagtgcagtggcgcaatctcggctcactgcaacctcagcctcctgggttcgtgattttcagcctcccaagtagctgggatttcaggcatgcgccaccacgcccagctaattttgtatttttagtagagatgaggtttcaccatgttggtcaggctagtcttgaactcctgacctcaggtgacccacccaccttgacctcccaaagtgctgggataacaggcatgagcctctgcgcccagcccagccctcccgtcctgagaggtaaggctgcacttgaagagtgcagcctagacccgtgcctgagggcacaggaggtgcaggctctgcccaggtggagtctgggttatctaagttgtggtcaccaagtgaagtgatccccggctgtcccccgcagctgagatctttgccgccatctcaacaaaggttcctatacttgtctttcccctagtgtgaacgagctctatgtcgatgacccagacaaggacagcggtggcaagatcgacgtcagtctgaacatcagtttacccaatctgcactgcgagtgtgagtactccacgcagcccctccctccagcaggacacctccttagggcaaatgtgtgtgtgcagaaatggcaagatctccaggacaagccaagccaacatatggttctccccactcttttttggaggagaatataattgcgtatgcatgcacttggaggttttctggcataataaacacaagacactactcataggggttaaccctggagagcagctgatttggtgcagggaggtgggatgtctcttagggtcatgttacagcttcgcagcagagcctgagagtctcatgcaagtgacttgttgaggggaggaagctgtaagggagaaacgcaggatagggcagtacgacaggataagcaaagatgtgtgttcagctgaagtccaaactcagcctgatctcacaggatgctgtggggtgtgaatgacaccatagcatttgtcacacccaatagcaatgggaccaggctgttattatccatgtcattgggtaatggctgcagagtggtgtgcgtggcaggggtcatatcacctcccaagcatctcaagcgagaagacctccggtcagccaagagcattcatctggagaagggcgcagctctgagtcattggcagctgacacctagagaagctggagcggtccaccatccatgagagagtgcaggacagggctcaagagcatctgcaacagtgaagggctgggagattccctttttgacttcacacctattttgttttaaccaaaagaatgaattacttctttttttttttttttttttttgagacggagtttcactcctgtcacccaggccggagtgcaatggcac

SEQ ID NO: 118857 - DNA, 1002 bp, Homo sapiens
tgagatacaagagctaacatttattaagcactttccacctagcgttcatcagaccctaagcattttctacatctatgaactatttgatccccataatctttcaaggagggttcaattatggtcagccccccatcttacagagaaagaaactgaggcatccagaggttaagtacctgaggcaggacccagattcagaggaccagtatggcagaccccagggtggccccgggacccctactatgcactgcccccctcgcctcacgtttagcggagtcattgtcctgtcccctgtagtctttggaccccagaccatgagctcctggaggtccccagcccggcctgcccctgcaatggatgaatgaaggctcccagagagaacaggctggcccccatcctcccgcgtctctgggtttgtgactgttgtctccctttggctcctgcagtggttgggcttgacattcaggatgagatgggcaggcacgaagtgggccacatcgacaactccatgaagatcccgctgaacaatggggcaggctgccgcttcgaggggcagttcagcatcaacaaggtatggaagccctgcctcagccctttctacctgctcccctttcctgctgtctccccgctccctggaaactggttgtggaggcactcactcgacctgaccctgacacagcccccagcaagcgagggttcgtgtccagctgcctggccgttcctgctgagaatctggatgggggtccaggctccctggggttttaagcccctgatggctggttcaggaaggagctactcttctctccagtgagggggacaatgatgagaagacctgaggatttgcagcccccagccctgggttcaagtcccagctctaccccttcttggcccctacaagtcacttgacccatcttaggctgagggtgtgatggcgataatagtatcacgataccacccacttcacaaagtttgtgtggggattaaatgagctaatgcagattcatt

SEQ ID NO: 118858 - DNA, 1005 bp, Homo sapiens
gaaacaaggagaagctgcagtggctcctgccacatggttgtcaccagcatcctttgttctgtaaatactcatccagcacctcttgctggcttggctctgcgagggcttgagacccagggaagagatgaggctaccacagtctgtccatcagggatcccccgtctagggcactggggcaaacttgggtaggaaatgataggggtttggagtctgaggaatccccattagtctgcaagctcaaaggtcatcccccagctgactgtggggtcagccgcccagaatccacagagctggagggggagcagctgccatgagtcctggctttgtgcccgtcgcccagatgggcacttcacatgcaccctctcaccagatagtcctggcagccccctcggaagctatggtagtgcccccattctgcagatgaggagcctgaggcccagagagatggggtgactcctttgcacagttgaaaatgatacaagcaggatccaaacccagatctgcctgattccagtgtcctccctggatcacacagggtgaggccccaatgttccgccccctggagaagtcaaccaaactcctgaaactcacatttctcccccaggtccccggcaacttccacgtgtccacacacagtgccacagcccagccacagaacccagacatgacgcatgtcatccacaagctctcctttggggacacgctacaggtgagcaggggacactcgagatggcatggccgggggtgggccttcaggggctctgtcacccagtgccctctgccctctctgggcactaggaagagttaccgttaaggtgacatctaagccaagcctggaagggtaagaagggtttcaccaggaacagaacagggaaatgggtcctaggcagggggcgtctcaaacatcacccctctcctagagcgcccagctggtggttttcatgtgaaagaccctcaaggttactttcagaaaaatggatcagtaagcgtatgtgacacggcatg

SEQ ID NO: 118859 - DNA, 1072 bp, Homo sapiens
catgtgtatcctgtcccatgacttggttcttttccctgttggagaatagctgctcctagcacccacactttttttttttttttttttgagacagagtcttgctctatcgcccaggctggagtgcagtggcatgaccttagctcactgcaacctccgcctcccaggttcaagcgattctcctgcctcagcctcctgagtagctgggattacaggcacctgccaccacgcctggctaatttttgaatttttagtagagacggggtttcaccatcttgggcaggctggtctcgaactcctgactgcagatgatccacccacctcggcctcccaaagtgctgggattacaggcgtgagccaccacgcctggccaacactcactctttcatggttgctctattgatggacatttgggttgtttccagaattttaatgatgtgcacagtgcaggaggaaagatcctgatggatagagtctcccaattcccggtatccaaggggagaagatgaagagcagttggttggtggtaaaactggggaatgagccccctgccgtgcccagggaatttaggcttaggattgaaatgacatagagctgtcagcgggcagtgcccgtccccctgcttcattctgctgtgtccttcccgcagccctggcctcccacgactacatcctgaagattgtgcccacggtttatgaggacaagagtggcaagcagcggtactcctaccagtacacggtggccaacaaggtgcgcgggcggtggctgggccgagctgtgtgcggcggcgccctctgctgacggagagcagagatgacaggcggctgcaccgacgcactttcttctgattcctttctggaggcctttcctgggggttagcttgggccaggcgctgtccctgggtaaaattgaaaagcccagtccctgccatgtggcagtctcagagtcaaggagaacagatctaaccaggagatagggtgtgatgcgtttgacaaagagcaggtagtctctgtcctacaaaggtcctggggttgcaggtctcaaacagccctgcatctggtccgagtccttcaga

SEQ ID NO: 118860 - DNA, 1005 bp, Homo sapiens
aggctaagagttcaagaccagcctggccaacatggcgaaactttgtctctactaaaaatacaaaaaatagccaggtagcacgcctgtagtcccagctactgtggaggctgaggcagttggaggctgagacaggagatcttggcagtaagccaagatcgtgccactgcactccagctctgtctcaaaaaagaaaaaaaaaaaggtgatcatattttccctagccagacaggatgagggaaaaaagtgatcatatagctacccttattaagcacctactatgtgccaagtaattacatagttacctcttttagcccccccagcaacctctcaaggtagatgattttgttcctgttttataaatggattaaactgaggctcagagaggtgaaaaaactcatccaagatctcacagccagtaaatggcaaggctcggacctgaccccagtgcctgcctctgcaacatcccctacccccagcactgtctcaggagcctctatcttccaaaacaagggctgtcaggggtgttgcagcaacaaagcccccagaagtcatagaactcttggtaggacagacatcaggatcatttgatacagtgactttcatcctgagaatcaggaagaactattagagcaggaaacaaagttttattgtgaatatgcatggtgaaatcacagcttcacacaaaccattaaaaaagccgacgtccatctaaggcagattggctgatagtttgcaagttttcctgcccatatctaacaccttttgttcacctgtttaggcttctgcaaacatttgccagaaactaaggcagcaagtgctgggggcagggaagagggcaggggcattaagaagaattgacaaggccgggcgcagtggctcacgcctgtaatcccagcactttgggaggccgaggtgggcggatcacaaggtcaggagtttgagaccagcctaacatggtgaaaccccgtctctactaaaaatacaaaacttagccaggcgtggtgg

SEQ ID NO: 118861 - DNA, 1042 bp, Homo sapiens
ccagggcccagtcaaccacttcccttccccgactacaccccccacctctgcctcctccacgactttggtgttctcatccccggctccagcctgtctgccgctgctggagcctgatgagactccaattcattatttatttcctcatgcggcgcctcctccacacgcttttaaagcagtgctgactgaacggggaaagtgactgaacagttcctgggcacttagggtacagcaggcagctggacagtgtcatcccggtccctgcagtgggccccattctacagatggggcaactgaggctcagagaggtaaactggctttcccagccagggccacagagctgggattggaccgcaggagtgtttactccaaagcccacaatctcgcctcccacggcggtgtgtatggtgcttctccattgcacgctatgggagagtaatggggaggggagtaatgatgcactgggaaggcgttcgtgctggtggaaaaacaggcatttagttcccgctccagtgcggctggaacacatccttctcatattataaggaattaagaaccataatgaaaatgtaagggaaacacacacgcaccccttttaaaggtagacaagctgacttcattctagtcacagtggaaggccaagaagctgacgggacccctgggaggaagttgctggtgggaacagaggggcattatcggatgacgtctgatgaatgccacttcctgcactgccctcagactcactggggcccaggtattgaattgtccttgtttttgtttctggagctgtggctgctgcccagagcagtggtgcatgcactggccgaggtggccctccctggctcagtgaccctgctccctcatccccgacggggaagatcccaccctaggttgtctctgagccttgaggcctggttgggagatacaagagcgtggcagtggcaagggaccaagccactctcagtcaatgccaccacagtcctagggggtgaggattagtcttcctttttttttttttctgagacggagtttcactcttgttgcc

SEQ ID NO: 118862 - DNA, 1050 bp, Homo sapiens
cccttgggcattcaggaaaatgagagttttcccaataggcttgaggtggtgagattcagggagctccctcactggccaaaggatggaacccacctctggcctaaggtgctttgccccacaaggatgttcttcatcacaaacacatcttggcaactgcctgagggaacaggacaccctgtctgggcctcagctacctgttctgttgaatgggttgctgtgtaacttcagagggcccttagagtgcgtgggcccccagcggccacaaagaatctgcctgcggtgctgggacactcttgcggtcctgttcctgtatgactcgtcttgccttctgctaaaagtgccagagagagaatggaagttgagacccaaaggcgtgctctggggaataagtaatattttactgatttttctggttaaagtgggtctcaggttgagacaatcccatttcttggccataaggttagagccttccagtgaactgaaagattaagatcaggtttcatttactgagcatctactaggtgctaggtgctccagatgtattttcagtagagccgcaggggttttgtcgttttatttttatttttatgtatttattttggcaacagagtcttgctctgtgacctcgcctggagtgcagtggctgaatctcgactcactgcaacctccacttcccaggttcaagcaattctcatgcatcagcctcccgagtagctgggattacaggcacctgccaccatgcccagctaattttcgtattttcagtaaaaacagggtttcaccaagtgaccaggttggtcgcaatctcctgagttcacgtgatcctcctaccttggcctcccaaagtgcaggggttgcaggcatgagccactgcacccggctggctttcctgttttatagatgaagaaactgaggcccagaaaggctctcccacggctagaattagtaagtgatgccacgatgcagcctccaaaggctgggtgctctctgctgccatggcaggaaagccgggtggactccccagccctcacctcatgccaccctcaccat

SEQ ID NO: 118863 - DNA, 1507 bp, Homo sapiens
agaccacaggctccagagttaagacgtacctgtgttcaagttgcatctctgctagtggtgaacttaggcaagtcacctgatgaacctcagtttcctccgctgtgaaatgggtctaataattcccttcctcattcagagggtgaatatgggaattaaaggagctcataatggtgaaaattattttattattattaaatccaccatccaacaactggttttctttgagccctaagtatgttccggacttggtgactatgtagtgggtattatgggcttaacgggcaatgtctgccttgcagagcccatcatctcatgatgtgggaggggtctggcctggttcatcctccagcactgacttctgacactcccaccccacccctgccctcttgcagatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtg

SEQ ID NO: 118864 - DNA, 1078 bp, Homo sapiens
atttttgtatttttagtagagacagggttacaccatgttggccaggctggtctcgaactcctgacctcaagtgatccgcctgcctcagcctgccaaagtgctgggattacaggcgtgagccaccgcacccggcctggggctcatgaacttaaagatcatggcccagtgccaggcacacgggaattcagaatagtaagggacaactattgttaagttctctatgtctgttgcataagtagatgaggctgtagataactacactctttgtctaaaagggccaagttctcatcagaacactttgctgagccccgggtgaccgaatccctagctctggggtgagcgacatgcctccaaggagctgcagccaggagacagccaggcgaaggcggggctctgcctctgggctccccgaggggcggaggccggcgcgcgggtcacgtgggggcgcgggaggcggggcttgcacacgctggtcacgcggtcagctattgacacttcctggtgggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccgggggtaagtgcgtgaggcccgccttgggaggaacgggcggtgaggagctagcaggccggggcggggaaaggcacgacccccacacgggtcagagaacgttgcatgggcgccccccgcgctgcagagtcaggcccccgacccggcggaactccttgtgttccttttcgcagcagcttcagtgtcctccggcctgagcgagtggagggtgacctttggtggaccccccttggaaacgagtttcaggggaattttttctcatcatagtcctgtgtggggaggtgcagtcggaaatgagcaggccgaatctgggagaaactggggtttgtccctagtcgactgtccccctttagccctgccttccacccacatgaggcctcgtttgcctgaacttaaggatcaaataaataaaacagaaattggcttct

SEQ ID NO: 118865 - DNA, 1130 bp, Homo sapiens
aaaggggaccttacatgttatagtctaataggaagatgataagctacaatcaaaccttgcctgtaccagtaaaaatgggtgtgtcatgtaggttgtgggtcttaacatttggagaatggataaaataagacacattttccctgaggttggaagttgtgatgatgataaattgagattaagtgaaaacgctttgaagcgaagatatcatgaattcaggaaatcttggatacttggaaagataatcaggtaatgagagaaaagtcagagacttactgtgacaaagcctcactgctttgtgatatgtctcaagatgaaggcaggctacgtcctgggaaacattttgttatcagacatgctgctgttaacacaatgtatatggaaagtttggtgtgaatgcagtagatttaagttttgctagtgtactttttccatgctaattgaaaatggtcatgttccaacatgatttcaccgcttcgttgtttctctcccatccttcttttagttggctgattgcaattctggcccaactcaaccctctctttggaccgcaattgaaaaatgaaaccatctggtatctgaagtatcattggccttgaggaagaagacatgctctacagtgctcagtctttgaggtgactatgcttgtgacctttcttatcagtatggtcaggcagtcagagtttgccttgactttttctcacattttatggccattttaacacgtggcaagggcaagctgctgaatgcaaacacgatctgaagagcagaaataaaattggaacttaagccttagcttacctaaatctcattaagattctttttagattctgctatcaccctgcctttttaaataaatacagtttaatttacaaaattaagcttgcatgcactctttcagacgcagatcaaaaaagtaactgtttatacttggcattgtgagatccagcaactttaaaaagtggctggcagatttaaaattgagcaggtttctttccagcagtagtcagccatccggacagaaccgttcctgtgatggtgttacactgctgggagaggaatgtcttgtcttcatccggttgcctgcgccactgttctggtggcgtctggcactggtgcaagacagagctgtg

SEQ ID NO: 118866 - DNA, 1217 bp, Homo sapiens
tgcaaggagcccgctccccaggagcctggccccagagcagagttcgccatgcctgcggaacctcccctccatgctataagagggaagggaaaaatacagactcttgaaactgcggtgaattcattagattccagcacaatcaatctcagtcagcttcattcttcctgctttctgtaacatagagtgttacttgtgctcctcatttcagcagtgtccttggttactggaccttttgccacagccctgcaaaacctggccaaacttgcaccaagttgattatcctgtgtttcatattttgttgagcatctgtgcattttaaagtgttggcttggttaactttctcgatgttaactttttgccttcctgaggaatgtatgaggaccagttaccagaatggttttgttttgcaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctgagatagaagatgctgttcttctgagagatacgttactctctccttggaatctgtggatttgaagatggctcctgccttctcacgtgggaatcagtgaagtgtttagaaactgctgcaagacaaacaagactccagtggggtggtcagtaggagagcacgttcagagggaagagccatctcaacagaatcgcaccaaactatactttcaggatgaatttcttctttctgccatcttttggaataaatattttcctcctttctatggaaatctgggctcggtgtttgtaaagttcatttttataagcttttctatcgctacataatgcctttttaaaaaatgattttgtagtctaaacttaggttgagtatataaaccctgccatgtagcttgagatgcctgaaaagactggtaagtgcgtttcttaatcgttcagtaactatttgagtgcctactgcagccaaggcactggagggatcaaagatgtgtaaatttggagtccctgcaagttcacaagctatttggagagataaggttagtatacatagaactgtaatataaggttgtgttggagcattgtcct

SEQ ID NO: 118867 - DNA, 1051 bp, Homo sapiens
tgatcctggcgcactgcaacctccgtttcctgggttcaagcgattatcctgccccagcctcccgagtagctaggattacaggcgtgcaccgctatgctcagctaatttttgtattttcagtagagacaaggtttcaccaagttggccaggctggtcttgaactcctaatcttaaatgatccgcccgcattggcctcccaaagagctgggattacaggtatgagccaccgtgccccctctagttatgtgattttgaaatgaattagcagtcgcttgtttccaagtagggttgaacttggatttttttgaggaacaattcactgacactttcaccatattcagtagctcatttcgggataggtaaactcttagacgagacataaatttgtcagataattggttctgattattttaagacaagggttgacagactttttttttttttttggaacaggatcaaatagttaatatttaggctttttcagccttccagtctctgccacaactactcaactttgaatctgtagcatggaaacagctgtagaaaatatgttctacatatttttgggctctattccaataaaactttatttacaaggtcaggctgtgcctctatttgtgcttccacggctatagtttgtcagcccctgttgtaagacatcagtcattgaggttttttgtttgttcgttttttgagacagagtctagttctgtcccccctgctggagtgcagtggcacgatctcggctcactgcaacctccgcctcccgggtttaagcgattctcctgcctcagccttctgagtagctgggattacaggcgcctgccaccgtgcccagccaagttttgtatttttagtagagacggggtttcactgtgttggccaggctggtctcaatctcctgacctcctgatctgcccgcctcagcctcccaacgtgctgggattacaggcgtgaaccaccacatctggcccagtcactgagttttaagtacttagatgttaaggtatttcagaatatacaaatagacactttaggtacatttgagcat

SEQ ID NO: 118868 - DNA, 1036 bp, Homo sapiens
tgatttaaattaaatttaattctacttcttcctctgtcctctcttccctagataataattacatcaggtctttaaaatggactaaaatttaaatatcactcttcttggaaattaaaaaaaattcaggagtacaatttttcatatttttactatatgatactacagtggttcaagactcaatttaacaaactaagatgctttggagcacataaacgatgctcaataaatatatattgaataattgacttttttgtaatgtcctcattgtgaagagcaccacacctttgattccttatccagaaggacatgtggtcttaggggattttcccattcattttcagccatctcttgtgtggatgactgctcggaagggcattgcatttggcactgtagtgaaatagatgtgagatatgatggtcattctcaaagatgtcacagtctggtagtggaagcaagggaataggagagaagatgaaaaatatgagctaagacatgaaggtcagtctcactactggaagttcttagtggagtaaagtgggattgtaactatcttgaggattaggggaaatggtaaaatcagtctaatattagacttaagagtagtggaagacagagttggaaagatagtgtcattgtgtatgagtatttttgtttgtttgtttgagatggagttttgcttttgttgcccaagctggagtgcagcgccatgatctcgcatcactgcaacctccgcctcctgggttcaaacgattctccttcgtcagccttctgaatagctgggattacaggtgtgagccaccacgcccagctaatttttctttttagtagagatggggtttcatcatgttggccaggctggtctcacactcctgacctcaggtgatccacccatcttggcctcccaaagtgcagggattacaggcatgagccaccgtgcccggccttgtttttgtttttttaagagactaggtctcactttgtgggccaggcttctctcaaactcctaggctcaagtgatcctcctgcctcagcctcc

SEQ ID NO: 118869 - DNA, 1100 bp, Homo sapiens
tctgagggaaaagatacactttcttccttactttcctcttttcccattgtccttccttaaagactagcagcagcagaatttggaaaataaataatgggcatgttttgctaataatcatgacaaactataataatctgttttgaattttacttgcctgtttctaaattttggagtctagagaactgctatcaaagggtaaaatatagtgattcacctgcagttttggttacaggtttcatattacataataaagggagaacttgagccccacctttcccccagtgtattccttgcataggcaacctctgctgcttaaatgttttggagactttgggatgtctgatttcaactgtaccgtgaaacaggtagtggcttgacttagtaagcatctgaaggactgttttgttctactcttgcagagtagagtagttttcaaaaggaaaggaaaggaattgttgagtgggacctatgaagtatagcaggatggatagaatatgaggcagatgggtcctagtttgctaaagagcttgggccatctgataagttgtctttcttgccaaacaagggagtcacgtggggtatacacattgtataagcttttcagtcaccgaggttgcctgtccttcctgcctccctgtttcgttgcctccttgcctcccttcctcacttcccttcctttcccacctccctgtccacaccccttccttcccctgcctctcttcgtttccctttccttcattctttcctgccctcctgcctacttccctgcctcctttcctttacctcttgtcttagtctattttctgttgctgtaaccacagattggataatggataattttaaagaaaagagatttatcgctgggcgtggtggcttatgcttcaaatcccagcattttgggaggccgaggcaggaggatcgcttgagcccatgaattcgagaccaacctgggcaacataataagaccccatctctacaaaaaaaaaaaaaaaaaaaaaagtaattaagtaaaagaaaagagatttatttggctcatgattctgaagactggaaagtccaagaacatgacactggcatctgttgagggtcatcccatagta

SEQ ID NO: 118870 - DNA, 1028 bp, Homo sapiens
taaatatatatttattattcgtaaaatactctcatttacaaagaggtttatatatttcttgatgtgaagtttttctttttctttttttttttttgagacggggtcttgctctgtggcccaggctggagagcagtggtgcgatctcggctcactgcaaactctgcctcccgggttcacaccattctcctgcctcagcctcccaaagtgctggtgagtatttttagtagagatggagttttgccatgttggccaggctggtcttgaactcctgacctcaagtgatccacctgccttagcctcccaaagtgctggggttacaggtgtgagccactgcgcccagccgaccctattgctagtaaggttaatttttcagattttaaagggtatcaaacttttctcccaaatccaggttttatgccaagattatactgatccactttattgaacacatgacttgaattagatgcctttagggaggcctaagtcataggtctagaaaaagtgactgaccttctttctcataggaatcaggggagagaattagggcaatgattatgactacataccagttgtaggacgacggcatgaggtcacataaggagagactgcacaagaacaggcctttggcaggaacagggagcaatctagttatactgtagcactgaattgaaaagcatagttaactgtttctaggtgggcacttgacattgtttcctaggttagaccagtgagctgggaacgacagcccactggaggggagagtgcagcaaagatccagaaaatgtgaattatagtcagtttattaatctaattaagtagaacaatgattgagtccctgggtgtggtgttgcttgcctgtaatctcagctacttgggaggctgaggcaggagaatcactggaacccaggaggttgaggttgcagtgagccaagattgggccactgcattccagcctgggtgacagagtgagactctgtcttttttaaaaaaaaaaaaaaaaaaggaaattaatacaatgtaccactgta

SEQ ID NO: 118871 - DNA, 1172 bp, Homo sapiens
taatttagcagtaatgattatacaatagatggaattaaattttgagatatgttttctcataaagaacataaaatgaatgagagcttgactttaaaaatcaatatattacatctttcagatcacagaaaaaataagcctatgttaattttgtgttttttttttttaatgttgccaattggttattgaccagctctattttagaaaaatataagaggaggaatggtaaatttcagaatagtaagtattaagatatgaccaaatccttgataactcaaccataagacttactcatttaaagtacagtattctctgctaatattatttttcaaaagtcaactttttttttgaaacatcaacttgtttttcctggaattcagtgaagttactttgtgttgtttgacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcaggtaaatcatacagagtaggtgcaaagttttttattttcccactacagaaagtcaatacctttgactcttaaatgaatcttaacacaactttgcatactacctttttgtgatatctcatttctgatctcagctagttttgagtacatgttcttccttccattggcttctatttcttactttgctatcacttgaagtttaatgagttctacataggtagtatgataaataggtagaaggtggacagatctgctggctttatggggcaaaaccaactcccttgaaaattagtctgccacagcaatcccgtttctatctcctcactattcctatttcccaattcttacctttcatttatgctagctgaatttagaagtaattaagaggaaatagtgagagacttcaggctgcctcccccaacccctctcatctctctctttctcatagacacacacacatacctatgtgtgcacatgtaaatatctccccacaaaatatatctaagaatgattgtatctgtttatattatggcagctactctgaattgatcagttttggttttaggcaatcag

SEQ ID NO: 118872 - DNA, 1026 bp, Homo sapiens
gaggttgcagtgagccaagatcacgccactgcactccagcctgagcgacggagcgagactctgtctcaaaaaaaaaaaaaaaaaaaaaaaaaaaaaaaaaaaaaaccgggtgcagtggcttgcacctgtaatcccagcactttgggaggctgagacaggctgatcacttgaggtcaggagttagaccagcctggccaacatatagtgaaaccccatctctactaaaaaatataaaaattagctggacgtggtggtgcctgcctgtagtcccagctacttgggaagctgaggcaggagaatcgcttgaacactggaggtggaggttgcagtgagctgagatcatgccaacagagcgagactctgtctctccaaaaaaaaataaataaataaaagaaattttttattctttctcattctctttcttcatctcagttagatttcaaattgaggcctttctattatttgacccactttaggagggtgagcccagacttgactctggcgggatttgtatagatgttaaaatgtaaaaagaagatagagaaaaaacaagaaggagaattaatgctgggtcccaagtcttttttttcccctttacttattatggaatggactgtgcccttttcaggaatcaggattaaggctacagagttcatgcccaagttactggtcttaccaaggagatttttgggtatttagttgattctgtttccattaccttcctgcaggcattggttgtactagacagtgatgcccaaattgtcttccagcttgctttggaaaataagacatgggactcagcagcacagagtgagagtgatttgctgtatctgcagaccctaggaaaagacagggaattctctactgatagttaaaatagtgttgttagacaaggatttgaagaaatgttatacagctaagtgaaagtactcgataggtgctgtatggtgactggtggctaaataagctttactttctagaagatattaattgctgctctatattttttcaattttttttgacagg

SEQ ID NO: 118873 - DNA, 1029 bp, Homo sapiens
acataaaattgaaataacacaaaaatatataaaaactggaaaactgagtgctcaaatgcataaatctactaaaaattattgaattgtctacttaatataggttggttttatggtatgtgaaattatacttcagtaaagctgttaaaacatacacagacaggccgggcgcagtggtcatgcctgtaatcccagcactttgggaggctgaggcaggtggatcacaaggtcaggagttcaagaccagcctgaccaagatggtgaaacctcatctctactaaaaatacaaaaaaattagctgggcatggtggcacgtgcctgtaatctcagcaattcaggaggctgaggcagagaatttcttaaatctggaggaggaggttgcagtgagccaagatcgcgccactgcactccagtctgggtgacagagtgagactccatctcaaaaaaaaaaaaaacaaaaaaaaaaacccatacacagacaacacacacacacacacacacaccccaaaaattaaagaaaaaaaataactctggaagactcaaaacgtcctcattttctttctgtgcctccaccttccaaaccttttaccaaaacgtaactaacaggttcttttccatgcatatgtaaacatatgtatatagtttttttgtatatactttttaattggataatatagataacagttttctgtaacttgctcttttaaaaataaaaatatatggtgggcagtctttcatatttgtacattagagctatgctgcattcatttcaatggctgcagagtcttaactgatatttgaaattgacatctccagtggcacatgcctgtaatcccagcaatttgggagggcaaggtgggcagatcacttgaggtcaggagtttgagaccagcctggtcaacatggtaaagccctgtctctactttaaaaaaaaaaaaaaagaaaaaaaaatcatctctaaaattcgtgaggagtattttactctgcctgcccaagtgttgttataaggtcttgcaaaagatcttaccattc

SEQ ID NO: 118874 - DNA, 1943 bp, Homo sapiens
ccaccactaaggagatcccaaaatccttctaagataaggaaatgtaaacttttttcaggcagaatgtttatggtaaactcaagagcccttgatatttggatcatacctgagcctctcaagggacacactttccgtcttttttaaatttaatttttaattgatttttgtttgttttattttcattctactttttcttgcctaaggaaatgatgacattatatgaaatgataaagcgtcctgtcagtagcctttatgttaaaacagaccaaaagtcaagtattgatttatcagtttgacatatggaggtgaatatttccttctgaaatatgatgtgcaatttcttttttaaaacctttctcaggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaagaccagcccggc

SEQ ID NO: 118875 - DNA, 1043 bp, Homo sapiens
tcacccctcttacagtgtacacttctatgagttttgacaaatcatgtaatcaccactaataccaaatagtttgatcacccccgaaaattccctcttctattttattttattttattttattttattttattgagatggagtcttgctcttgttgtccaggctgtggtgcaatggcacgctcttggctcactgcaacctctgcctcctgggttcaagcgattctcctgcctcagcttcctgagtagcggggattacaggcacccaccaccatgcccggctaatttttgtatttttagtagagatgaggtttcgccatgtgggccaggctggtctcgaactcctgatctcaggtgatccgcccaccttggcctcccaaagtcctgggattacaggcatgagccaccgcacccggccccttatattcttttatagtcatcccttttctccactgccaatccctggcaaccactgtccatataggttgctttttccagaatagtatataaatggaagcatgctcctgattcattctttgtctggagaaaacttagttcctcaaagcaaacatatcatcaccttcttatgttttcaggaaggaaaaattacctttttacttatggccaatgctgcccaagttttcctggttaccttaggtttggattgtgtacattcttcgcacagcccattccgtcttgttcatgtacctagcgttaatgatctggagtacatcagaggtggccattctctgagggtattttagatttataggtcattcaatactgggtctgaccaacagttctagcaactcagaattaagtattttctgaaacttcctattaggaaaatacccccttcttaaacagtgacgttaatacaaatagctttcaataaaatattaactggaataggcatataagttttttatctgatagccagtgtgagaaccgtcatcttttatacttttccaaaagaagtggtgtgacaggtaggaagaaaactaatgctgccacatagaattctgcctagtagaacaccatcataga

SEQ ID NO: 118876 - DNA, 1050 bp, Homo sapiens
gtttcagatacaaatattagaaggaagacatttaaaaatcatagtttatgtatctaagtaccattatctgatggtacttttgatattcctatagctgtcctgtaattgttctcttaatcctgtttgaagataataaaaatagtatcgtatactaacttataaaaactaaaaagaaacccaaggaagatgaacagtgtagttatctatgtttattaatctcggaatgttttatgagttagagatttacatattaaaagttctcttatagacctggtttattatctttgacatgccaatgatgttttcagatgcaaggaaatataccaagttacaaatagaaggggtcttttcatttgttctgattgatttattgaaatttatggagcttaaaaattgcgggacctttttttaaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggtaagaggggattgcagtcagatatttagtgtcactttaatcaagttgagctactaatccataatgtttactccgtgtacctaggcattcagcccttcctagcaaactggagatggggactgtagagctgctacatttgtgtgactactcttcgtcactcacaaatagcttttaccagtgttaagagtcctcacctaagtggagaggaaggactgtgtaaacattatttcatttctagtcccttcttaatctacctaccccattcaggaaatgactaggaggctgctggtttctgacctgtcacagttggtataaccagaagggttgaggagaaagtgaacgggctctcttgcattcttgtgtaatccccagatgtaaatggggggactggaattcaaacggtaatggggataaaagggcaaggaaagaaaagaaagggagg

SEQ ID NO: 118877 - DNA, 1047 bp, Homo sapiens
tattattattattattattattattattattattatactttaagttttagggtacatgtgcacaatgtgccagttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtccatttcttaattatctgttattacataattaaaaggaaagtctttcatggtagtgacatattccaagtgttttgttctgtcttacagataatttattgtttgtaatcaactccatcaagcaagagattgtaaaccgggtacagaatccaagagatgagagaggacccaacatggggcagaagcttgaaatcctcattaaagatactctcggtaagaagaatgcgagataaattcataacaattaataatatgtgtaagatgtatgatttaaggggatattaaaagttcttttagtttaaggaaaaactcaagtgctctcattgtaattactctcctttatgagtagttttatcttttgagatttagtgttcataaacatgtgttgcaggtgaccacaacttgtaatttagacttaatcatgaaactattttaacatttaagaaaaacaaacttctagcaactttaacctttcatggaggacaaaaggtcccagagctgtcaagcctgcagtttgcactttagtgtagagattcttacttgttttactcagtaatgcatttcacaggattcccacaaacttggctctctggtttcccatccctgaacagattgcacaatgtggggaggatcagag

SEQ ID NO: 118878 - DNA, 1262 bp, Homo sapiens
atgtccagctaatttatttatttttatttttatttttatttttatttttgaaatggagtctcactctgtctcccaggctggagtgcagtggcgtgatcttggctcactgcaacctctgcctagcagatttaaatgattctcctgcctcagctgactcccaagtcactggtcgtacaccaccatgcctggctaatgtttttgcatttttagtagagacagggtttcaccatgttggccaggctggtctcaaactcctgaccccaagtgatccgcccaccttggccacccaaagtgctgggattacgggcatgagccagctcacgtggccagcagcaaacttatttttatgtttgtagagacgggttcttgctgtgttgcccaggctaagctcaagtgatccttccgcctcagcttcccaaagcactgggattataggcatgagccaccccacccagccctcaccagttgttaatattttgctacatttgctttatttctacctctatctacatgtgtattttggacagggaatatttgaaaataactcgtaaaaatcatgattctttgtctctaactattttagcctgtattgcttgaaaacaaggacattctcttagccacaacgccagtgtcacatcctagtgcttcaacattgatataatatctaatatggaatccattttcccagttgtctcaataatgtccattatagcatttttttgtgtgtgtgatccagtcgaggatcatgcattgcatttagtcatatctcttcttttgttttctttagtctacatcagtctccccatcttattttatttttatgaaaaatccaggtcttgtaaaatgtctcaacatttggatttatctgtttcctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctcagcctcctaagtagctggcattacaggtgcctgccaccatgcccagctaatttttgtatttttagtaaaggcagggtttcaacttgttggc

SEQ ID NO: 118879 - DNA, 5508 bp, Homo sapiens
aaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgttctgaattgtttgcctcatgttttcgcccttcctttctgtacttatatcttgcttacctaggtaaccatccgctcctcaagataacctattccaaagaaattccaaatcacagagagtggtga

SEQ ID NO: 118880 - DNA, 1020 bp, Homo sapiens
caggagttcaagaccagcctagtcaacatggtcaacctccatctctactaaaagtataaaaattagctgggtatggtgacccgtgcctgtaatcccagctgtttgggtggctgaggcatgagaattgcttgaacctgggagttggaggttgcattgagccaagattgtgccactgcactccagcctgggtgacggagcaagaccctgtctcaaaaaaaaaaaaaaaaaagacttgtgcttttcatataacatggcccccaaagcccaccagcaactctgttgttgcttaacagaggaagacagtctgttctaaagctggtagaaaagctggccagttggacccctgagaaacagtatgtctgtgtcctgtgtttgcctacctcagagattttcaagggcaattttgaaaatgtgtaatttttgctattggagttaactatatgattttcagcagcgtcaccatacctagctgatctcttcctgccttcatctccagtactgatttaatcatcttaattttttatttttgaaaagatgttccttttacatgttttatgtatgtgtctgtctataagtatcaacattcagtgaaaagtctcagttatgccccagttttgttttttgttccactcttccaaacaggtaaccacttttgttactgatatgtcattccagagtttctctactcaaatatttaaaaagacaaatttctttttttttaaaatttcttccttgtttctcatctaaaaagtagcatactaacacacagcttttaaaaactttatacttttgtttttttgtttttttttaagacggagtctggctctgtttcccaggctggagtgcaggtgtgatctctgctcactgcaacctccacctcctgggttcaagcgattctcctgcctcagcctcccaagtagctgggattacaggtgtgtgccaccacacacagctaatttttcgtatttttagtacagacggagtttcaccgtgttagccaggctggtctcgatctcctga

SEQ ID NO: 118881 - DNA, 1020 bp, Homo sapiens
ggcttcatttttctgtccctgcacgagctctcaaaccttcaagcgctcaaactgcctattactcgtctttaattaaataggcacagaaattgtgagtatctggaaatgaacagcagtttgatattttaatgatatctaagtgggggatcagtgtgcttgtatttcgtcattgtttttcttttcctttcgggcctgccctaggtgacaggagcagcagctctgacgccaggacagccgtgcatcactcccaggctgactattccagctcttgttcccttcccacttttgggccataggggttttccttacttccttgtggacttagctatagatttaaaaggatgtgtgttatatgttacctagcattcctaggtgttctgttttaaaagggtgcttcaagtgctattgtatgcccttggcagaaatagaaatgctcttctgctttcatgttgacttttgaaatcattttaacatggaattatttttcctcaaaggacctggagcagttggctaaagagcaagacaaagaatcagagaaacaacttctactccaggaagtggagaatcacaaaaagcagatgctcaggtaggcagggcctgcccccgccagcggcttctgctggctcttcttgttgcctgtgagccttgcacgtgtgtttgcctgatggatctgctttaatgctgacttaatggtgtcttttttttttttttgagagacggtgtctcgctctattgcccaggctggagtgcagtggcctgatcttggctcactgtgacctctgcctcccgagttcaagcaattcttctgcctcagcctcctgagtagctgggattacaggcgcccaccatcacgcctggctaatttttgtatttttactagagacagagtttcgctgtgttggccaggctggtctctaacactggcctcatgtgattcacccaccttggcttcccaaagtgctgggattacaggtgtgagcaaccacgcccagccaattgcatcagttacacactggtgga

SEQ ID NO: 118882 - DNA, 1840 bp, Homo sapiens
tccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcttccacttgagtagcgtcattgtctgagagggtcattgatgtccggtgcacagggggacagctgtgagcaagtgggcttttacgtcaagagaatcctatgcttctgtggatgttcagcctacagggaaggaagttagatgaagaggactaccctaggcttctccgtcagagggaccctgtccaagcccctgcctgagtcacccagacaaggaggagaataaatttcatgcagttggcctggaagtgccacccccacaccccattaggcaggtccttaaggctcactctggtctcacctttgagtctcccctgtgagtctcccctgtggcttggccaccccttctctcagactgagcctgcagcagacaccaccagcttaacagctgagtggcctggcatatagagggaagcccactgcctcctccccagctcttgctcacgacagcagaacagagctggagcccctggtttacgtgatctgtgccactgttggtgtacctactatgttccaggcaccacagtaggcattttgcatgcattatttcatcctcattacatcccacaaataataggtattatcctcattctacaggtgaagaaactgaggtacagacttg

SEQ ID NO: 118883 - DNA, 1036 bp, Homo sapiens
ttagaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagc

SEQ ID NO: 118884 - DNA, 1628 bp, Homo sapiens
ttattcttcaaatatttttaagggaacaatagcagccacagcatcatcaacaacaatgatagctgtctttttttatgtttttttaattttttttctaatggtctaggcccttggccagggcctttacatgggttatctcatttatctttcccaaagatgctacaagatagaaattactatgcccaagaggaggaaagtgaagctaagagattagagaactcggactgaggtttgattcctgcttttaagcttcggaattgctggtatacatgactgaagccagtcatcaggaatagacttcaaacctgctcccagcctattatctccctcctagacctgaaagggctcacagctccccacatgtggtgggcttcttgtccttttatcaaatatatccccattacacaaggagaacactctaaaattcccttccttcaggtgcctctggaagagaaaaatgccccatggctaggaaacaccgtgagcttcactcgcctctagccctgtcccccattagagagagtttgctggcctcaggaatcggtggggaatggggcccattcctagtttataaggctataatgcatgcctggagcacaggaattctatctttcttggagaaaagtattctttgggaaaactgaaggttggaagtcccaccccctccccttaatttaagaagaaggtaaagctctctggcgttctagtgtctccttcttgggaatgtggccctcggggccatggtctcctcacaccattcagaatgagcctatgaccccccaccccagcctgctctggaaatgcaggcagcccatataagaagcctggtcacatgctgttcctcttgcttccccctaagtcagcatctctaggcaggggtctcccctaactccagcttcccaaaaacccccattacctttccttctgaagccatgatgtggcggtgcatcgacttgtacttctagctgaactgcctgttttttaggtttttttttcccaaccatcttaactgattaaagtatcctatcagtccccaaatatcaagaagcccatttccaaatgtgtggcattggtcaaaaaaaaaaaaaaagagagaactgaatttgcttttcactttagagatgaggaaatcacagtcaccccagaatctgcaccacccccattcttcaacccaacccccatccacaccagaacactcacccccagttaatgctgctcttttcaagctcttcctctccgctcccctcaccccttcctgcccgccccactttctgcacagcatctgtctccccctagctgccgcctgcctggttttacccccactcgccatgtcactgggtgctggcaggctccaggcacatccccctccaagtattttttaaaatcctttaggcttgctgacacccagttgaacgagctggactttgtcattagacacgggctgagcttgcagcctcagaaggcaccaggccagctcggaacacggcttggattaacttggttcggcacacacacccctccccgcagttcacagcttcctcctggagagagagagggccaagggcagaggacagcatgggctcatccagccttctgggatccagatccgccctgggcttctgggggct

SEQ ID NO: 118885 - DNA, 1060 bp, Homo sapiens
aaattccctttgtgttccagaaaagttgccaccacacaaccaacacagggctacctgagggacacatagccacggaagcccccgttggagggaaactcacagagtagccagggaggaaggagggagatgtgttcgtctacagaatgaacatcccttgttgcccagtgctgggggtgtcatgtcactctggacgtgcctccggatgtcgcattgcctgtcacctgggaggacgtccgtctctggtggggccttggggttctgatgtcagaaatatcctgtgtaagcccaagaagggctgaaatgtccaagcatgtaacgaggtcttctgctttctgcccctctctcccttccccggcctgtgtgttctcagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgagtgagtactgccccgcagagggcctgggtgaaggggccacccagcaaggatggcaatgtgtatgggaggagagccgcgttgcttctagaggctgaatgcctgtcaaatggagaaggcttccatttacttcagaaagctacactgactctactaaaaggcccctttcctgctggcttttaggaaaagagagaattccctcatcagtctcaaaatcacaagcaacagaaatgggaaatcgttttactaagaatgaaatgtgtcgattcagtaatactcttcatcttccccttagccaagaacccactagctctcagaatattctgagtagctgtagaggtgtccttacagacagcaaattgctaataacatttgttgaatatttactaagcgccaggcactgggctaagggctccttgtgaatttttcacttgatcctcaccacagccctcgtcacctccatttgacagatgagaaaact

SEQ ID NO: 118886 - DNA, 1470 bp, Homo sapiens
agatctttctctcccaagctgaccggtcgaaaccctgattgagtccttcagttccacactttccttttgctctatatgataaatatagtcagggcctgacccacttcggttatcccagggtcccaaggggaacgcggagttgctgctcagggcaaggcaggaacacaacaagcaacatatggctccagtgccaacaacgcaaatacatttttagatggcatgtggcatcagactcaccttcttcgtgttctccctggccacttatatgccctgttgaaacgccctgttactatatctcagaaacgtctctcctgcttcattggagagcaatgccaacatttggaggtggccatcagcttaggtgagatttatggatgtcaccagtccccatccactgacatatagtagtgagcctgacaaagcagtgcctgggaacaaggaggggaggcgaagacggggctggcagcctaaactgcagaggatgtgcggtgtggccagaggggaaactgaaaccagggaaggaaagaggtagaactttgaactccttgaggctccctaataaagcatcactctggattaacgggaattaggaaacgtaataggaaatccggaggaaagacgtgtatttaagggcaatcccacaggatgtcagggaagaataccaagaacagattgccacagccctcgcataaattcatcttcctcttttttttcccaaccaacaggaatacgttctcaagttagagacatccctttcaagttgatgctcagcacataactgcttaataaacgggcacaccctgccctccattctgtttggctctggctggagagtcaaaagagagggggccacggggaggccatgcgggccacatggtttttcagagatcagacgctatctgtagacatttctatggctgctaaagacaaaaccaaaataaatgtgctggctggcttcccacttccaacctaaacccatttactttctcaactcagtgacttccgggcctgtctaaaaacagaggggtgacctctccgacgacagctagtttctatagtaatgtggggtgcggggattcccgggtaggcatcccacaatgcctccgggctgcgcgaggttgataagggagcagcaccgagctcgcctccacacccccaacagctgtctcctttctaggataagcacaatcagacggggttgccaggaaagagaactgcaggccagatgtatgcctggctgccttcgccactcggaggcagggagcgtgggggaggggccgccagtgcggcagttcagactccagatgctgccaggcagggtgccaggccagccttttagaggcaataatccgaacagtttaaaggagtagagtcattttcaaaaaggaaaagagcgctcttcctggtagggtaggaggagacaagggtatggatttggggcgtgggaggcacggaggcagaaagggaggt

SEQ ID NO: 118887 - DNA, 1054 bp, Homo sapiens
gaagggctgcaagcttcctcccgggctgcgggaattctaggggattgggtgatacctcacccggatccctaattaaaaggagcctgcaacctctgatagtggcgtttctgaaggctcgcccccagctgactccactcctaagcctgctcgccaaccgcagcttccctagctggtattttaatgcgaagggttgggaggcactgccttaataggaattttgttttgatttttaggtgttgaatcataaagctgaattgaaactgctttttagatgctgtcatttgggggtcaggaagcaaatggctgtgatttaatagcagcaacttctacagatcaagtagagaagggtacttcattgatgaagtacagtcttcgactcaaaattttatttttgtctgtgggtttaaaaagcggaaatatattttgctctcaaactaagtattcccacaaatactttaataaaatggaaaggatgaaaaggaggaatgctcagaccagccttctggttgtaatttttgtaatttttcggctcttttctacaaatatttacaaatagagatatttttcatgagtagattaaaggacgaaattttgtttcccaggctttttaggtcctgaaatagtcattactaagtcttttttcctccttaaattttcctttagttgttaacttttatttcaaatgacctctctgcattgcccagcatgggttagagttttgtatatatttgtatgtgattttccttttagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccaggtaaaaatccatccagagcatgaagaatgtttggggtgagcatacatgattgaaacgttcattggaaagccttgttaaccaacttcctttgctgttccttgtggtgtgttttagtgcttgcaagcgacagtctaggtataaaacattatgccagtgtctcc

SEQ ID NO: 118888 - DNA, 1022 bp, Homo sapiens
caagagcatcaggactgtctttttgttcctctattgagagaagcccttgagtccaatatggagtgtaaaacattcattttaagtctttctttttaattgtaaattcctttaggaacataaaagtgaatatagtctgttatcaataaataacattttgatatgattatctttcctttttagaatacgccagacaccttttgaaagctaatttttggtgaagaaatggattcggttacataagagtgcaacttcagactgaagataggccaaggtcgtcactgatctcaagatttcaaccttgaccatgggcagtgaccagattgaaaggggagcaagttcggcagtgggagagttgaccgtgtcaccccctgcattgtgctgccatttggccagcctgtccaagggcatgacaccaagtagacactacagagagagaaacactacagcaacccagggttgtcctgaaacagacttttatacttgaacatggagactgcacatggactttagggtttgtgctgtgggataaacggaagctacagtgagaacatagccagtcccaaagacaatttcaaagaaaaatgacagtaaagattagctgggagtagtctttgacagtgcttatttgatactgtctctcagagtttgcaaaccagattgtacaagtcattagcgtcagatagctttaaagttgtgaccttcttgtacatgaatcttctagccagtttcctttcctttgtaacgaaacatgaaatcctagaatgtatgagaagttcagacattaggcataaggaaactcgtttgcaggctctctgtccagggctgcttcctgtcctggaggggccagtgagtcttaggtatgtttattttattctcacatttgtgtttttttagaaaagtgaatggtcaataaatggcttatctttcataataaaattatttgatacttttactccgaagcttcagctgaagcttaaacctcaggtctgtgaagggcaacctttgtcttctgcctctgtgca

SEQ ID NO: 118889 - DNA, 1129 bp, Homo sapiens
ctgctccttgagatctggctcagcctgctcactgcctcccaacctacctctccccatggccatcctaggtcctgcagaaggccaatcctgaccccctccatgatttcttcaaattcttcacctctgcattgaagtcctgcctctactgtattcttttaaatttaggggcttttatacgaatctcagcacctggattatttggtactgattgactttctgaaggtatcagaggagggactgatgtttcagccacattaaaaacaaataaacaagtggcaaattgtactttcaaccttgttcttagaggacattccatgtcccaagggacccatagtcagcctcccacccactcactatccagctcacagtgcctcgcttcccccggatcttcttggggacacaccctggcctgtcatctctctgcaaccaaaacaaagtgtgggcccaagaagcctgtggatattctaggcatcctggctcctgctgcctgtcagacagttacaagaagaggatttatttccagagggagcctggggctacagtgaagcacccatcttccttaggagacagtggctcaggagcctgtaggcaggaaaaaggctgcctgcctgagctccaagaggctgggcttggctcccagctccccttactctgggccctccagtgcttcattcgtgggctgtgcttccaacatctgctgctgccacttgcagtttgagcagagtgtcttctggggccacacccagaagtaagggtttcctctagcccctaggtgctgctagatacatgtacagttctcaggggctcaaccaggaatgaaactctgctctcctacctccatttcagtgctctgtcttctgttccctttccaggtgggctttgattggcaggccccattcagtggaccctgggcattgtcaacactacttgccagatttccccagctctctgccctccagatctgaggcaagacggcacttgctggccccaaggcagggccatgtgactaggtctggccagtgagccatgcgtggaagtgacatatgtcacttctggttgggagcctgtaattgctgctctaatcaccccttcccaatgccatggtgactgtgggaaatatttgagatca

SEQ ID NO: 118890 - DNA, 1043 bp, Homo sapiens
ccccttctcctcctcatatcctaccccccttctcctcctcatctcctacccccctcctcctcctcatctcctatccccctcctcctcatctcctaccccctcctcctcatctcctacccccctcctcctcatctcctaccccctcctcctcatctcctacccccctcctccttatctcctccttcttcctcttccatctcacgatctcttccccatcttcctcctcccctctcctcctcccagtcctcatcttctccactctcttcctcatccctcaccgcaactcttccctcctcctattcttcttcctccccttcctcccacctcatcttcctcttcattccttctctctccttcctccctctctttctctctgccttctcctccttttaaaatcaatccagatttacttggcttttgatttgtgatttagtagtgatcaggagatttgatgttaaaggaaaatcggataagcccagagccactgacctaattgataggagttgccattgcctctgtttttctgtataaaatgggaacagttttttgtacaatacaagtacaatacaatacaagtatttatttgggcccatatctattttcactagtcttctgagttctgtgaggaacaagaaaggaatgagtaggacaatgtcctccctcttagcaacttcctatctcaatggagaccgcctatcgaatgggaattttctaccccaagacacctgagacagaccacagtacacgctgtgagtgattgaagcacaggctctaaatgctggcagagatcaggctcagtatgggctggagggaggctccacagacaatgttcatctttttttttttttttttttttgagacagagtctcactctgtcgcccaggctggagtgcagtggcgtgatctcagctcactgcaacctctgcctctcgggttcaagagattctcctgcctcagcctcccaagtagctgggattacaggcgcctgacaccacgcctagctaatttttgtatttttagtcgagatggggtttcaccatgtt

SEQ ID NO: 118891 - DNA, 1122 bp, Homo sapiens
tgaatagagcaaccaccaggaggggtttgtgtgaataattgagatttgggatgtgctgggcttccgggacagacaggaagtgttagggaggcagaattgatggggctagaatcggttccatgcctttggctcacagtttatgccacagagaatgccctaaccttctcatttctgtgtggctcagttccaacacatctttgccatcccagctccaaggccacctccttcacaagcttgccctgcattcttcccacgtgaaggtcacctctctcctgtctattctgatagcgctttgggggcagcttgccttttgtgttctattggaacacagcacatcaaattccagtcatttgtgcctaacaaagcacagcgcatacaggaggtactcagcgaatgttcactccaaatctgcacctcactaaaccatggccagatgacatgcatgtgcactgattgacctaatggtagccagacatagagaccacaacgaagtgtagtgggacccccagctgccaaatgcctgatctccctgtgatttaagacttcacagttgcaatagttaactcaagctaaacttgccaggtggtgggcgtgggggctagatggtgaagatcagagccagacagccactccccgtgtttctgggagatgccgtgggcactgaatggacatgggggtgcatcagaactgatgtctgtagcagcccttgtcctgtccccgggagccattcgcttttatcaaggttgccttgcctcccccttctccttctcaggaccctggtgagttccccctcctctgtcacagatgatcagccgctctgcactggtcatgctagcagctgactttgggagagaagatctctgaaccaatagtgttctctcaacatgatgattgcctttcttctgtttccgcttgagaagagaccgtttggcttggtggaaagttccccagggggctctgatgtcacatggactgggatttgaactccagctcctccactgttggctttgtgactttgggcaagtcacctcccctcttggagcctcaggtttctcatctgtgaataaaatggggatcgaagtcctttccctctgggttgtgcaggtggcaggtgctcctgct

SEQ ID NO: 118892 - DNA, 1050 bp, Homo sapiens
actctctgccatagcttaagcctcatcatccacttccacatctcctaccttagatgattttagcagactaccaactcagaattacaatggaatcactgcagtagatgactaactgctatttgcatgcatgttttatttgtgaatgtgaccttacaaatcgattttcatgtctcactgatgaaggcaccaagcgtcagggagacaagggacttgtgtgcagccagtaagtagcagagctaaaatttgagctcagatcgtctgactccaaaatgcatgctctttctccacagctcactgtcatgtcttgcttctttcaactctaggtactgccaacaagaaggcccaatcaagatcctcccacaacaagagcagattgtgaggtaagaacactttgatcccttgggaacacagagccatgagtgtggccagactctctcaaatatcttagacttcatggctataaggcacaaattctagttttggtttatccttttcctcctgccctcatctgccctccactcaatttccaagctcatctttaattttgttgccatgatctcatgggccaggcttgggtgacatgcccatcactgagcaatctctcaggtcaggggatgcgctgtccaatggggttgtcttgggtcatatgccctgccgtgcatttcggtcagtcctattcaagccagatggatggaaagtggggaagatggttctccagaagcaaataaggtgctgttaccaggaagggtggccactccttctcactcccttgcctaagacctcagccacccaaagcaacaatcgtctatttggttctatagcgtggcaagctctatgctgagcactggaaggacaaagagagattgggcacagacttctcactgatccaggtgatgaagagctcacatctgagaggatgtgaccatggatgacccaccagaatgtcatgggatccagctacagccaaggaagcacagagcaccgtgggagcgatttattgtgcttggggatggggaaggggacatgggaggagccatattgagaaagtag

SEQ ID NO: 118893 - DNA, 1019 bp, Homo sapiens
tcgtgagcgaggaatccgttctccttgacacgtccctattgctcctcctgcaaagcccagttagggaagagaaatatcaaaggagtcccttgcccacacaaaagatggcgacctgctgcgctcactctgggtgggggaagcgggttccaggcgccgggcctcactaggcgaggcgcagacggaagaggcgtctctggaggtaacttttcgaccttcctgggagtagctctgaagcgagggggcgtggcctcgcctgagttctaacagatgattggtcttccggcaggtaggtggggaatgagtgctacccccacccctccctcttcgaaccggaagtgtctctgggtctttccagctggttgtcatttcactcggctcggtcctgaggagaaggactcagccgcggctgcgggacccgggcaccgggaggcggtggcggcggcggcggcggcagcagcggcgacagcagaggaggaagaggaggaagaaggaaagaaaaagaagaaccaggaggagtcctcaacaacgacagcggggactgcgggaccagggtaaagcggcgacggcggcgacggcccagcaaccgtgaggagaaacaaaagccttctaaattatagtttaaaaaaaaattctgggggaaaagagagagaaagccgaggggggaggcccttctcctttaaaataactacggtagtgggtttttcctttttttcctcttttttccctctctgcggagaatcgaactgagggaactgaacaaaccgcccctgggtcccatgagggaaaaaaaccccggagccgcagagaggggaagaggcagaaaccgcaggaccttccaggtcgccccctcggtccccgcacccccaggccgcccgctcaccctcgtcgagtctcgctaatccctcctgatcgcgacccccgcaagagggagaaacgggtgtttccaacccctttcatgggggagaggaagccgcggggagcccaggaacagcgaccgcagcaagatctgcacccggagc

SEQ ID NO: 118894 - DNA, 1201 bp, Homo sapiens
tccattagtcaatgctgatttcctctcccgaaaccaggaattcacttcccaccccagataacctaatataatctatatatataaatatataatatataatgttcttaaattattcctgatttttttttaaccaagctgccaagaaaagaacgtattcccctcttagtcctattctaatttttatgtgagtgaatctaaactgctgaggaaaaccatatgtgattgttaaattatatatatctatatttttactccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaag

SEQ ID NO: 118895 - DNA, 1009 bp, Homo sapiens
tccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggtaagattatgttccattaatagattaggatgaataaggaaatagcatggtgtaatatctatgtaactagagtttgaagtgcccgtattcacatcagagcttttcttagagagaaaatgaatcaataaccagactttattttagcaggagtgtaattggaacaaaatattcagctgtttctttggcagttttctaaattgtagccttaatcttgtcatagataattatgaatacctggtagctggtgatgtagtaattattaactataatacctttcttgcctgacatgagaatcagggtcagttttttccctatttagatgagaataaataatatatagatataaatatatttcattgcagaaactattgaatgttttctgaagtaactatataactaaacaaatttcttttgacactataaggtagtgattcactgaaaaccagctattgaattacagttttctcactggttggttgcattttaaacctggaaactctctgaaccttgtaggtctgaacagcctgaattgatggacttggcaattcctcttaaacctctgcaaattttggcctacctttcatcagtaaggactatct

SEQ ID NO: 118896 - DNA, 1039 bp, Homo sapiens
aaaaacgatttttttttttttttgcctatcaaaaagctgttggcatttgctttaaagggtttcagttgttaaaaccaaagatcaattactgtgctttagtggtcaagtaaaaaggctgtttaagacattgacaatcccatgaagtctatttttaaaaagttgcctttgatattcctttgaacataaatttaaagaaaatttaatgcaaagataagttttatgaattattcttatattgctaatttaaaaattgtaagttaacattcagtacattttaactggattaagatttggctcagaactaaatacacctttttttcttattttgctactatatgctgacacagtgaatttatgtggcctcacagtttggttcccattctcagcttactgacttttgttaagattgctttaggaaaaatgaaaagttcagacaatgaataaaatatacatatatgcacattaatattttttcctattgggctaatagagtgtgtgttatgtgtgaaatctttttgaacagtttctttggagattaagttgatttatgaaataatagttagactaagattgatactaaaatatattgttagaaactaactcttcccttagaactgctgtcttttatattgattatgggaaaaggatggtcagtgtacctgactttcaaatatggtaagattcaaaagtaaattgttaattctgctcctcatccccaccatttgtagctctgtgtgtgtgtgtgtgtgtgtgtgtgtgtgtgtgtgtgtgagagagagagagagagagcacacgcacacatgtatgaggagagagctagcagtggggtgatttgaaagtcacaagagaaataaatgatttgaaaaaaatctctatgacaagaaactcctaattgggttttgaaaaagtctaaagaagtaagtaaactgaccactgtgattcttacttaaatggatacagttctttttgctttttaaaaaccaataattcttgtgaattagttatttttgagaaaaagtatcattttaagttggtataa

SEQ ID NO: 118897 - DNA, 1129 bp, Homo sapiens
tggttttttaatacaaataagtgatgacaagaaatgtttatcattttaaggatttataatgctcaaaatgaatgtgatttatttagtaaaggtgcaataaaaaatgttctcagaggctttctggagagatcttatttgtcaattaacatggcaaccaaatggagctgttgatccaaggtaatacactgaagacattcattcatttagttgtagatcataattctattagggaacatgtggtaacctaagatctgttagactctaccttcattacaggagctataatgaaaaagtactgattgaagagggaacttgcaaagaaatatgagatgctgttaaatgtggtccctcctgcttcagataattaccactttaactttaatctctgatgctcgttgtcttcattcaggccacgtatatatagtgaaggatttcatacctggcaggtaataatagagcaaaaattctaggcccaaacaaaacttcacttaaaccacttttcctgaacatctgctctgaagtcagactcgaccacttactgtgtgactttgtagggcaattagttaacttctcctagcttcatttgcctacgatggggaaaataaatgacagtactgacttcatatgatggttgtgaggaactaatatatgtaaatgttatgtaattcatgtaagatgcacaacacagagccaggaggaacatgttagccactttctatatcagtggcgatggctttacggcatgctacaagctgtggatatgaaaatgagtgaagctcatggcgcatggtgatagtataagctctgtcatacagagcttatcactatcttgtgggatgtcagagtgctagggagacataagggaaaagggatttgctgcctgtgtagggatgtgagggtcatttggaagtggaatcttgaaagttgactggatagtccactcttgatgatctgtgaatttacatattatttaattcaagaggaatatttacattttggcaaatcttgaattaaaactcccatagttacctttgattaattatgggctctactggcatctcaaaatttctatttattttggcagctgacacactggcgtacactttcctttcaaaccaaaatattttcc

SEQ ID NO: 118898 - DNA, 1039 bp, Homo sapiens
accccatctctactaaaaatacagaaaattagccgggtttggtggcgggtgcctgtaatcccagctactctggaggctgaggcacaagaattatttgaacccgggaggcagaggttgtagtgagctgagatcgcaccactgtactccagcctggaacagtgtgagactgtgtctcaaaaaaaaaaaaagatttctctcatttttttttttgtatgctttaccatttaatagtcttacaatcattcgatgactatttttaaactttgccttataagaaaatatagctattttgaacagcacatacaggtaccagtctagcagataactagtgggacaagtttggaaagctttgccacgtttttgcaatcttaagtgatgggaaagaattttttttttttacacttatgtaatgttcttaactaatacagaaattcgttttaatggttttggctttctgaataaatgtgatgcttttgttgaaattattgttagaagtcaaatcactctttgctgagccctgtgtacttacttttgtggtttttgatgtttggtgttaataataacatttagtaataatgtgccttacatagagagtaaaattgctactttgtgatctgtgtcccatctaatgaaacttactgtcctcttttatatttaaatgctattttaaaaagtggtttgtggctgtttgtgtctacaggatcgccccaggacattcgacatgcactcactggagagttcactcattgacataatgagagctgaaaatgataccattaaaggtaagtttagaaatatacccaattgatttcagacaatagttttaaatgtgtattaactatttaatctgatacacagtatggcaaatattatggagtcactttgtatgcagtaagttctatcaattttacacatatacctcttgttgttaaaaaatccaacatacttgatgaacctctatagtggagccatcgtgataccaggtaagagtactacgtgagtactaattgccaagaatgggcaattatctcaaagacac

SEQ ID NO: 118899 - DNA, 1023 bp, Homo sapiens
aggacgttaaatagcaaagagtataatttaaactgggctacaattaaatgtgtgtgtggctatgtaggaatgaagcgtgtttcttctcctcctgtactctccctctcttgactgcggaaatggaacatcctaaacagtctttctcttgccttggcttagctgtgctgtaggatgggacctgggcttctgtgttgaggtaacttctattgtgaggaagaagagggcgaaattgtgtggcatgatttttttgtatgaaaagtgaagggcctattcttaattttgaacaactgcctgctttctgatttacttttgatccggatttgttggattcctcactgtactgtgtaggttgagcttacaaaggtgtggattttgagcagtgcgattaccccctttcagatttggggttgctgttgtttttgtctttgggtttttataaggcggggagggtaaggggaaatgcctaggaaagaaaatcatgtgatgtatgtgaatgccgacatcgtcataggatcggactgaagcctttctccctctagcctctgaatggaaaccaactcagttcaaactaaatgcatcttgtgcatgggccagatcctcatctgccccgtttacttacataacacatactagtcaatcgaaaatagtgatcctctgccctctacctgccacacattcgtgattgaatatttaacccttgtttttatttggtctgaaaatcaaataagcagttgccacaaagggggaatttgtcttatgtcatccatgatgtgggtccgtaattacttaagcagcccctttatcttaatcctgaacattgaacacaaggaatcctattttgaggccatgaaaatcggttatcgttttattctttgttacctgagtgagaggtgagggtaacggtgggcgagtagatgggggaagtattataatagtaaacttttaatgttattagaaggttaaacatacatttaaaagatttttttaatacataattttttcttttcagttgtagtaaagttc

SEQ ID NO: 118900 - DNA, 1084 bp, Homo sapiens
aggggaagaaatgccacctgattcatagttgtcataaaaatatccaagattctctgcatttagtttagcaacaggaacgagggaacagttcacaattgtgccacagaattattacttcccaaaactcctgcatggactttctacctgaatgttgtatgcagttgattcatttatcaactgtatgtgcctggattgtgaatttcttgtttttccccctcacattaccattatccttactaccaaaactaaaaaggaggagagagaaaattctctgaaattgttcttgcttagccctgtacaattagccatacaatttgtaaaaggaatactttttaagaaggtttaaactagtcactacttttcaaatcagacattgagatggtcaggctgcctctgggcttcattattttatctaattgactgattctgaattcagtcctacaccactgcactcagttctaaaagcaaggctttgttttattctgggtattacctggtaaccagtcaattaagaacattagtggaactctgaagggaaagcacttccataatctctttggaatccagttgggttgatgccagttgctgtgtattggaaaagagaaggaggaatcaaccaattagagcccccttttagtgcttgagaaaccaacaataaagagcaagtcttaattctgaagagcagccctgattaattgaaatataaataacttttaaaaatctaacttctgctggctataatattccaaataataaatgtctggcatggttgactaaatagaggtatttaaaccagctgcctgatttctttattgtaatgatcggaagttgttagcatataacagacttttccaaatgttacgaaataaaaggagaagtgttcagggttgtgttcaaacctggtttggccactagtagtgccttagattggtcacttctctctagacctcaatttcctcacctgtaaacggaggggttgaacttaatgatctttacattaccatcagcaattcagtcttacattacaaaactggaggtacagttttatattttaaaactgaaggtttttatggtgtaatgactg

SEQ ID NO: 118901 - DNA, 1026 bp, Homo sapiens
gctgcagatacatttgatactttttggtgtttgtgtgtttgaaatggcagcatttatttttattatttcctgttgaattatcagtagtagtaatatctggattattctttagaaaataacttattttacctaattaatgaaagtaatacttatatatactgctaatgtaaaggaggatttcctctggtcttttctccttttattttttgacttggttactttagttagtgtcttaaaaggatatgatagtacatactgttctttttagcacctcctgcccccacctattctaagtcagtctgttggtaaatattggttcttccaactggcaaatgcttagcatagaattgcctagttgacgtatggatcttttctaggttgtaggatttggtagtgtagatccccagagtcacactgtatctgttgcctatatttggctaggttgagtcatgtcaccaaatatagcctatgccttcggcatgatgtatgccaggcttctggttccaaattctgcagctggcctccagagactactgcttttcctgtcataatgttccttaagattagggctgctgaccaggcagtattttttatatttataacaaaatcaataccaagagccttcaaagattgaattttgctcatcaaataggttcacatgctgaaatcctaatgccttccttctccctttagaaattaaattctgaatgtgcccaaacctggataatgattaaagatagatgagttcttggctgggcaccgtggctcatgcctgtaatcccagcactgtgggaggctgaggtggaggcatcacctgaggtcaggagttcgagatcagcctggccaacatggtgaaactctgtctctacaaaaatacaaaaaaaattacccgcgcatgatggcgggtgccagtaatcccagctactcgggaggctgaggtgggagaatcacttgaacctgggaggcggaggttgcagtgagccaagatcgtgccattgcactccagcctgggagacagagcgagac

SEQ ID NO: 118902 - DNA, 1101 bp, Homo sapiens
aagcatgttgaaagatcccttcattgaaaagataatatgaaaacaaactgtaaactctaaagtgctctacaattgttaaccttaaaatgctaatgaaaagctgagaataattgttgaagatcatactcagaatatatgcatatgaatttacttttgggaaagggagattatttattgagtatgtgactgaccattacatatacacattgtgtttttcattattctctcatttgcttcccatttttataaataaagaaactgagggttagggacataaggaaactagagttgcattctctgctcttttctaaggtaggccttacaaataatagtgtctttatcatatcttaggaacattctttgaatgttgttgtaccaacaagctaatataagcataagccaatgtgataggaatttctaactataaagcaaatgtaaattaattttgtggcagtgagcctattaaattagggattaatttataaaatcatttaaaatggttctttgcatctttgttgaatcgtatgctttggtctttgtgatgattgtgtctgctttttggttctaccatctttattcttttgttcacagattaattccttttagcttcaagcctttgatttatatcttttcaactgatttactaatttggctaatttctacactcctctccccatatattttcttttagtcctcctggaaaagtcaggttgttttgttttgttttgtactgttttgagacggaatctcgctctgttgcccaggctggagtgcggtggtgcaatctcagctcactgcaatctttacctcccgggttgaagcaattctcctgccttagcctaccaagtagctgcgattacaggcatgtgccaccacacccagctaatttttatatttttagtatagacagggttttaccatattggccaggctggtctcgaactcctgacctcaaatgatctgcccacctcaacctcccaaagtgctggggttataggtgttagccaccatgcctagccaaaagaagccagttatctgataacatcttatcatctgagctacaccccccttttttttccagatagaattgctatttgtctt

SEQ ID NO: 118903 - DNA, 1039 bp, Homo sapiens
ttatcttctggtggtgaaaaagtcatgaattaaatattggtatatctactaaattgctagttagcagggaattctgagagaaaacgttattaatatggtaatagttggtttttattatgttgtatactgccttagtttcataatagtttgaaccttgggcaacaattacagcaaaaagcttcccataaaacaaataagattcaataaagttttacagtgtccttgaagaaattttaaaaatgcccaaaattgacctcttacctcccgttccttgtttttttagacatttaccaggaaatgaagaatatagtcacagtttttccattttcaaaagctggtagatgaaatcacagttgattcttttgacaatgtttgaaaggttgttttgtttttttgtttttgtttttttctcatttgacatgcagcaaggacatatgggcgaaggagaggtaacattgtttttaacttttaaatgtatcacttgtatttggagacgacccaagcttgtttaatttctaacctttgtggggaaggggagaggggaaatgaagcatagctttgatccttaggtaatttttgtgttacagttaacattttagacataatttgaaggagttaaggagctataaagaaatttagcagaatggtgggatttggatttgaatcaaaatgatttccctgtgttaaatgagaaactcagcttatttatatctaaagatgtgctttttttcctttctgaaaggaatttcttagaaaaaaattaagaatctttaaaaagaaaaatatagtgacactagtcccaaaatacctcattatcttggaggtttaattatgctcaaatgccttatgtcaacttttttcttttcttttttactaagtaaacaatacatgtggtttaaaatgagatgagctaaataaatgactaatcctataaatttcaaacatttgggggaaaagctctagaaattttaggtaattctaaagaatcatttcgtagaggtacctgaataacttattcttggcacctatattttgcctt

SEQ ID NO: 118904 - DNA, 1031 bp, Homo sapiens
aggattattgcttttaaaaatactttgtaataattgttaacttttttgcccatgaattgtctgtattgagaatgagacattttggtttgtacattccctaggtccagattcggccttggaatctcagtgacagtgactttgtgatggatggttcacagccacttgacccacgaaaaactatatttgttggtggtgttcctcgaccattacgagctggtatgattaaacaaacgacaaactctctaccctatagcgcaagaaatatgaagatcttcaggataaatttttcctaagaattggagttaatatccaagagtgagagttctagaatcaaaatatctgggtttgaattcatgtgttctaatagttaagtgaccttggacaaattccatgacttttctaattcccagtttccccatctgtcaagtagggatgaaaagcgtttcatccctaggatgaaataacaccagaaaaagtatttcctagtgttattttgagggttgaattagacgaccagtgcaaagtacttagtctagtgttgcataatgctaattattacgctcatcattgtctgaaaagaaaaaaagtccttcaagaatagattctgtattgagattgtcagtatttgtttcccacatcctcatttgctcaacagcgactgactgagctctgggatataatagacttcccagcaatgcatcagatttttagggtagtacttacagaacaaattaaattcctaacttcaagtaatttgaggtttaataatatacatgagataaaaagacataacatgaacaggaatgtagctgcacgattttaacacttcataaagaagaaaatgcagtcattatttcaaggtttttttaaatgaaaaattggtgaactgactgtggggaaagagttttgatggaaataagccaggagggcccacaaagagtctaccagttagttttctagtgttcaagtaattattacattaatcaatacattattaactggtaaatctatggcagcaacatggcacagag

SEQ ID NO: 118905 - DNA, 1019 bp, Homo sapiens
cttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaac

SEQ ID NO: 118906 - DNA, 2222 bp, Homo sapiens
gggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaa

SEQ ID NO: 118907 - DNA, 1064 bp, Homo sapiens
gtggaagaaatatgtcttttttctttttcacgtcttctgtacttgtattttagatccccaagtaattacgggtagacttgatgactcctgtgttttctcaaggagtataggtctatgttggtaagacttacaaacaagaaacatttgggaatgatgcaaatatagtattccaaaggttgtaggcatttagagggaaggataaatatgggtttatgaagagcagagtttcccaaacttaaattattttcctatgccatatctgcatatcatctgtactattattaatatatttatttaaataggcacattttcccttttaactaaatttctttttagaacactttaaattattacttcagtggaaaactgtaccatttgctataaatagaaattaattagaaacaaatataataaaggcaaaacaatattattaaattctagctaagtaggttgtctgctgagagttgtctgtggtcacgaagggagacgaccaagtcttagagaagtcttaataacatactggtaccaaacttagattttctcccaaatgtaatcagaatattgaaaaaaactggagagagaatgagtttctcaccatatgagttaatattccttagtgctatgtctgtatgtctgtgacctgctccaaatcagtggcatgtttctcacaaattgcaaaatgccattttagagcatattctagtttattcaacaaatggaatacttattgtatagctgatatctatagaattggatactggatctctagtgaataataaaacacactcctcaagtaaacagtgtgataaatcctatgatacctgagcagagggtgctttgtcagatcagagaaggctccctggaaagctaagtattgaaagagtagaagaaagtgagagatagagtggtggtagggcaggaacaaggtggggaagggttgaggtgagggaatattctagacaaaatgagagccaatataaaggctttcagggaacacacgctcattattttataattttgtctttggaaaaacaaacccttgggttttcttctaacagttaaca

SEQ ID NO: 118908 - DNA, 2027 bp, Homo sapiens
catcggtattgatgaagaaaaacattttaactgcaatataaaattatacattgtgtcacttcatgtagtcatttcctctccatggaagctacattcctacttaatgcatttaacaaagatctacccttgagttatagccttgatgtcattatttcattcctggaaaacaactcatgaattaaaccgtgctctaaagcactattgagttgatattgtggtcagagcgaaattagatgtagtctggtgtgtttatcaaaataatttgtagttctggattttaaaaaaattaagttggataaaatttatgtaactaataatgcaatgtgaattgataaatcacaagttattttctttccttaacgtgcatttctttctttaacatgtctttctttcctgcacatgctatcatgaatgtttctgtgagttcttagtacggtcattctatggcaacttctatttcatagtcagtaaaattgcagtatttaatttcatgaagaatattttcataagataatcatgaaaacagaatgccattttgcaagcagtggaaacttatggttcatataatattgcatcagtggtagcatgaattgtttgcaataatggcatattagtgataatgtgtttcactttgcttatccatttaagaaggagaatgaggtggggggtggataggaaaaagaagtcagaggtatcttaaatgaaaaggatgtttgaataggcagagcagtgtgcaaaaaacctggacatacttctgagtgctaattcagatcactgcataactttgaacttgttgggttcttttctgcctcagcaagaggccttctcttaaatgtaatcttgtaaggattatttaacaacttaatatgctgtgttttccataaatagcctctggtaaaccagttcattattttacattacagtgttaaactacattacagaacttctttataaaactaataattatgtttaaaaatgtattataacttgtattccataatgtatatttattaatgggaaaaccagtgctagaggccaacttaaattttccttattttttatgttgtttgcaggctcaaattacacaagatgaatcttcttatcttctggtaagaatttatttacgtaataattatggaatatagattttattcccttcccttctgtatcctcccttctccaaacattagtgtataaccaatcattgctaattccagcctatttcctttcttaaatacagtgtttggcacatagtaggcactcattataatacttactgacctttaaaacttcatttgggccccatgtccatcatgctattagaaattctctctctgtactccatgtttttccttcttcttctttttctttctttttttctatcgtaccctctgagggtacaatatggtacattattctgagggcagaatcttcttcttttcgtttatacctctacttagtcctcttttcctttgaatatactgtcatatttaatgctatcttactactgctcctttttatgtcttagtatcctgtaggctgtgttatggcccttgtcctgcctcacttaccatatttacctttgctaccacctaataacaaatgctgtcctaggagtgattgttggtcccattctctctttacatattcactctgagataactcacagatttttatagcttcaactactcttcctgggtatattacccttaaatctcatcctacccttgacctctggttatgtacctctggttttctttaggctgttctacttatttctttttttgtcacctctactgaaatctacatacagttatcttttttcttttttttttctttttttttttaaagagacagggttttactctgtacccaacctggagtatagtgactcaatcgtagcccactgctgcctctaactcctggactcaagtgatcctcccacttcagcattccctcccaagtagataggactacaagtatgcaccaccatgcctggctagttaaatttttgttttgtataggtg

SEQ ID NO: 118909 - DNA, 1225 bp, Homo sapiens
cattctgtactcaccaaaatttttcattaaaaccactagaagatctcttccctcccttccctgcacaactaagcatgaaacaaccactgcagaacccaaaccgtaagttgcaaatattagactactgggctaaaataaaatgcctttcatccacacagaggaaagagtcagatatagatttggtgagtgaatgtttctactcatgaaaactagacaaatgacactttgggctggagatgaagagaaggcaggaccacaatgcagtctgaagtctttaatgtagcaggggtgggtcattagcccctactgaaattatggaacagaaataagttaaagtattgcagcttatgttcagtgatgtatcagtaaagaaaagtcttatgtttattatattctatttaacataacagattgaacacatattcaccagaaattattaaacaaaaattaaaagatttagaacaaatatttagaacattcatttcagtgggagtcttcattcctccatggttctagaacagtgaaataaactgagtttgtatccagcattagactcttattttaaatctaacaaatattgatatacctaataaattaaaacagactactatgtcaagttgtataagtcacataaatataaacatacattgaagcaaacctaaaactctcatacacattcactacaaaactttatgcagcataaattacagtataaacagtgtaaatatgtctcattttgcaatggacttcagttgcataagctaaaatttgaagcttcacccaaggatttagcagcctgaaatttacccagcataatataaagaagttgtgtgaccctcaatgcagggaaacttgagagcctacatggcaaaaaaaccgaggccatttccccaggcaatgtgtccttcatctagaaacaggtggatttgataaatagtcactagaagatcatgttaccacaaattctacactgtcgtagtctcctgaagtaattaagttacaactattagaggaaaaaacaaaactatgaattactttacagtccttacaacttgtactatttcatgagaattttgtatattaacactttgtaatacctttgtaaaataattaggaagcccaccttctcaatgcccccaaaaaagaatggatgtcatcactgtaatcatcctggatataaaagtacctgtcactccaagggaaagaagcaactagagtacacaga

SEQ ID NO: 118910 - DNA, 1156 bp, Homo sapiens
cttgcagctgaggagagtgcagcttgtgcaaaggccctgaggcaggaaggaggctagccccaaccctgaatagaaacagaaatagaaaccctgaatagaaataaggacagtgagggccgggcacggcggctcacgcctgtaatcccagcactttgggaggctgagtcggatggatcacgaggtcaggagatcgagaccatcctggctaacacggtgaaaccccacctctactaaaaatacaaaaaattagctgggcgtagtggcgggcgcctgtaatcccatctactcgggaggctgaggcaggagaatggagtgaaccagggaggcagagcttgcagtgagccaagatcgcaccactgcactccagcctggatgacagagcaagactccgtctcaaaaaaaaaaaaagaaataaggacagtgaggccgggctctaggagggtgcagggagcagacacagatgaggcagaagtgggcggagggcagacagttccaagcattgaaggctgtatgaaggcatttagggtttaatactaaaagcaacaggaagcctttgaaggacttcaggaagagaagggacatgattacatttgggttttagaaaaagtatgctggcttttacatggctaatggagtgtggtggatgaaaggggatggaggggcactattaggctactgcagtcattcaagtgaaaaaacacacaaaaaacggtggcagatcagataagggtggccagtgggtggagagatgcaggcagatctaaaatatttaggaggcaaacaatcagccctggaggcagtagaacaagtggtcctgtggatggatgatgcagcagcctggctgggcttgagccttggttccaccttatcctagctgtgtggccacaagcgagtcactaagcctcacttatcaaatggagataatagtagggttgctatgacgatgaagtacaaagtacctgcaaagcacttggatctgtataagtgcgcaatagtagcctttttatgtcaactgtgactgggagctttgaaagtgaacatgactcgtggttggttatctgggaattgaagcgtatgcggggagaaacatgtgggtttgtttgtctttgactatttttctccccactaaatcaatactgaagcagctgcgtatgtg

SEQ ID NO: 118911 - DNA, 1022 bp, Homo sapiens
ccccagtaaactcttcagtctgaaccttatgctccttcctcaggcttcctctgcttaccatccaagacttgtctttcactgtcatgggccactccaacgtccacaccctggggcaggctgttctctccacctggatcccccttttactctctccttccaggctggcccaggagccccactccccagtgccatctccatcacatcgcttctcaccttgccttctatgagtctttcctgagagccgacaccacgtatacgtcatccctgactcccatgtgcctggcccagggccagcgaagggctaggcattcagcttgtatctattgtccagtgaacaattaggctttggcttgcatggtaaaatatgaatgacattttctccattttagttctctggggatccctgggggaaattgttctttataacagaaatgaggccaggaaaatcaattgtgtttctcggctgcaggagatgatggaacagcgtaactttcctgaatatcccagggcacagcactataacagagtggcaagaggtggactgtgctggaggcccctttcattcttacgtgcatttcaagccaagctcaggcgagaactcaccattcagctgcccactgctcatgaaattcaggagctggcgtgcttgcaaagcttccttgcaaagctccttttttctttttaggtcataatgagctggttgggcagctgcttggttgccaatgactttatagttaaacacccacactccaagactctgccttcagtaaatggagggagaacaaaagaccgcaagaaagacaggagaatgaacattgatacagcatcttctgggttctaggcacagtgactgctgcatttgtctacttccttgacctgcataagtgccctgtgatggggacattattgtaatcactccctttgtacagaagatagagaatgagagagaagtgacttgtccaaggccacatgcgttagataggggccatttgtgtgtcttctgagcaatcagtttgctttta

SEQ ID NO: 118912 - DNA, 1047 bp, Homo sapiens
cagtcacatgacaatgactcacaatgccatgtcttgggtctctgcatatccttgagcttgatgctcagatagtcagaggcctctctagcatctccacttggttacctaatggcatctcaaatgtaaaatttccaaaatagacctctgatttcttttcccagctcccttattcctcctgatgcctaaacctatgcctctcccagcttcctcatcggtcagttgcttgggtcaaaaccaggaatcattgcagattccccatgttccctgaatccccacatctaatccatcatcaagccctgctgagttttccagacacatcccagcctgcccacttatcccttctcccaaccaggcctcctctctctcctgcctggactatggtggttgcttcttcatggggtcttctgcttccactcttgcctccttctaatcttttctccacagtggggtcttataaacatgtgaggcttccaatggccatcatttaaacctgaataaaactcaactctcttactaacaccaccaacaaggccttctatcatctagcccttgcctctgtctccaagcccttctcacatcagtgtttccatgttcattatagttcagacacagggactttctttttgttttctcaaacatatcaaggtctttctctttcaggactttggccctgtttgcaccccttgcctcaaacactcttttcccagatcctggcacaatttgcttctcttcattcagatctcagttcaaatgcagtccccttcctgggaggcctttcctaactacgtcatctagagtagctgggtctctgtcatattgctgttttactttcattgtagtgcttattactgcttagtattttcttgtttatttatgtgtccattggttatctctttatacttgaatgtcagcttcagacagcagggacttatctgccctgtgctctactacagtgcaaagagctggattcatggaagacaactgataagtttgattaaataaattgttgaatttgagaataatggatgattttttcaagctttctaa

SEQ ID NO: 118913 - DNA, 1035 bp, Homo sapiens
gaggtactgggtgttggctctataatccacatgagaaaactggggctctgagaggttgagtgcccaaggtcacacagctggccatccatagtccaaggccatctgagtctcagtcgtaaatactgcgttctcaaagacgcttttccttggctatgctgtctaaaattgcaccccccatccccccacacaccctttgtaacacaaactctgggttttttctctttagtgtcttttgtcactagttgaaattaaaggtgtttacatgttttcttctcctcatgtgaacagggcctattttgtgttgctcagcctatctatcccctgcgcataacaattgcctgcaccaagaaggccctcaatgagtatttgttgactgcctgaacgaaaaagcctagctctgcttcactccagagcctgggcacttagctgctccgtaggcaactcttttctgcgcccccatagctttttccctgcacatttctcacagtcctagtccctcttctgcgttgacttctagattttgacttgggtgcctttggattctcccttctttgtccatcccccttttactgatctgcttcagtgttctaggcattgttataggtgcccagggaggatgcaggtaaatgaggaggctttgcagctcctacagcttcagacttgatataaaagatgagagggaactgtttgggaggatgaatggggtggctaccaagaagttctgggacctcaagcagatcctttctctcctcagcactgagcaggtgtctcactttcaaaaatacagtgtttgggccaggcgcggtggctcacgcctgtaatcccagcactttgggtggccgaggcgggcggatcacgaggtcaggagatcaagaccatcctggctaagccggtgaaaccccgtctctactaaaaatacaaaaaattagctgggcgtggttgcgggcgcctgtagtcccagctactcgggaggctgaggcaggagaatggcctgaacccgggaggcggagcttgcagtgagccgagatcgcgcca

SEQ ID NO: 118914 - DNA, 1002 bp, Homo sapiens
aggctccttgagttagtgtgattgtccttggcagacacatcttctctggcctccaagggtcagaattgagtttcaaagtcagacagaactgtgaaggctgtgtcatcttgggcatggtactaaatttctccgagcggctctataaaacaggggaaaagatcttggagggctgtcataaggagttagcaatctaacaatgcatggaaagcctagtgtctgggtgttccgtcatgtcccctggacagtggacagcagtgactgaccggctgtctcacacctgcctggccctagtgaaacaaactgggcaatcagaccctttcataactctttcaaaatacggtagttttgaccaacagctttccagcttaataacgcagttatcattggtactctttagccaagattaaaggtctttgtactaattcctcataaagcacattccctgctaacttgttttctacaaaattttggaaaattctttttttctccagcagttaagcattttcttagcatgcagctaaaaatttgaaataaaatttatcttggagataaattctttttcttacatgtttctgatgatcttcaggaagctcaggagccattcctggccccaggagctgcatttatgcacgggactgtggccagtgaggacaggagcttccactcgtggaaaaccagcttgttaataatgatcccacttttgtttggtaacttaataaagattaataaaggcctcttatactcttcagtttgctgatcctaccaactctatgagccaactcttacctgtgttttatagatgacagaattgaggctcagaggtgtaaagtaattcacccagtcacatgtctagaaaggaaatgatagaatcaggactgaaatctagattatatttgcttaaatccggttctcattccataggttatcagggtagatgctcgggaaattacaccacagggcggggggcctccatcagcaaaaaccagccagaaaaaaacagct

SEQ ID NO: 118915 - DNA, 1032 bp, Homo sapiens
tagcataagtggcatcagccaaccacagaatttttttaagtcccacttttttctcataccccaccaaaatttcttaataccgttaaaatccaaaaatttctttaaaatcattcatgaaaaagattcttagaattaacacctcagttgtccgagcaccaggaagccacattacagctagtgcaatacacagagaccgtctgtcaccaatcattttcttctagcgcgtctgttctagcccctttctcttccctccacaccccattgcaccatttcttcagctcgtgaaaactgagcttgctggacatgagaaacctgccagtgtgccgctgtgtaaaccataacattttgctgctgcctttctgcagtcctgaagccagctaataactgctcagtaagcgcctcttccacagcttccctaggtccctctgtgtctctggtggactggggcctgctcccctgtctcctagcctctctgagtgcctgaaggcaccaccccagcgcttctgcataactctcaaagcctcaggtgaacagggcaaagagagcaccctccccactgactgtctccgcactctccctggcatctttcacttgcttcaggtgccgtgaagctgatgaacccacacactctggaacacattctttggcgtcccgtgtagtgtgtccctctgagggacattcttcatgatccttgccgcatctgcagtgggaacgcaaacatcttgttctccaaaactttcttttgaagtatctgtggtttcatgattattcctgttcccagtgtcagcacaaggctgtgcagcatgacttcctccagcgcagtctgcagaaatccggagtcgagaagcctctgtcctagcactgtccctatcctaggtcatgaaagactgtgattgatgttcaagacacctctgtaacgagatgtttgatctttacccagtttcaaccttccagacaagcccaggggccataatttgccagatggatggctgcataagccagaccatggaaaaacaaaggccattcctgcac

SEQ ID NO: 118916 - DNA, 1038 bp, Homo sapiens
gaatgctgcggaccaaccaagtggcccggccagccctgacccctgcgggtggaaaagggtgcaccctggggatccccacatagcggccaaggccttaaggataccagcatctcgctccctgaatagactctagacacaaaatggagccagcacagggcgcgtctcggcgcatcctcctcagcccaggccccgtgcgtaaggagcgctccgtgtcagcgcgcttgctagaccccattgatttttagagacgggttttactatgttgcccagtgtggtctccaacctcctaggttcaagcagtccttccacctcagtctcccaagtagccaggattacaggtgcgcaccaccacgctcagtgctgttgactttaatgtgaataggaaataagttttgatgtttgtttgttttttaagtggggctcctgttttttaaaaatggatcaatttacctggagtgcaggctgctcctgagcttgaaggtggaagtcagttcatgcgtgaaagaagtcttgcctaattgaaacatggcatcacggttaataattaaaatgttatctgatttgagatcagctgtttttgtgagaatgctaatgtggcattcctgattagtctgtatgtttgtttgtttgatttttaattctgggtgcagaggaacacagattatcaaatccagttggtatttcttatgccactatagtacaacttgaaatcccttttaagtagaggaaacagtgttgtattcatttcctattgctgttataacaaattactacatatttgagtagcttaaagcaacacagatatattatcttagagttctggaggtcagaagtctagaacaagtgggccttccttctggaggctctagggcagagcccctttccctgccctttccagctgctaggggctgcagctcacagcccagcatcactccaacctctgcttgttcccacatctgtttctctggctctgcctcttctgcctccttccatctcttatagggagccttgtgatgacattgggccaaccaaatattc

SEQ ID NO: 118917 - DNA, 2050 bp, Homo sapiens
tactgactatatgtaacaaatttgtcactccatctaggcacaagtgttttaggtgagcataaatttttttttttgagacagagtctcgctttgtcaccaggctggagtgcaatggtgcgatcttggctcactgtaacctctgcctcccagattcaagcaattctcttgccttagcctcctgagtagctgggattacaggcgggtgccaccgcacccggctaatttttgtatctttagtagagacgggtttcaccatcttggccaggatgatctctatctcttgaccttgtgatccacctgcctcagcctcccaaagtgctgggattacagacgtaagccaccacacccagccagagcataaacttttaaaaccttgtagccacttgtctctaggacactggggagatatttgaaatgagcaattgccatattatttgttgttttcttaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggtatgttatgaatatgtagcaacagtgtgtttaccattacagaagctcaaagtatatttttgtatgtaaataattttgttgaaataagtattatttcataagtatatgaagtgacaaacaaggtaattagcttgattgaatcattccgtaatgtacttatgaatcaaaacatcatgttgaactcctttagtatatacaataaaaaataaaattgaagacaataaaaaacaaaaaatggggtattattgatgtaaaagaaaagaagtcatttcacttttagttccattatgtttgaatgttgctactctgggactctttttttttttaacccttcccctctgctaaatagcatcttcttagttgttcaaaaggaggttgaattttttttctaaatcttagccccaaaagagaatgaagtggagaaggaaaataaagagtctgcaggcaaattctcctttgactccattcatatagatataggtataggtataagtgtagatataggcacattaaaggtgtatgtgtagacatagacatatagcattgcaagtgctgttaggagggcccaggaccgcttagcctacaaattgtatcttttttccccaagagaagggatctggcatttattgaatgtctattctgtaccaggctctctacaaattttatcttacttcatcctcatagtaaccctctgagcttggtgttatctatatctacggaatgaggaaactgatgatcccagaggataaaagcttgcccagcacacagatcctaagcctgtgtggccttatggctttctcccttccccagtacgtctcctctctggttactggtgttcacgttttctgttccatgccgcggctgggcccagtgatggtgggtatgtgacggatgcctctgttttaggactacgccggctgtgctgttctggcagtggattaaccagtccttcaatgccgtcgtcaattacaccaacagaagtggagacgcacccctcactgtcaagtaaggctacgagaattgaccactctctgcagttcttcaaccttcattttattaagtggtgatactctcctgtttaaaaaagcctatgtgtgcatatttttatattgttcagaatattatgtagcatccttttttgtagcttttttcttttttaaagtaaagtgtttcattttctctctccctatcaagaaaacagtcttcttccagcctgccttctcagacattactcgtgcctttggaggtactggtaggatgttacctccttctcaccctggagctcatggccctgtagaacacatggcaggcagcaccggcctggcctctgataagtgacaggctgttccgccatctaccctgcctgagttgacagacaccaacgttaagagtagaggagacaaagtgtggtctctgcagaaatcaagggg

SEQ ID NO: 118918 - DNA, 1820 bp, Homo sapiens
ttttttatcacttaaaattgcttttgacaacacatattcttctactattgttatatggaacaaaggatcttgaaatctgcagccaagtggtgtttattgcaattaaaatttcttttaaaagaagagagaattgcttgggctttatagtttttggatgataagacttagtatttttatacagttaagatatcattttttaaatggcagcacttcatttttgctttcagtgtgtatattaatattttgagaaatatttttaagcaaatatgccccaaacatttagcccaatatgcattcccctgtattcatagcttcctacacacagctcccctccttctcacgaatacaaagtctgtatgtttatttatttattttaaccaactcacttcaaagaatacatgtctacttttttggagttatagtcaagatacgtgtgaagaatcccattgtttatggatctgcttgctttttctctagattcccctacttgtggagtgatagtgaatgttgttttgtagactcttcattctgaatcatgctcttttatatttcccttttatttcttcaaataatgttgcaccagagtttcctgacatgccctcgtcgtccacacgatatccttttttcttttcagtgagttgggaacagcttacgtttctgcaacaactggtgccgtagcaacagctctaggactcaatgcattgaccaaggtactcagatttttatttccataataaagctgtttaatttgttatcacctgcctggctctaaatccctctattatttcttaaactagttcaagtcatatggctttcttgttatagtgcttatcttcagctgcatattttagttatatcttccaataagtttgggaagagttgtcaccagtaacacctaccaggactgtggtctgtgcctgactctgtgtacgaagtgctaaatgttcacccatcctgacagcccaccagaggcattgcagagggcagtgtgcctcaggccacagctctgaagagaggcaagagcatctctctctctctctctctctccccactccaaagcccatactcctgcaaccacacttagctacaaggccttagaagcttgcatggtcccagcacacccatgtgggaaatatacaaatactgctaggaaaagttttgaaagcattcttggcctgagtttctatgcaaatgggactctgcatttttcagagttttcaagaagaaataagttatttccatttactagtacaggaaaaataagataaagctcttgaaattttctcctctgcagcatgtctcaccactgataggacgttttgttccctttgctgccgtagctgctgctaattgcattaatattccattaatgaggcaaaggtaagacgaatatgcactcttagtagggacatgtgcttgacaggagagtctcttgtaataattagctttgttgaaactttcaaatgcttgttttaatatgtataggtgaaattatatgagatcttggatttcttttgaaatactctggggttggggatgaggatgggcgtcttgagaaaacaagcttagcgatgagttactgattattgaagcagactgaggagtgcggggagggggctgatgctggaatagtctttctatgtccgtataataaaaagtttaaaagatatatctcaagcttacattgagttgtgcttgggttggacaaagtctatccaaagaaagtttattctctaaaatagattccttttttttctccagaattttcttttggggcttaaagtacattattctatatctttggaagtattgttgtagaa

SEQ ID NO: 118919 - DNA, 1038 bp, Homo sapiens
cttagtggaaattgccttccactgggggtggcagaaaataaacaagtaaataaagtatgtagtatgtgcagtggtgatgagggcaagggggcaatggggctagggcgtgtgggtagggcagccggggaagagcactgggtggaggtgtgggagtgagccaagtgggtatcggtgatgaatattctggcagagggaaccacaggcaggagtttgcctggtgtgttacaggcattacgggtgcaggtgcagctggggcacagtgggaggggtggggagcagtaggaagggagtcaggaggccacagacggcagagcgtggatggcagccctggcgtttcacacctgggttttagtctgagaggtaagaagccaggcagggttttgcatacaggagcagcacagtctgacttaggttttatctgtgtgactctgggtggtgggttgagaataggctgaaggagaatgagaatattcagtggaggctgtgcggggaggctgcctcagtaatccaggcaagaggcagtgatgggctggaccagggccatacagtgggaatttgaccagaaggaactgatggagcaaattggaatggttagagcagctactgataaaatgtgtgccaagcaactgctcaggtttccctatagggactggggtcagaatgaccaaaaatagaaagtctacattgtatttagttctgctgagaatctctagtccaccctaaggctgcttagagctaccttcagaccaggggcctaaagaaagttctcagactgagaaatcagagggcctggcagttagagtgctcttcacagaaaaaaaacagaaattagtatgtttaattttcatcatctaaactgaatgcaaacagcgcttggcaattaaaatgaagctctccaatgaagtatacttcatcagctgctgtcaagtcatccattgatactgttttgcggtttttaaattccttttgtcactgtgactgctcatcagcaggcaaggaagagcaggcaacaaaagttgaaaagtgcatgaaggaaaa

SEQ ID NO: 118920 - DNA, 1189 bp, Homo sapiens
ttgttccaggctgttacacaatgataagatgaataactattgtgttctccccactttcatcttaagctgtggtttttttagctttgcttgatattgtaccctttgatcatcatttggaagtgtgctgccatgcctactcttcccaccgaagccccctacctgccccacgccccacatggaagggcccactggtttcagaaccccattgtgaaggtccagagagatgatcaggacagctcatggctcagtcctggcacctcactggctacaagggagcctggttgtaggtgtactccttcagacctcaatgagagatattgctctgaaaaagtaatggctaactaccattaaggtacccatacatacctaccactccccaagttcacagttgctggtatatgtcggtgttgcatttcacccatgtagagaggaccataggacagaaatgatagtatagtcattgctaaaatagacacagaggcagcttatattaaaatccctacttttccacgttcaaaacactttcacattctattgtgaaggcgggcttcaccatgcctcttccgcaaaggctgaagaggtcacttccttggcagctcatgatgcccatgcggtggtgtgccttggttggccttccgcttgttcccactgccccagggccaggtgtgcctcctctgcaaggaggtacttatctgggcttttaccttagaaatgaccagactcctccgcaaacatgaaactaattgaacattctgggcttttttaaacggtgatgcttggggagcattcagcatgactcatccatccccctacgccttatctctccccaagtggagagctggaaaaaacacatcagctgtgggcaggtgactcacggaaatttttgcagtaaaccaagaagttcaccgcctaaaatctggtgcttctgtgaacagttttcttgaagaatagttcctgttgtctctttaaacttgggtcattcttgatggcactttcattgggagtgaaattgatatggtttgggtcctatgctagttcttgttccttaagttctaattcttttatattcccttttataaaagtagactgctgtgtctactcagtaggctttcaggactgctaattgaatgggaatgtaacatttatttgttcattcatgtttttttcagcagccctttgctgaatgctt

SEQ ID NO: 118921 - DNA, 3222 bp, Homo sapiens
tgctctacagaagctcagcaagtacacagagcatgaattgttggaagtttgtggatggttaggttggctgggatgtaggcaatgtgtaaggaattgactataccatatataaaaattagctctcagtgattcatagaatctaatgtaaaagtctacaactgtaaaacttctagaagaaaatacaatagaacacgggctaggcaaagacttattagactcaacacaaaaagcacagtccataaaagaaaaattgatcaattggacttcatcagatttttaaaattctgttctttaaaactatacagaaaatgaaaagagaagaaacagcatggggaaaaatgtttacaaggcacgtatgtgataaaggacttgtgtccagaatacataaaggaccctcaacacttaagctgggcaaaaggtttgaacagacactctaccaagtacatacagttctcaagcacctaaaaaatgcttagtgtctttagtcgttgggaaacctagattaaaaccacaggagctgccactaaatgcctattagaatgtcaaaaactaaaaagattgatcatagcaagtgttggtgaggaaatggaagaactgaaaccctccccactgctggtagaattaatgtggtacagtcatgtgagaaaatagtgaggcagtttcttacaaagttaaacagatgctgccctatgatccagccatttccttcctagatctttacctaggaaaaatagaagcacatgtccataaaagacgaatattcatagcagctttatttgtaatagccaaaaactagaaacagctcaaatgccaataaaaggaaaatggataaacatcttgtgaatacaagggaatacttagcaataaaaagtaacaaactagtgctacacacaacatgaaggcgtctcaaagtaattacacaaaagaatagatactgtatatcgagtcctagaaaatgtaaactaatatctagtgacagaaagatgagaggttgccatataatggggtgcagggtttatggaagagggaggaactgcaaagtggtacaaggaacaagaaaaacattcggggtggtgaatattttcattattttgattgtgcttatggcttcacagccatatatgtatgtcagaacttacattaaatatgggcagttgtatgtcaataaagctattagatcactggggaagaaagaatttagagtcactaacttttcagggggttttttgcttttttttttttttttttttttttgagaccgagtcttgctctgtcaccaggctggagtgcaatgacataaccttggctcactgcaaactctgcctcccgggttcaagcaattctcctgcctcagcctcctgagtagctggaactacaggcatgtaccaccatgcctagctaatttttgtatttttagtagagacgggatttcaccatgttagccaggatggtcttgatctcttgaccttgtgatccacctgcctcagcctcccaaagtgttgggattacaggcatgagccaccacacccagcctgacttttgagttttttacttcattgaatatatatatgtacatatatatatatacacacacatatatatatttatgtatcttttaaacatataattactctctttaattcatttggacttttcatctaaacttgctctgtttgcacagttctgttaggtaagatatgttcctaccttgagaaatgttgtgaatatctagcgaaacaccaaacatcctcagctgactaatgtggtatcagactttctggttgcaaggtaggggtgaataaggcaggatggggtgcgggggtggtgctggaagaagacatggcatcaggttgggttttgcaggatactgaaattgtctaggggccttggctgtgcaaagagcctttccgtcaaaaccctctgcatgagccacagtcagcacgtagtttgcacatgcccacctccaaggtggcacacagctgctctcttttgagtaacaggttagcccagtttgctgcagaccagagtctacttacaatgaggaggctgctctcacagggtcaagagcacaggctctcgctaagtactatgtttaccctcccatcaccaaatctgtcccagcccagatgtcacctggctaggaagcgctggggagtatttagcatctccttatgacaatccttcatcatcaaacagagacagttgccaaagatacagtgttttccttttcattctatcttttgaggagaggggcccctctgtgtaacctgtgaagactagtttccttgacgatgctgctcccttcctctccaatccatccctttcccccttacgccaaccctcctgatgaaccttttccccagaggagtctctttggggaccagggtatgcctcccatgcatgttgtcttctaacagcttgtgttgactcctaactaagctggctgatttcattacaaccagctcacaccttggttgcagtgatttctgtggccttatttatataaccatatatctcatcactctttatattgtgtatttaagtaccactccttttttaaaactaaaaatctaacagcatttattctccagaagaccaaccaacttgttcatttccattaaaaaaaaaaaaagtgtgactagcaaaaatgttttatgccagaaatagttttaaccatactgacagcaactaaaaccaagaaagacgaggtgtaaagtggggtgagggatggtaagcatttgttgggtttctgatatgttccagccaccatactaggtgctttatgaatgtgatctggcatatcttcatccacacacttttaggaagctgttagtgatgttcattttgtaccatcacaaggaaacggaagcttggagaggctaggctctgcctgtggttccccacagtcaggaactaaccagaaggcgggagacttgagaccttggcaccaggctgtcctacctccccagccaggggattcattacaattaaatgacagctacttccccacctccattatatacccaagcagtgctcagattaaatgggggactgggaggaaaaatagaagccacttgatctttgcgtgtgtgctgatttacagatcaaagaaggttacaggaagttaggctaacacccttgttgcagcatttcccccaaatttcactaaccatgttctatctgaatcttgaaatgtggtgagaggttccttccagttaatca

SEQ ID NO: 118922 - DNA, 3928 bp, Homo sapiens
attatcaatgttatgcatttcactgattgcatatctctttttttatcaatggtgaacattgcaaatgattgatacgtttttcttaggaagtggcattgccacaaatggtttttccaacaccagcagggcctgagagtgtcatcaccatacactcttgccggcaataagagatttcaccttttaatgatatgagagggaaaagttgggtgttgggttctccagtgcatttctttcattatgagtgacatttttctgaaaggaacgtgatctcgttttctagccgcatgaagcatttctccaacaagacccactgtaccagtcctgggatctccacacctgtgccttctccctgctctttctaggtcctgattctcacctctgcctgtgtaataaccctgtcatttctcccttatcccagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttgagacggagtctcgctctgtcacccaggctggagtgcagtggcgtagtctcggctcactgcaagctccgcctcccgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgccttgtgtctgtgtttctcttttctctgaaaggattaatagatctgaagctttgggccactcagagccttccttgatgctgccagagtcttcttatttagattttctgtcttaaaccattggaagcaaaacggttttcccatgacattctggccttggacagattctgttgtcctcgacgcgtctctttataaagtggtaaaagcctgaaattcagggcagctctccatgaggtgctgaagggctcttttcataagaagctaaggcactgctgcctgccccaggtgtcccgctcctctcagagtcctccccctaccaggtagtgtgtagctccatttcagaatgttaacctccagtgaagagctaatgactggttagaagattgacaaactaaccaaaattttacacactccggttatgtgtgtgaaaggttataaaaggaatggccgggtgcggtggctcacccctgtaatcccagcactttgggaggccgaggcgggtggatcacctgaggtcaggagtttgagaccagcctggccaacatggagaaaccccgcctctactaaaaatacaaaaaattagccaggcatggaggcacatgcctataatcccagctactcgggaggctgaggtaggagaatcgcttgaatccgggagctggaggttgcagtgagccaagatcgcaccattgcactccagcctgggcaacaagagcgaaactccatctcaaaaaaaaaaaaaagagattataaaagggatgatgaacatggagctgcatctttttaaacgttgttttttgatgcttcagactcttaatgcttttatataaagctatcaactgtatgttgatcacagtttataagaaagaacaaatcaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaattctctcttttatttgtacataaaggataaagcagtttgtgtgttacaactgatggtacttttcattcaaagttaatatctacagtaccatcagcaactcctaatgaaaagatatttttgtattatgcctttaacaagaaatatatttctattttgggctaccagtctcccacctttttgaacctcatatacataaaggcacacccacccaccccccaaactcctatgacaatgtgattccaggaatattaatgatgggcgtgggggatggatttcagcttgaaacttggatggccaacacctctgcacatgacggtgatggaaacatgcttctatattattgatctgattctaacctggcactggcatttactaacagagaaagtctaaattaacctaagtttg

SEQ ID NO: 118923 - DNA, 1058 bp, Homo sapiens
ttacttaataagtacgatatacattatttgggtgatagatatgataagccttgaccactatgcaatctatgtacgttacataattgcacttgtactctataaatttatacaaattttaaaaaacctggaaaaaactgctgacggcccattatgtgctaggagtttgggctccttcttgcctttgcccaggagccggagacgagccctggggcaggggctggggatacacaggaacagggtgtggtggtcccaatcctctagaagttcagacacaggaagagatggctaataagagctgtgggtggaggccacacaggtgtgggaactgggacactggagctttggctctgagggcggtagcaagcaacagctctgtgtgtgtgcacgtgcgggcgtggatgtgcgcataccagagtgtgtactccggcacacacatacctatttgtggaaggaagcattttcttgggtctggaaaaccccgttaatgttaaaatcactcagactactgacccagcagttgcacttctaggagtctgtcctgtgattccccaaagcactgcttgtgtaggcaaagtctgggaagtgtaaacgtgcacgtgacagaacgtggtgaagccgtccaaaagacttagattgtctgggctgatgggggggcctccaaaagtgtgccgatgctgagtgtgatatgcacaagggagaacacacgtgtgcgtacccacgcatctacacatgttaacactggtcaaggagtggctcaggagggcggcagtgagagggtagggatggctgcctccagggaggaaatgggagctgggacaggatgggagaaaggcttctttttcaccatgtgtctcttgggaccttttcaatctttccaccttgtgtatgtatcacctactcaaaacctaatagatgtagagtttgacaggtggagaatggaaggagaagggtatgctgagcagagggaacaacacacaaaggaatggaagctggaggactagctcatgcttaggagtgagacagggccatatggctgagatgggctccaggctagggtt

SEQ ID NO: 118924 - DNA, 1040 bp, Homo sapiens
caaagaggcctgctgtttgcccctgggcatttagcagtgcctggcagagctgggaatcacctgggctgttgagcgctgtgtcttgggtgtagcccctgaatcgccgtgccagtttctttggtttgagacctttactggctctgtagcctctgactggctcaggccttggacctgggcacctctcagatggttcctcctcagccccttcgaagactcctctcccctcttccctgttccctggcccatccttaaatgctggtggccccttctccttgaggtctacaccctctgccttagtttgctgcccccgcagcacttctagggccctcttgctgatgtgggttcgaggaactaataaccttccgatgtcgctggcagcagggaggcccccacagcctgtctagaaaacagtgaggggaagtgtagcacaaggcttcatatacccctcccctttagccagtaactgtttccagaaattccgtttctagggaaataatctgaaagaaacaaagtgttccctgcatgaagatgtttatcatagggtgaagaggagacaacagccagatgcaacaatagggaagggttttctcctacctactcctgcgcgagctggtgacctctggggctcactgggtgccggacactgttctccagcctctatattattcgctcctttaatccttgtaacaactttttgaaacaggtactagtaacatcccctttgacaagtgaagaaaccgaggcttggcaaggttaatcagcgtgcccaaggtcagccagctccctgaagtctgactctaccagcctcaaccgttaccagggcggcgatggtcagcagtcacaattaccaggtagttgttgggagagggtcaacgtgctgggcagcatgagatgcctgtcaggtggggcaggctgggctggactttgcaatgcaaagtccagaagactgcatggctcctggccctggcttgtctgtgtcatcggcacgggccccgccactcaggcagcaatggcaggtgagggcagagacaatttctgaa

SEQ ID NO: 118925 - DNA, 1046 bp, Homo sapiens
atcattcactctgtagtttgtactttcatgtcgggtttcacattgcatggtaattattatttttctctatgtttggatattcccaatagaggcaagccttgatgaaacaaaaggagcccaagttttgagatcagacagacttgggtttgaatctcaacactatcccttcctggctgtgtgactttggataagacccgtgaactccctgaacctgagctgcaaccgtaagccagaacacatataaagtgctgaataaatggcagctgtcagaattcttatttaatatgtgcatcccattgggttgtacatttctgctgatgcatcatttttttctgagattccccaaggctggactgtgtcttgttcaactttgtcttcgcagtgccccttgataagtataagaatgcgctaagagttggaagcatgaataaatcatcttgtacttttttgacgttggtcgtaatttttggatcattgtcagaggccatcggctgcttccttgaaagtttcagggaggctgaggggaaggagagtgaaggaggcagagtttggaaaaggatgggggacagagaaggacaagggggaagagagaaaggcaggatctggagcatctggatgggcctgtccttactcccttggtggcctcattaggtctcggagcctcattagctctcggagcccaggtgataggatgctgctgtggcagatacctgggagactgaggcaggctggtggagatgcagctggtctgtgagctggaatgtcagggcctgtcagtcactcaggtccctctggctgggaatgaagctggagctagaagccccaagagagatgacaacagatgcactgatgggggccggggagggagacaatctttcctgagtacctgctgggtttttggcacaatgctgggcatgtctacacccatcctcatttcctgttcacattgaccctgaggagtaggactaactcccactgagttaaagataagagactgaagcccagagaggctgagtattctggccaacgtcacacagctagaagag

SEQ ID NO: 118926 - DNA, 1037 bp, Homo sapiens
gagagaggggaaaggtgccaggctcttttaagcaccaagctctcatgtgaactaatagagtaagaactcattcattatcatggggatgacactgagccattcatgggggtctaccctaatgacctaaacacctgccactaggccccacctcaaactttaggaatcaaatttcaacatgagattgggtggtggggggcaaatgtccaaacaatattcgaaggcttataagaaaatggagccaactgagacagagagagagagagagatttctgatgatgtttgaacatgtagtttcaggtgtgtctgaaattatatctgcccttaaacttttcagtaacactttggaccaataaatacccacttcattgatttttagtttagtttagttttttgcttaacatgccattagatgggtatctgtcatttacaatccttacgataatcccatgaggtagacatttattattccccttttacagataagaaaactgaggctgagtgaaaagtgactgcttcaacccacacagctggtaaagggccaagcgcaataaaaatccaacccttttctggctctgggcccagtgagttgcacattccatgccctggatgagttccatgttcctttccagctctcagattctatctccctgtgctgtctcagaattggataggtgccaggtcgggggcagcaggtagtggaccagctgctgcctgggtcaggagcccagcatgttctcaaggacacagatgggctggcagccttgtgctctgggcagggagcctaaggcgggggtggacactggtttctggagaaaaagctcattcaagactcactgatgcccagcactaggctccaagcctccagagccaaggtttggcacggcttctctttatgtgcccagggcccagcgtggaatgtctgtttaactcagctcttgagagcgcctacacaattggagggaaccccctttggtgatggtgattgtttgcttaaatgtgtgtgtgtgtgtttgcagggggaagcatggaaaaacctg

SEQ ID NO: 118927 - DNA, 1006 bp, Homo sapiens
aggaaaaaagcggctgtggctgagatgcatcccagaggggacctggacaaaaccggcctcaggtcctgcttccagaccccttgtgcagctttggctctggtcctttcctgagccctgtgtccagctttccctttggttctgggtcccatctgataacctcgataacccccttttctgtctgagtctgacagagttagtctctgttgcttgctatcagtgtaccctaattcacacccagcccctctctaaggctgctgtgaactgttgaggttcacacctgattccttgaacaccaggctgacacgggctgcctcttcctgtccctcagctccttcctgcccccgctggataatccaagttatgatcaaccactggaccacagcctctaattaagacccccttctggatgtaatcaaccttgccagaaaccagaggcctagggtctgtttcagatccaccctctggtggtagccctgacctcactgactgctggccaggctgctgtcctggtctctgcactcccggctcaggcaggaggctctgggtcacctgcccagcaatctccctccttcttaggatggggcctcctttgccctccccagggtgaggactgccccggaggctgtggtggggcctggagacattcctgcctctgggcccagcatgggctctggagccatggaagcccttgcaacacctttgccaggtgactcttgcctcagtcatacaccacttctctctgttttcctcatgtacatcttgcatttactattactcactttatacttagcaagagtaacaggttcattttttgacctttaatacatatatttggaaagagaacataagatccttctcataaacaggaatgcagtatcctgttctgtaaatagaaggccatggttaaaaacaaataaatggaaaataaaacatcgtttatccacttccagctagttactgttgccggctgaagtctgagcctcttccttggaaaggaaatcaagct

SEQ ID NO: 118928 - DNA, 1067 bp, Homo sapiens
gcatttattgaacactactgtataccacagcaaatccatgactacacccagactcagagggacaaagaggcttgctcaagttgtccgagctagcaggtggcagaactgggatttgaccctggcctgcctgatttctcttccccaactgttctaggagcctttgctgcctcagccccccaactcaatgccactcccccatgcctgtaagctggacttctgtcttctctgtctgaaaagtttgcttttgcactgaatccctcccgggctgctggagtgtgatttgctgcctgacagctggaagtcaaagcagcaaggctaactccatcctgcaggcctagccaagctcaggggccctgaaagtttccaggggcagttagaccaagctgggcaaccttgggcacgttgatcaagctctctgaacctcggcctcctcatatgtagtgcagggaggctacttctcctatttaggaggcgttgagatgaatcaacaaggtggtggcaccaaggaagcaaaagggagacccccgcctggagtctgggtgtgtaaataaagaggcgtggggccaaggagggctttaggggcctcgtcccaggcgacgtgaggccaccgcaggaagtttctgagcaggggagtgctgtgaggcgaggagtattttaagaagattcttctggcagcacagaccaggttgagttggaggagccgcgtgggggagtgcgagcggcgcccatgcctggaaaactttgcaaatgaggccccctcttggagcccttcaggatccaaggcaatctgagaagcaggggctgggtccgaggtctcacccccgacacaggttgcatctacaacctcagggccatcagcatccccagagcaactcagacaggctcctagtccatcacgacgtgccttcgctcacagcatgcgtggcccactcagagccgccgctaaagctaggatttgaagctgggtctgtaggacatcaagtccagcgctcttccatcagagttacacatactccaggaaccttgcctgagcctcagatgggcatcttactgccctcaactcagcc

SEQ ID NO: 118929 - DNA, 1049 bp, Homo sapiens
gtggctatccagcactctaattagctggctatggatctaatgcccacccatggcagtaggacatagagtcaaccccacccaaaccacaaagactgagggtggaagaagacaggaactccaggcaacactagacaggtcaaaaatgtattatgaccacagcaaattacaccagaaacatcccaatgacataatgccatagtgatagggtgagagcatggaaggatctcatggggttatgtgtgtgggtgagaaatacaaaaaaaaaaaaaaagcttcagaagaggcaagtgcaagatttaaacaaggatgccagagctattattatgctctgtgatccagaaagtggcctcagtctgcaaatcctgcccctgagatggggacctcaaaggccatgggccaagacaagttatttcaaccccaagtaggtggggcaatgccaggcatgtattctacctctggaaatatttgttgaccatccacaatcaaaaaagccttgggcttgatgttggggattcagggatgagcaaggcatgcacttgctctcaagcagcttaggatccagcagcaggagacaaccaaacatagggtaaaaagggcgccccagaggtgtggagggctctgcagcagggagcactatgtgggagaagagttgaggtaaacaggttgacaaaggaagcagaagtcagatcaagaggggccctagtaggtttggacccgatgctgcaggtaatggtgagtcactgaaggcctttgagcacaggagtgacccaagcagggtgacgcttcaccgccttaatagagccagacaaaggcccagtggagagtcacagagaggatcaaagggctggcaataggcctagaagggagacggcagagggaaggctagaaagctggaggcggggagagccttgatcaaagtcaggcaggggagcacagcggcttcctgacgctggacccaggtggggacagagcggccctgtgaagtcaaagagaatgttgctttgttcagctctcactgggaaaggtgagtgttgcacagatgcacccca

SEQ ID NO: 118930 - DNA, 1030 bp, Homo sapiens
gctggatgtaaaaatccttggctcgttttctcgcttgtgtatctttcttaaatatggtactccattttcttttggcattaagtgttgctgtcagaaagcccaataatctaattttctttttctttaaagtccactagttttgctagtctctgtctcgatgttggtaactttggttctgtagtctcaggtatgtgttgtgctttttaaataatgtagttcaaaatctttttttatttcaggaatgttatcttgaatgacagttcttggtggtggtctattatctttgcttttcttcttcatcatctcctattattgtttcagcaccacagtcctcttctgcagtttgatcgctgtcttttttctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggtaagtgactctatcagcacttcccttgttgggtacattaattttatttcatcttgagtgacattgttccctcctcttacttggtaattctcttgtctcttctgtccactctgtatcataggctggattggcctgtaagaaccctcagtttcagccatgatgggaaaatgctggcgtcagcatcggaagatcattttattgacattgctgaagtggagacaggtaacttcatgagaatctaccgtctttcacctttggcagtcaggacttctcttgtgatctcatctctgcatgtgactacttcaccagcatgatcatgaatgaatttgtctcctttagacaagtatgtttctgttttgactgtcactgccaggtggtgaggaagcaaagagttaagaaataaacaggcaggtctgaggaaagtgatttagaaaaatattttgatttatttaaactttaaactacagagtagaaggaagaaaaaagcaccacttggggtccc

SEQ ID NO: 118931 - DNA, 1010 bp, Homo sapiens
agtgagcgtcgcctcgtttgggggcgcgcgtcttcgcgaccctcggctgggcccgccgcccgcttcccgcccctggcgcctcacagctgcagccacttcccgccttgcctccttccgggcctctcgggccccggggagcgcggcgggccggggcaggggccagggcagggaccggggaggccgggcctcccaggctcagcgctgaagcccgagaggactgcggctggaaagcggccgagcacatggacgagctcctggcgcgcctgctgcaggggctggggtctcaggccggggccgcgggcgtcctcggagcctcggcgggacgtgggggctcgggtgtactggccgggccgatgcaggaaagcgggagcgcgtaattcttcggcctgtggtggacacagatgtgtgcagggaggtaacaggagcccaggctgggagggagggaagcgcgggcctgggccagatggtggccgcgctccagggcctgactgcagagcgaggggcccgattttggagttgtacaggagggcgatttatttcctcagcacttaccctgtaccaagccctgaaggaatagggaaggaaacctcgcgcgctatttctgtttccctcagaaccccttcgtctttgtcgttcatgaggtggtgaattatctgcctttcgagaatcctgcatcgatgtttattgaatccctactatgagccagatgttgtaggggccggggatacaacggcgaacacaatatccatggtcccctcagaaggtgatacatcatcaggtggttgttgaggacctactcaagcggtgggaggtggagctttctctcagaaggcttccaacgatctccccagcctcccagagccatcccccggaaacacaaggattatcaagctgatgttatgtgtatagatcatacagtttaccatgcttcctatgcaaatactcgttcaagacgtttcctagcttctgctgcccctgttccctttctagctggtttacagtccctaaac

SEQ ID NO: 118932 - DNA, 1219 bp, Homo sapiens
ataatgcctaccttatcaggtcattgtgaaaattaaagatatgtgaaaatactcaacatgttcttagcacatagattctttcacatttgcttcacttcttatttagtttttgttgtaggttatcctgtgtatttgaccttccaaacaaaggttgcttttgactttatgacttaaggttggaatatctcctactactcccctgtcctccttggaccagaaaaaaaaaaaatcccactgtgatcctagtcatgcgtatgtggcatttggagaatttaagaaggtatagaaattgacagctttggcaatactattgcttatgttacacaagatgtgtaacttatcagtgaggtgaaatggtaaagtaatgcttatccttaaaagctaagacttaagtcatctcagataaagctaatactcccatcttgacctcttttcttcacacaatccttcaacaggacttcattgacttaactagagagaccagaccaaggacaaaagatcgcagtggactgtatgtgattgacctgacaagagctgagggagaaaatagacctattgccactcttgacttaactttagaacctgtcactccttcccagaaggagccaaccagtcttcagacatgtgccagcctctctggcaaagcggtgatggaagggcacgtggacagaagctctcagcctacagcacggagaatcattaacagtgatcctgtagatttggacctagtggaagaaaacacctttgtaggtcccccacccgctacatccatcagtggaggctctgtttatccaacagagcctaattgtagctcagccacattcacaggtaacctcagcttcttggcaagtctacagctgtcttcagatgttagctccctctccccaacaagcaataatagtaggagcagcagcagcagcagcaatcaaaaagcacccttgccatgcccacagcaagatgtatctcgcccaccacaggccttgccgtgccccctgcgacctttgccatgcccaccgagagcctcaccatgtccaccacgagcctcctcatgcccaccacgagccttgtcatgcccatcacaaaccatgcagtgccaactaccagctctaactcacccacctcaagaagtgccatgccctcggcagaatatcccaggcccacctcaagactctctgggcctacctcaagatgtgccagggctgcctcaaagcatattaca

SEQ ID NO: 118933 - DNA, 1872 bp, Homo sapiens
cttcaacgtattctagaacctcttatttttgtatactatagaaatcccggctcggcgccgtggctcacacctgtaatcccagcactttgggaggctgagacaggcaaatcacgaggtcaggagattgagaccatcctggctaacaccgtgaaaccctgtctttactaaaaatacaaaagaaaattagccgggcgtggtggtgggcgcctgtagtcccagctactctggaggctgaggcaggagaatggcatgaactcgggaggcagagcttgcagtgagctgagatcacgccactgcactccagcctggggaacagagcaagactccgtctcaaaaaaaaaaaaaaaaaaaaaagaaaagaaatccctcctaatttccttctttttaatctctacagaacaagggtcaaaaattagaacccatccctcatcgaagactaagaatggtaacaaataccattgaagagaattttcctctggggactgtgcagtttttgatggactttgtgtcaccccagcattacccaccaagagaaatcgtggctcacatcatccagaaaatcttgctcagtggctctgagactgtggatgtcctaaaggaggcctacatgcttctcatgaaaattcaacagtatgaaccgtaacctctggctgttggcgaatcttctagggatcttggactcagggcatagctttctcttgacaggcttttttaacctaaccgttacagtgggtgacttagcatattagtgttatttgaattgcaaatgataggaaacccagtccaaacagaccttaactactgctaaaagagaatttaatggctcgtgttactagaaaccgaggagtgagatgtgacttgattcagtatacaaaaatggttaccagggttcattctgcagctctacttcggttctgtttggggctgcatgtggtagcctctcagcctcagttctgttttggggccgcatgtggtagcctctcagcctcagttctgttttggggccgcatgtggtagcctctcagcctcagttctgtttggggccgcatgtggtagcctctcagcctcagttctgttttggggctgcatgtggtagcctctcagcctcagttctgttttggggctgcatgtggtagcctctcagcctcaggcttttatgacacttccagtgggaaagagtgtctgcttcctttatagtcacccaagagttctgaaattgagtcttgcaggatttaattggcctaatgagagacatgaccatatctttgagccaatcaccgtgaactgaggggtagaacagcacgattggctaaaaaagccacatacttcattttggggttctggtaggtaaaactagttggttaagagtagtgaagagttggtttcttaagacaaaattatagtactaaagctttccaaaaggggactggatactgggtagcaaaaaacaatgaagttccactactctcagattgacatggtatgataccagaaagtgagcaagagcatggaggataatggaggataggaagaggcttcttccttctatcaccttcagatcctatcccttcttccgctaaattctccataattctaattgatttcacttgactttcaggctacatccagccaatgccaagacagtggagtgggactggaaactgctcacctatgtcatggaggaagaggtaacaacaattataagattatatcttctgtaggggaagttttaactataaagaaaagtgatatcaggtgccatggctcacacctgtaatcccagcattttgggaggccgaggcaggaggacagtttgagcccaggagttcaaggccagcctgggcaacaaaatgagaccctgtctctacaaaa

SEQ ID NO: 118934 - DNA, 1609 bp, Homo sapiens
tgagccgagatcgcaccactgcactccagcctggcgacagagcgagactctgcctaaaaaaaaaaaaaaactcactgctattcatcttctctcctcttctcttcttccttgtggatatttttcaaaagttatttattataatattagtggggttttaggaggaaacaaaattcggtgtgtatattaaatctactatttttacctaggttacctaagtgatcattaaaagtagttttgactgtatgtttttaccttattaacttgtagagcctcagccctgtataaagtgtgattccactgcacacactctaaaccttagttgttaacattaataggtgacaataatatagagctggcaaggacttctgtggtcacccagtctaactttccacttggtttaggaatgttcctggtcaggaaggcacagatagtactattttaccctgaagttacctttgaatacttacaattcaaagaaaaatgttgatattttagttagctttttttttttttttttttttgtagagttgggttcttgctgtgttgctcaggctggtctcaaactcctggtctcaaaagatcctcccacctcagcctcccaaagtgctgggattacaagcatcagccaccatacctggcctttagttgacttttacagccttactgcagttaaatgtgatgtttttattagacttgtttaattattgaaaatagccagagggcccttttgttgcctgtagggaaatccagggatctgggggcccaggttaaggctatagttctgagcaccataaatacaacagacatggaaaccttttctttctttattttttttttctgcacagaaaaagaaagaataaaccttttctttcttttttccattacagggatgttatcaagtggctggtcaaagcagtaactgaagatggattgactcagcccccaaatggaaatcaaacgtcttcaggaacaggaatcttgaaagccagcagtagccacccttcttcccagcccaacctgacaaagaacaccaatcagctgtaaggggcaggcagttctctttcctggggctcttggggtttagtgttttagagagaacaacaccaatccctaagagcagcttcccccaaattaacaagatcttagaacataggctgatgcttattcaagacttagtttaactagaggctaaatttctgatttcaaaggcagaacaaaaccaggtgctttcacccctaaaatgaataggacttcacaaagtgaatacgaagtcacaacgcagatgcaaaacaaatgctagaggacactgcccttcacttcctgcatttcaggagacagtaaagggttacagctcctcatcacttcagatatctgttgccatagagaaggagtggtgtgtagtgtgagttttgttaacctcgagtcctcaaggacctgggtttctctcctcaggtcccgggagaaaaatagcattcagcctgcaggttccaacacaccagggcaggtatcatcaccgcagactgcactggaaagaaattcatggcatttcttttatggagttgagagtggtcttggcgttttttgagagatgccgggagattaggggctg

SEQ ID NO: 118935 - DNA, 1023 bp, Homo sapiens
ctgttcaactatcagctttttgagagtggttccttttatttatcttaatattccttgttgtgccaaatagtatttggcacatcattggcattcagaaatattctcatgattaattttcatagtgacaatgtgtagtaattatttttaatgtgtcctaaacttgtctttgtcaaatgtgaaagactttttcctcattctagcagttgctaatccaacaaacccatttctaccctgtccacaggttttgtgattctgtgggcttccatggtattccttcttaactgtcttttttaggacaaatgttgtacattcagggtgaattgtggctcatgttctttgaagcatagttgtgatgattaactccctcttcctcttctccacacagagaaatgttctttactaccatggaaagccaccttctgcgctgcaaagtgttagaaatcatattcctccacagctgtgagacacccacccgcctgcctctgtctctggcccaggccctctactttctgaataattctacgtcactgctcaagtgtcaggtacattttttcctgcccaatttcaggcctagagcacctctctttgctctaggcccgaacccttcccataggattttagcttaaaacacaactgtttgagcattctgtaaaggtgaattgaaaactgtacaaaaattttaactggggaaggcatttattatcaatccattttactatctctgcagtcagataaaagccagtggcagacttgggacgaattggttgagcatctgcagtttctgctgtccagttatcaacatgttttaagaggtaaggagcatttgttcacaagtggagtagtggaaggtctcaatggacatttgtattagtcataactacacaggatattctgatttgttgacattgttccttggttgtatgtaacttattataagggataagaaatgacatagccggagtcaccactgtgaaaagaattcacatattcttgttatggccgacaatacatggtcctcatagt

SEQ ID NO: 118936 - DNA, 1026 bp, Homo sapiens
cttgaatgaaaatgttaaacatgtgatgcacagagtattaacctgtttcaaaaaagtatagataaataatttattaaaaaatatatataccttgtatatttaagccatatttgagaacaggctaggataggattatttaaaaaaagatatttactagagttagaaattacaacctactgattaaataatgcaggtttggtcctgtaagattttaaccacttttcatgcttttagagcttctgagcagttggagagagagttcaggaggtattcttggcattcagtgcttggcaggccctcaggagccgctccagcccttttgaaagggctctgcatcagggttcaagtccgcagcatagaagagcaggagcttcaacaagtgcactttgtcttggagttgggggacaagaggctcccccagcatctggatcaggcggctgcggaaggcctcaatctgcttctctacgtctaccactgtgatgtcatctccttgctggggtttgggcttaatccttttgattattaagtcctttcggtcgatcacggaactccttaagtgttctgcaagagggaaaaaagtcagttgggtgctctgaactgctttttaattctttttaagaagtctaattttggtaggtagagtcttggcaaagacttgctgactagctacagggatacaagtcgaaggctgtgtgagtgcctgcagtaactccacttccaaaaggccctttgttctcagttctctcgggtccttaagaagttttacattaaaaaaagtgatatggtttggatctgtgtcattttttatgatcacataacatggtcaaaaaatgaaaatactgaggaaacaattagacatattcatctagtccatgttttagccaatagtatttaacatgagtatgatcatgaataaacaactagacagtcccaaattgtaatccctgatgttggaggtggggcctggtgggggtgatttctcatgaatggttgagcaccatccccttggtgctgttctagtgatgg

SEQ ID NO: 118937 - DNA, 1214 bp, Homo sapiens
tccaaaacccaggcttctttattcctttaccactatccatgtgagcattgacaaatcatggcttagaggtgctcactgactcgctaagacgactttggccctgttgatgactggtgctgtgctccagccttatcagttaggggacccaaggtttgtttgggacctgggtacaggtaaaagccagacttggcagggacccctctttctaggctgaaccttgagtccccctgctttttggcagacctaatggatcactgtcttgcagctagttcttcatgtggggcctcttaggccagtgccggaggaggcatgctcctctttctatgccacagaacaaacactactctagcagagcctttcttgcactttaaagtgagattaatttagctgtaatttggttaaaaacttcctaagagagaaaattaagtctactgatttggtataggtaaatggacattaaacttttttaaagtaaaggagatggtagataccgttagattatagtcttgaggttcatgtgaagccagtggtgttaacttactttgatttccttgttcaggtcagggcctggaacgcctgtgcggggaggtcactcaattcaaaattttctgtatgaaagcatttttcaccaaaatgagcctcatccctttatgcaacacataaccttactgagggagggaaatacagaagccacctttttatttctcttcactgtgtacaagttcacttgttgtcttgaacactgtctcaaatacctgctttttgttttggatagtaccttgtctgtataagaagctggcctttccatagagaggccctggagtctaaaattatgagaacaattaatttatttgtgtcttctattatgatctcgttttgacaataaaaatccttactactttctcaaatgtggctatttttttgtccttttaacaatagttattccactctacccacccagagtcacactgaacttggtattttgaaaaaccattgcctttttattgtctccttttaacatcaaatgttttataacacacttgatccttttgtttctaccccctattcattacagtcaaattaacaggcaatataataggtctaacagaatgcttgcatttcattagggaaaaatgaacgtctctctcctgaaacaggttgtcggtaccttgaatgacataatattggtgtatagactaggttcagcagaggga

SEQ ID NO: 118938 - DNA, 1014 bp, Homo sapiens
tactgaatcaaactctgaggtggagcccggcagtctgttctaatggctggcacagggtcagaaccacttagccagtgctctcatcaattaagatctagcatagtgcctgggatgtggtcagtgcttcgtaataagcatttcttctgcattcttagggcatagtactatagtatatcggaagatcatagtctgggaaggtagtagacgtcagagcttcaaattctggctttcccacctttataaatgtaaactattcacctaatgtctttctttgttgtctctatggataatacctatctagctgggtggagatgaccaactcctcccttcaatgatttcctcacttaccagattaatgttatttcagtaacttcctccccaaaggagtaagtttaggtgtgtgactcccctgccctgcctaagtgcttctgtactgtacctctcttgaacaggtggaggaaggagaggccagtctaccctcccctgccatgaccctgtcatcagccattgacagtgtggacaaggtcccagtggtgaaggctaaagctacccatgtcatcatgaattctctgatcacaagtaagcactcttcaccctcagagtagagtgccataggggcagggaagagttgaggcttcctacaagctgattggagatgatactgcaacacgctcgccttaccttatcctaaaaaatgtcagtttggctgctgaatcatgtcagtattgaagctccatttattaagtggaagatttgccaaatgttaagcatcttatctgatttaggtgcattcctgctgctttgttgatatgatctcatgttcccagctctgtcactgtggccttgggcaagctacttaactacagagactgccccgctctaaaatggggaatttcactggcaggttgaggtgaggatcagaaggcccagtgctcagtggcggcagctgctgctgttactgtttcaagctctgctggagaaggggaaacatccgggcatttcccacttacccca

SEQ ID NO: 118939 - DNA, 1010 bp, Homo sapiens
ttcagctactagtacgaaccctgcctaaccccgctgttttgggagacagtccgtgctcactgcaccgcttgctaatcgaagtgacttctcatctctcccagtctcagcttcacctccgtgaagtgggaaaaacaggatgacaagtgctcgcacttggcagccctttttgagccttgagggcttgggtttgtgggtgtcattttactatgctacctccgtcttcccttagcttgtcacggacccaggcacagcacacgcgctgaggaagtggtggtgaagtgtggcgtttcctctcggggctggcggattccacactcggagctgcggctccacaactcgctgggcggcgaagggcatggggagggggcgggtctcgcgatcgtggacaacaactcccagcatgccctgtgctccgctgggccaagtctcgcgcgagatcccgcggtctccggaggctttatctgcagtgctgcctgcccgctgggtggtactgctacctagtgggtcttggggaccttcgaaatcgccgccgctctcacaatggcttgggtccagactgcgccacagcctctcgggagacgtgggccctcggaacctttttagtgccggactccgggccgcaggcagtcccgcggcagcaggatcacaggtgaacagatggcgggcctgggccctcccttggggctgcgttctctggcgatcaggaggggcgcttccggcgaggcccgatctcggggcccctccaagccactcccctctccccgcacctcttaacccttcatcccggcttcgagctcggctgggtcgcctcttgcctccctggctccgctctctggggtctccgtaatggggcttctctccgggaatgccctgcagctcccgtacgggcttcccctccgcttcgtgggaccagcccagcccgagcccccgcggcttgtcctcaacctcatctccccacaccccgccttcggctagggtcctggccctaatcttagcctggaggggtgggt

SEQ ID NO: 118940 - DNA, 1100 bp, Homo sapiens
caggattccaccacaggaggtggaggttgcagtgagccaagatcgtgccactgcactccagcctgggtgacagagcaaaactccgtctcaaaacagtggctaatgatgcaatgaaaagaggttggtacaaaggagagcccagggtgagggagagagcattgagtttaggccaaggggtccagaggctacttctgggaacttggggcctgatattcccggggatagcctaagaacagtgtgtttcctgatattcccggggatagcctaagaacagtgtgtttcctgatattcccggggatagcctaagaacagtgtgtttcctgatattcccggggatagcctaagaacagtgtgtttcatgaacgacaagggtgtcagtgtgttaggaaatgctgccagctgtgttcggacttctgtgtctcacccaggacctgagcgaggccatgagtatgggggagctgcagcgggagctgggtctacaggctatcgataaccagcgggaggttttcctcttggcagccagcattgcccctgcaggacccacctttgaagagcctggcaccgtgcacatctggaaactgctcttggagctcctctcctaggctggagctctcctgcttgccacctgcctgtcaagaccatagttgtactgctgctgcttcattgccagactgggcctggggcaagagccacatggcagcatttcccttttcccctcctttgcctttcaagagcagggcctgggcaaggccaagaaccatgcagaagccttcctggtgaggtggccgtgaagccgaagcagggaggtgggtgagacagagggtggggaggatagtgtctggctcattccaggctggaatgtggatccagctttcccttctcttacctgtacagtgagatgctcagtgggctcaatcctccactacaggtcccggtacctgaggaaccagtgtaggtgtcagaaatactcctagagcctcaaggtctcccagtccagaaacagtctggtgacgtcatgcccttctcatgtgggcagcttctgagtggtgacacagcaagcctttgttcctgtcctgcattgtccagccccagctccacct

SEQ ID NO: 118941 - DNA, 1772 bp, Homo sapiens
tggctttcactggggaaaaattgggtccagaaaggctgagtgatgtacccaaggccatcccgttggctggtctgctattcctgtccttaggatcacataatacaatttttttccatctttttacctagattcacataagggaaatcctctcccagagtcatttcttatctacccagaaggaatttgcaccctttcaacatcctgggccaagtggtggcgtttcagttcatgtgaatccatgtaaagtactatgatatcgacgacagcctcaaagccaggtgggaggaggaacccacaactttgtctccactgacatctgtatgttatctcattgtcattcatgattccagctattttcctaagttccaaattttctatgactgtcatctggggttttgaaaacagcacctagaaacagagcctagaactctggcctgttctgcttataaattaataaataaaatgcagttctgaggtcaacacctagctccagttgactgtcgtcccagggacacaggctccttccttcccctgacttctgtaaacatgggcactggcacagttagtacgagagcagcagcttgtctccagattagaggggaaaaacccagccttcactttttctgtttggtgggtgaatatcagttattctgtagtcaagagaggctggcaggccaggcctgggctcagggaaaggcagggaggtcttcagaaagctccttgctaggatggccaggttcatcctagcacttcacactcccatggctgggaaaggcatctccgaattaggaaaccacctccctttaaaaataatggccctggggtcagagaggcagagattgcacaaggccacaagtcacttaggtggagctggggctggacaatgcaggacaggaacaaaggcttgctgtgtcaccactcagaagctgcccacatgagaagggcatgacgtcaccagactgtttctggactgggagaccttgaggctctaggagtatttctgacacctacactggttcctcaggtaccgggacctgtagtggaggattgagcccactgagcatctcactgtacaggtaagagaagggaaagctggatccacattccagcctggaatgagccagacactatcctccccaccctctgtctcacccacctccctgcttcggcttcacggccacctcaccaggaaggcttctgcatggttcttggccttgcccaggccctgctcttgaaaggcaaaggaggggaaaagggaaatgctgccatgtggctcttgccccaggcccagtctggcaatgaagcagcagcagtacaactatggtcttgacaggcaggtggcaagcaggagagctccagcctaggagaggagctccaagagcagtttccagatgtgcacggtgccaggctcttcaaaggtgggtcctgcaggggcaatgctggctgccaagaggaaaacctcccgctggttatcgatagcctgtagacccagctcccgctgcagctcccccatactcatggcctcgctcaggtcctgggtgagacacagaagtccgaacacagctggcagcatttcctaacacactgacacccttgtcgttcatgaaacacactgttcttaggctatccccgggaatatcaggaaacacactgttcttaggctatccccgggaatatcaggaaacacactgttcttaggctatccccgggaatatcaggaaacacactgttcttaggctatccccgggaatatcaggccccaagttcccaga

SEQ ID NO: 118942 - DNA, 1030 bp, Homo sapiens
tggtcttttttttgagacagaatctcgctctgtcacccagggtggagttcagtggtgtgatcatggctcaccgcagcctcatcctcccgggctgaaacagtcctcctgcctcggcctcccaagtagctgggaccacaggatggttaatttattgtttttggagagacagggtctcactgggttgcccagggtggcctggaactcctgggctcaagagatcctcccacctcggcctcccagagtgttgggattacaggcatgagccactgtgcccggtgcaccacagcctttgaggtcaggattctggacctcagggatagatagcaagtggcttgcctaattcaggatgagttcagatttgagcctttgcctgtctagccctccttaaagtagcccttctcctcttaggccatggcccgtgatgagaagaattactatcaagataccccaaaacagattcggagtaagatcaacgtctataaacgcttttacccagcagagtggcaagacttcctcgattctttgcagaagaggaagatggaggtggagtgactggtttacatcacagctgccccaggctgaggcgtcccccggaccagtgaagctggagccagggtgtaaggcaaggaggtgctgtgtggctccagaggagctggccaggtcccatggaatcagaaggttacacacacgtgcacactccccgctctggggaaggaactgttctcagaggctccaatttatattcatctgggggttcacggaaaagccagaacctgctgttttcagggtgggtgatgtaaatatagtgtgtacataataaagcaaatatattttacttctctgatgattttgtatttttctgctctcagccaaaccctggggctgccccggtgaaaaccacctctaccggggctgagaggccatcccgcctgtcagcaagtgctacgttcacttgctcttctaggcacggcctctggcctcatcccgatggctctctgcccatttcccgcacagcagttcctctcaactc

SEQ ID NO: 118943 - DNA, 1144 bp, Homo sapiens
gttgcagtcaaccaagattgtgccactgcatttgaacctgggcaacagaatgagactctgtctcaaaaagaaaaagaaaaaaaaaaagagagagagagagaaaaagcctccagggcattagttctcattgttacctacttctacctaaccgtgggcagggattcttatgggttagtagttgtgttgggataagcaggagtctataactttccctcatcaaagatccttctggtctcaagggctctgttctctgcaggtgaaggccatggaggtggacatagaggagaggcctaaagagcttgtacggaagccctatgtgctgaatggtgggtgtggtccatatattcctttaggtcactgtcctgcactgtgggaagctgggaagggccctaagatgtcctcattttgcagatggagaaaccaagtttcagaggggagaagtgagctggttcaaagttcacagagttaggactgtgtcctggctggctcatttttcattgtactgactaaaccctgaccttactgtgtgaactaaggtcagagatgtttagggaggatgtacccaggtgcctgggagaatagaagagaaaccagtaaatctctggcatgggtatggcttctcatgaatttaaggatgaactgatttttagggattccaccatctcaataaatgttccaatgacaaaatcgattttatgtatattaaggctatagagagtgaacgctaaaacggaggagagtaaaccctacaggaaagtgggaatactctagaattcttcattcatccttccccttacctgtcagggagtttaagcagctcccctaaagataaaggatttgaatggccagacatttgatacagaattccttgagttcctgtcttttatctcagtggttctcataagaattactgcacaggattgtatataccaagccataggcacttactgtagtcaaagaggaacatttttaaaaattttaaaatgtggttaaaaaacacataaaagttaccatcctaaccatttttaagtgcactgttcagtaaaggatattgactttgttgtgcaacaggtccctaaaaccttttcattttgcaaaactgaaactatacccattaaacaactccccatcttcctctacctcc

SEQ ID NO: 118944 - DNA, 1060 bp, Homo sapiens
gattgcctgacccaaggaagttgaggctgcagtgagctgagattgcaccactgcactccagcctcagtgataaagcgagaccctgtttgagaaaaaaaacagaaaacgaagatttggccacaaagacagacatacctagaaggcaatgtgcaaacagccacctgatgggggcaggattggggtgatgcgtctgccagctaagggatgcctgaggctaccagaagccagaagcaggtggaacagacccttccccagctccttcagagggagcatggctctgccacagcttgatttcagatttctggcctcaagaactatgagacaataaatttctgttctaagccagctagttcatgtaccttcttacagaagccctaggaagctaatatttactggcaattactcaaatctttttaaacatcatgcaggtcatgaacgtcctgtttgcaaactctgctgaaggggaagaaggtgtgatcactggttgtttatccaaaatccaagatgagcccagttgaaggaggaagcgaaatacacagggcagtggaccctccacatccagaaggtcccagccaaccctaaggaggggagtctcatgggtcttcagggctcttacccaggcttaggaggaagctaccaccaggaacctctggtctcgcttttccctcccactacaagccacttcccctctgggaaccttggtgtccttggttatatggtgagaataacagaatttacctcacagacttgttaaaggatcgaggttacaaaagcattctgcgagaggctgtctttcctcctggaggtggaggcaacagacatggagagcttggggctcccacttggctgggaaatgggggaacattctcccttctctcaaggtcatgaagctgggaaagttctaagcacaaaccgagccctgacaccagttgtggcttccagagaagtgagaatgataataaataagtgtaaaaagagtcaacaacacaccctttaagccaagaaaaaaaatacatcaggagggacagtcacaattgagtagactgagaggaggcgtgag

SEQ ID NO: 118945 - DNA, 1028 bp, Homo sapiens
gcttccttccactctccctcatttagtactctttggcactcgccttgtgccagattggtaagacacccacaggccgcccccctcaccgtgctcatggtctggagtgtgttatgataagggccttgtggaaggacacagtgagctctggaagccactctctgcctggggagcctgggcaggcttcagagatgcaagaccttcagctgaccttaaagtgtgagaaggagtttgctggatagggagggtgggaagagaaggtgggaggagcagctggggccaaggcatccagagagaaaaggcccagctggctgcagtggctgaagctctacaggctgggatggtggggatggtggggatggtggggatgggtgggagctgaggctgggaggtggttggcttggggctggttgcaaagcgcctgttgtgccaaggctgagctcagacttgatccagaaggcagtggggagccacaggaggcttccagcaagggatggggatgtcagatgggcatgggtgctgtggaataccacagggggctcgatgcttctgttgagcctgaggaaatggcccagagagcacccaggagagccctgaagagagagtatagaccagggcttctcaaacttttttttttttttaagacggagtcttgctctgtcacccaggctggagtgcagtggcatgatctcagctcactgcaacctccgcctcctgggctcaagcaattcttctgcctcggcctcctgagtagctgggactacaggtgcccgccaccatgcccggctaattttgtgtattttttagtagagacggggtttcaccgtgttagccaggatgctctccatctgacctcgtgatccgcccaccttggcctcccaaagtgctgggattacaggcatgagccaccgcgcctggccacacccagctaattttttgtatttttagtagagatggggtttcaccatgttggccaggcaggtctcgaactcctgacctcaagtgatccacccgcctctgcctcccaaagt

SEQ ID NO: 118946 - DNA, 1042 bp, Homo sapiens
cccctttctctctccagagcttgggaggagtcagaacattgctctagccgctggtgatctctcctggttgccaaccctcctggccatgactgatctccccactgagatgctcaggtgattaaacgagagcccagttgtggcccgtgacactgtcactggcaagggtaggggtggggacaggggcaggaaaataagttctgagcagcccggaaataatgagtggtgactgcttctcggggctttgcctgccagcagcaccactgtgctctcctggtcatggtgcacggagggccagcaggtgtggggccctgccacaccggaacagcaggccacagcagccatgctgtccctcatacgcacacgccctctatgggctgcagagtgttaccatagcatctcgtaagcctcacttcccaccggtagtaggatattgtcactcatttaacaggtttgaaagccaagctgcccagggaagggacttctcaaaggtcgcgagtccagtgagtggcagaagggggatgtaaagcccagcccctctgatggagtgtccagcgctcgtcccgtgccctccacgcccctgtgtacccagctacttgtttattcatttggtttatacgtttggtcgttcattcatttggtcagtgcacattcttttatggccacacacctgctagggcagtgaataaacggatatggaggcaaatccactggatagtttgtctccaaagagctctcttttttttctttttctttttctttttctttttttttttttttttttgagagacagggtcttgctctgtagttgagactggagtgcagtggtgtgatcatggctcactgcagccttgagtcttgggcttaagtgatcctcctgcctcagcctcctgaatagctgggactacagggagggccaccatgcctggctaattttttaatttttttatggagatgtggtctcgctatattggccaggctggtctcgagctcctgggctcaagcagtcctcctgctcagcctcccaaagtgctgggattacagg

SEQ ID NO: 118947 - DNA, 1020 bp, Homo sapiens
atagacctaaagttattgatacacttatttccttatataaaatgtgtaaatattcatttattcaactatatgaagaaccttagtgcgcagcgctgctaggtagaatcccacttactatttcagatgtaagtactttgtaaacacttagcatacataacctcatttaatacagcaaccctatgaggttcatactgttctagtccctgatttacagatgaagggtatcaggactaagaaataaaatgcttaggttacacagctagaaaatgatggtgtcagatttaaagctatgtccatcttccagaacccttcccaggcttctgacttctgtcttgtgcaacttatatttcagtgtacagttgagtgtggaatgcaaatgctgagaaaataaatatttttttggcgagttctcacttttttgcaatttccttgaatagacttcactataataaattttgaagtggttattttttcccctcttaaattgagcagtgtgttggaagtgtataaatggaaaaatgctgtcatagatgtaattgacatttgattggaatttttggtagagaaattgaattgatgacccagcaaattattattagagaatgagttaaacagacaaccagcttacacttccaggtagaccaccaatttcagagtgttgtttaactttggcagaccattttaccccttagaactcttcaggggtaagctaacatgtggtttaagtgcaatgaagtaatgtgagttataaattatggtatatttagtctcatactggaagagcatgaatataaatctatgatagcatttctgaagtaaagtgcataggaacctccattttatcttctgtggagatcttttttttttttttgagacggagtttcgctcttgttgcccaggctggagtgcagtggcgcgatctcggctcactgcaacctccgccttccagtttcaagcgattctcctgcctcagcctctcgagtagctgggactacaggcacgcgccaccacatccagcga

SEQ ID NO: 118948 - DNA, 2529 bp, Homo sapiens
aggaggctcacttgaacccgggaggtggaggttgcagtgagccaagatcgtgccactgcactccagcctgggcaacagagcgggactctgtctcaaaaaaaaaatttttttttaagtagagacgggagtcttgctatgttgtccaggctgctctcaaactgctgcctcagaggttgagattacagtgttgagatgagttgcctcagtgttgagattacagatgtgagccaccacacctggccccttaactcttttaaaccttttaatataacagtgtaaagggttaatcttgttcattttaataatgaagaaacaggttctgagaggtcaaatagctttcacaagtagtaagtggtagagatttagaaatttatatccacaaccatcttctgtgtaacttaatggagaagtcaagtacacacatgaataatgggtatgcgatatatatagatatatatatatgtgtatatatgtatattgtatatatacatatatatacgtgtgtgtgtgtatatatatatacatatatatatacacacatatatatatatacatatatatatatacacacatatatatacacatatatatatacacacatatatatatatatatatttttttttttttttttttttttttttttgagacaacatatctctgttgcccaggctgaagtgcagtggcgtgatcatagttcattgcaacctcaaactcctgggctcaagtgatcctcccacctcagcctcctaagtggctaggactagaagtgcctggctaatttttgtctgtttgtttttgagacggaggcttgctctgttgccctggctggggtgcagtggtgcgatctcggctcactgcagcctctgcctcccaggtttaagctattctcttgcctcagcctcctgagtagctgggattacaagtgcctgccaccatgcctggctaatttttgtatttttagtacagacaaggtttccccgtgttggccaggctggtctcgaactcctgacctcaggtgatccacctgcctcggcctcccaaagtgctcggattacaggcgtgagccaccggacctggccagcaggtaacatttattaagtatctactatgccttaggcatggtgttaatgtataactattatgtttaatccttacagcagtttacaaagtaccataggtggtatgcataatgaagcagatctattgatgtatttactcaaggtgattaagctactaggtagtggaattctagtgggtctagatctggacttgatggctgagttcttactaatataccttgctactttggaagaggaatagagtttcaacatgtgttgggcagaatattcaaagctaaagaaatagcttgcacaaggtagggagatgggaaagtgaagtgtctgtggtgatgaactgaagagtattgaaagtggacaataagactagaaaggtaaattaaagccagattttggaggcctttcaaagctgttcacaatgtttaaactttaatctgtagatgaggggagccatcaaaggatttttcaactagggagtgacactaggtttcaggtttgcttcattagcagtatggagtatgtgtttggaatctccacaggggtcagtacagaacaggatgacactgctaggagttggttctcaatatgtttcttcatttggtatattgaaatcagtaaaagtaaaatattttggaaatctcaggtttcctgtatttcaatttttttatgatgttatttggttagaactccccaaggcattttatttcatatcatgtttctcagcccatttgatatcttccaggatttttctacagttctccacttctgtttattttggaaccagttgaatatgaataactattgcagacaattgttttcagctatttcagatgggaaagaataaggacataggttttaaggagagctaatgcaggtatgtggaaggttacttttattggcgttcattttcccaaatttccaaatatagcagactctcctagtgtcttggtttactgcctctaggttgctgtttgaacaactggagaaggatgacatggacagagagaagggggaattaaaggagttatgcaggccagcagaggaagaaatgatcccttttctgcttgcacaggaggaagaaatttatgaccctcatccttttaaatgatagcctgaacgctgggctgtagaatcaaatttataagtcattttgaaaatctttcttttggcttcacctgactatattacctaaaggaaaaaaaaacacatggtgctttttgttcatgtatttaaaacagaacatacagtggtccatttgagggttttttgccagagaatttggcactgttgagaaaacaagagctttgaaaatccaggcaaacatgacttaacttttcaacagcttatggtgagttctgtgatcttgaacaggttctcacttctttgaacctctttcattttctataaaatggagatactggccgggcgcagtggctcacacctgtaatcca

SEQ ID NO: 118949 - DNA, 1008 bp, Homo sapiens
cgtatctactgaaaatataaaaattagccagacatagtggcatgcacctgtaatcccagctactcgggagggtaaggcaggagaatcacttgaattctggaggcggaggttgcagtgagccgagatcgtgccactgcactccaagcctgggcaacagagtgcgactccgtctcaaaataaataaataaaaataaaaatacaaaaaaagttagcccagtgtggtggcacaggcctgtaatcccagctactcaggaggctgaggcatgggaatcacttgaactcaggaggtggaggtaccagtgagccaagatcgtgccactgcactctaacctgggcaacagagccagattctgtctgaaaaaaaaaaaaaaaaaaaaaaaaaaaaaaaaaatctaataatacatgcttgttggaagttagcaacatacaattgtattttaaaaagtaatcaaatcttattttatttccccattctaattccaggtttgttgtttatctttgtgtatttttgtcttctgcatacacagcttaatgtggaagctctcttaaccttaaccttcacttgactgattaattggagcagatatcctccttttcctaaactctattctgtaatatgttcaagcatttctgcaaactctactctgtaatgcactcaagtgtctcaccagtcaagttgtattcctgacaagaggcagttatatttgctcccaaactagtgtgtgctggttatgtttgtcacatgtgtttaattaaacactacataaacctgtaaaataccagtgcaaaaagagttttcatcgatacgaaaactaaattaaaagctttaaacaggctctgtctggggaaattgctaaaaaaaaaaattgttgtttagttaggtgtgggcaagttaactgtaaatgacttagggagaaatcattgagatacaacattgtacacttactgcttggcaagtgtttaaggttgcactacacttaaggaaatcaaatcagtatgggttatgct

SEQ ID NO: 118950 - DNA, 1003 bp, Homo sapiens
agcctgggtgacagagtgagaccctgtctcaaaaaaaaaagtaaaaaatagccaggcacagtggtgcacgcctgtaatcccagcactttgggaggctgaggtgggcagatcacctgaggccaggagtttgagaccagcctggccaacatggtgaaaccccatctctactaaaatacaaaaattagccagatttggtggcgggtgcctgtaatcctagctactcaggaggctgaggcaggagaattgcttgaacctgggaggcagaggttgcagtgagccaaggtcgcactagtgcactccagcctgggtgacagagtgagactccctctcaaaaaactaaaaataaaaactaaagaagttccaaggagtgctagtggattcattccctaaagaaaacgataggcttttatcagaaacttatgttcatgtgagtactttatgttaaaatgaaatatttacataaatattcatttatgtaaaaatgaaaacatgtaaaatgttaaaatgaatatttttattactttgacttcagttaattgattagttatgggtctcattctcattgggtaagagaacttctgtctttgtcttatagagatatgattatattatacttaactctgcatagcataggtaagtagtcatgaagactgactgggtttgtttgattgagacagagttttgctcttgttgcccaggctgcagtgcagtggtgtgatctcagctcactgcaacctccacctcctgggttcaagcaattctcctgcctcagcctcccgagtagctgggattacaggtgtgtgccaccacacccggctaatttttgtatttttagtagagatggggttttgccatgctggccaggctggtcttgaattcctgacctgaggtgatccgcctacctcggcctctcaaagtgctgggattacaggcgtgagccaccgtgcccggcccaaaatatatttttaaaacttaaaatgaacaactcaatcaaaaggtaggg

SEQ ID NO: 118951 - DNA, 3396 bp, Homo sapiens
tgggcaacagaataagactccatctcaagaaaaaaaaaaaaaaaggttaaagttcctgacttaatgaggaaataaaaaaattatatgctgaagttgctaagatctagcttgtgtttgtgaaattgtgaagaaagaaaaagaaattcatagtagttttatggtcacacttctgcaaaaattgcagccacagtgcatgataagtgcatagttaagatggaaaaggcattttttgagtggaagacatgaagagaaatagcttccaatgacagcattcaagttcggtactatacatggtttcaggaatctactagaggtcttggaacatatccctgtggataagaagggactactgtattgccaaccagggaagcttcagtgcttccagagaatttattagggcatcattacataggcacgattgatttgtttggctgcccacatggttgaactcagtcttcaagtcaactgataccaagttgtccaaagttccccaccctaaaccacatggttggtctttctggcatggccggctttcaccctaagactactgggtgttgcagctgcaacctaaaatctagtaacaaagacatgcttatcaggtctgacatagattacctcccaaaagggaaagatcagacatctctttgggtaaggtcaacttttttttactacattgagacaaatatctatttcaaggacagagttaaggagggaatgaattttttaaactgaatatcagtagtctgacaggagttgtattaggatctttatgtgtggccaactcattaaattttcagattaactcagaaatattgttcctttattttgcacatgaggaaactgaggctcatatgtttttttcttctttattttttatttttagagacagggtctcgtttcattgccctggctggtctcgaatttctggtctctgggctcaagcaatcctctcacctcagcctcccaaagtgttaggattacaggtttgagccaccgcgcctgacctgaggctcatacattgagcaacttttcagagagatggagcttggatcagaccgaagtttctctgctgcaagccccttcatcagatgccactcatcaggactgcttcactgcataactccaggggtactgcctacattgtattctctgaggatggcttttcttgggattgtacagtgaagcactttatatcccagccaccctaaataatacatgccatctgaatccaggcagtacgcttgctgcataaatgtagcttccagacaagtttcctcgtctcctctaccatggatgcattctggagtgacaactccagttgcctccaagtacagccggttaacaggcccatgaaggtgcactcctcagtgaccttttggtgtattcatgaccatcctgttttggaataccacgcaatagttgcctcacctcttgttgttggttgatttgagcatcgctgaaactcttgccactccgttttccttctcaggctgctgtacaggacagattgaatgagcaagagggcgtacctagtgttttcaacccacctccatcacgacccctgcaggttaatacagctgaccacaggatctacagctatgttgtctcaagacctcaaccaagggcaagttatttcatagctgggatttcccccttttttatttataagtatatccacttggttatattgatctccctgtgacaggagcaaaacaaatatttagaatgtaaacctgttagttagacttggcccgttgggtgtattattttgccttgattcctcaaggaattgttacagaaactactcattttttttttcttttctttgccagttatttggagagtgttttctgcctcttaagttacaatttgtttactcaagttctttgttgcttcagtttacttaatcttaaaccagttttgaggaagtatatggaatctttgtaggagctttggccacgtctttgaaattagccttgaagggctagtagcaaggaggtggttcacttaaatttgacagacatttaagagtactccaataacctggtatcttgctactagggatccagacatgaataaagagccagtcttcccatttcaaattcaatttctcacagtctattgaaggaagtcagatgtgtacactgataatgaattctaaagaactgcttggactttctttttcttacccctggggttatactcacctcttatacttttatacttgcatttagaatcctaagaaaacactccctttaacattgcagcagttagaatttactccatcatcaagcctttttgtggagtacttgatttttgttgtgttttgttctgtttgagacagggtctcactctgtcgcccagcctggagtgcagtggcatgatcttggctcgctgcagcctagacctcccgggctcaagcagtcctccacctcagcctcctaagtagctgggactacaggtgtgcgccaccatcctggttaatttttgtattttttgtagagatggggtcttgctatgttgcccaggctggtcttgaactcctgagctcaagttatctgcccacctcagcctcccaaagtgctggaattacaggcttgaggcactgtgcctggcctacttgatgttttaaaacatgtttctaagtagtgctctgtggttttctgaagtacagtagcagattcccatgtcagccatggggctccagagcttcctggccacagacacagaaagtgtctcaggttaacacaatgtgacaactatgaaatgctttataaactatagagccctggatgtatgctagttttaataattaataacagcaataataattagcattattactaagataagcagctatatggggatttgtcattgtggttaatataattatttaatgtttatataccaatgtccaaggttagtaatagtgattatctttcttgctatttctatatacattattttaggtttttatgtttgtttgttttgttttgggacagaatctccctctgttgcccaggctggagtgcagtggtgtgatctcagctcactgcaacctcagcttcccaggttcaagcgattctcctgcctcagcctcctgagtagctgggattacaggcgcccaccaccgcgtctggctaatttttgtatttttagtagagacagggtttcaccatgttggccaggctggtctcaaactcctgacctcaagtgatctgcctgccttggcttcccaaattgctgggagtacaagtgtgagccaccacacccagctaatttttgtatttttagtagagacagggttttaccatgttgaccaggctggtctcgaactcctgaccccaggtgatccatccgcctcagcctcccaaagtgttgggattacaggcgtga

SEQ ID NO: 118952 - DNA, 1034 bp, Homo sapiens
caccatgcctggctaatttttgtatttttagtagagatgggatttcaccgtgttggccaggctggtctcaaactcctgacctcaggtgatctgccccactcagcctcccaaagtgctgggattacaggcaggagatacagctctggaccttaaagcagatttaatacaaaaattctgcaaaaaaaaatgatagtaagatgaaataagaccaaagatggtggcacttagaaggatgaggtggccaggaagaaggaactgtactttagaggaacaaatcacatggaaggaccaaaaagagtgagaaaatctgacctagccatttgataaaatattagggattgagagaattgtctctaactttgtttttggactttcaggggctgcttggatggggttattacttgataatgcttccattccggtttacctattacacgatacttgatatatttaggtatgtacctttggatttatgtattagtagaatagtaagactttggagctgaaatttaggccaaaataagctttatgctctatcaatgttgacttaccaatttgtcatgagatggaatacacttcccgaactgtcttttaatacaacatacaagtattttaaattgttgaagcattggcaggcattgtgaaatggaattgtttttaaattagtcttaccttttgtttgcaaaaaccagtctgactatatttatttgtctccccctcccccccccaccatatttgtcacctctacacttcctagttgatgtccacaccctttcctttctaaccactatcatctcctagcttcacactccttagaactttcttcctcaactacttctcctccacctgactactcacaatcccaacaaattctcttgctctgagattacccagtttgcccttgattcctcccacaatagttggacctccctagacactcctgttacaccttttctttctttttctttctttttttgaaacagagtcttgctctgtcgctgtcacccaggctagagtgcagtgccaccatctcg

SEQ ID NO: 118953 - DNA, 1055 bp, Homo sapiens
tggggaacttaaatgttcaagggcatccaggccagcagatggagctgggatatgtagtctgggccttccctggaagtacaggttccctgtacttcccttcaaatatgggacagcctttaccctgcctctagggagcagaggctgaagttgtgggtccagcagctgcataagtacaagggtcagatagtaccttttatattggacccttggtgttttatgaggctgtctacttaatggctttcttggtttagcaacattcttcatgatcactaattgcttagtactctttccatccccattttatttaagaatgaacatgtaaaaatctttaaaatcataatgaaaactaagttgacatctctgtttttttctaaaaaatcaaaaaagctgattgtcctaaattgtgtagatcgtgggaatattgtgtaatgaggaaaaaaaaataaaggctttaagagagaattctaaaatgcttaatttcaaagaaagtagttaaaacatcagtcttctgatgaatttctaaccattcccccacgtatacaacttactacattttgtgcttttaattcgctctggaacgttgttgtcaatgaatttggtttgattactcgggagaaattccaagtagaattgtatacacagggggaatttgttgggataatgaattgactcactttttgttaaggaaaagtatcacagtttaatcaccttgtctgtgctgaaaacgttttaagtaaatgaatattgtttgcttttctagggaaaatatgcacggcatgtattactaattttaatgcagctgtatcatccaaccagcttgtttaatgttaggtaacacattatcctctgtcctgttgccttctctggaaacccaaaggataaataaatggtactatacaaatagggtaggccctttagaaacagatgtgtggtaccattaggtatgtattcttcactttacaagagctgccagtactccacatctgccagggtactgtggagcagttttataacttcctccatggttgccatcaaccataaatcatcaagcaaaa

SEQ ID NO: 118954 - DNA, 1040 bp, Homo sapiens
taaacacgtggctgttgagcacttgaaatgtggctagcattactaaggaactgaattttaattgtatgtaatagatttaaattcagaatagccacatttgactagtggctacagtacttagacggtgccattctagagagtctgggtgcatagcctgacacatgatctttttggatactgtgtcttcccttccaaacccttctagccctaaattgttctacaaaaaatactcaggatttatgtaggccagtgttggaatttataatcccagtagtttgcattcttcctgaacaggcaatagaataacacttgctgctttatggcttttgaaccagactctactctcggatttgatggtccactcacagactgttcacctccctttgttgccgtgcctctggctctgttacaggaatctgtacaaattggcccactcgatatgcactgtagtaagctggattcatgtgatatttattccttcctccccaggtttgctcttcgttttatacggcctgaccctcgcagccgggtcactgaccccgttggggacattgtttcatttatgcactcttttgaagagaaatatgggagggcacaccctgtcttctaccagggaacgtacagccaggtcagtgccataaaccatatagatgccaacttaccgaaatgattctatcctcaaaggagagcacagcccagcactgatcatgtccttcttgtactcaaaaaccttaattagctcttcactgcttataggggtgggtaataaaaaagaccaaaccttttagctggcccctctttgatctaatgctgcccttcttttgaggtcttttctgcataacttattttaccataccctcagttccagctgactcattccctgaacatagtctgtacttgcctacctctgtgcctttgcttttgccggtccatccacgtggaatgccttcctcacatttttgctaattggaatcttgccagtccttcaactagattatgtcacgccccacttacagctatccctgattgttgtgccctgt

SEQ ID NO: 118955 - DNA, 1781 bp, Homo sapiens
aggttgtgaatagaaggaaggtaaggatttttttttaatagaagtttataaaatctcttatttcacaccataaggaaaacataggtaaaactctgttatggtaaaaatcttggtcatttggacaccaatttttttttttttttttttgagaccaagttttactctgtcacccaggttggagtgcagtggtgcgatctcagttcactgcagcctccacctcccgggttcaagcgattctcctgcctcagcctctcgcctatctggaattacaggcgcgtaccaccacaccctgctaatttttgtattttttgtagagatggggtttcattatgttggccaggctggtctcaaacccctgacctcaagtgatccaaccacctccgcctcccaaaagtgctaggattaaaggtggagctaccagcccagcctcaactttctattaataagcttctttggaacagaaaaactaacctttttaagggtggagaaaagttacgtggggagaaaggataaggaaaggattaggcaagagaaaaaaaaatgatgatggagattattatcagtatcatcaggctgagacttgcagccttgtgcccttttaggtttgagcccttgtacagggaaaaactgtgccagattctttatagatcctttttgtaccatcaagtagacattatccttaaactctgcagccttccctggcatcatcacaacaaccacaccgccaccaggaaagcctgtcctattctagtcaagcacctagggataggcatgcaaattgataacaaaaacaaaagattacaaaactgggaggaactgggcatggtggcacactcctgtaatccctgcttctcaggaggctgaggtgggagggtcacttgagcccaggagctggagaccagcctgagcaacatagtgagaccctggctcaaaaaaagaaaagaaagaaactaggaggcggggaaaaagcggagactaaatgatacctctcgtcttccccaaccaggattaaaacagttctctctcactcattgtggaaagtctaagggttgatctttttcaccgtcaagtcctgcccttgatctgttgggtctttttatcagtctcacaggctttacgagagaacacctatccattcctggccatgattatgctgaaggatcgaaggatgactgtggtgggacggctagaaggcctcattcaacctgatgacctcattaaccaactgacatttatcatggatgctaaccagacttacctggtgtcagaacgcctagaaaggtacaagggagttcccttctggaacagagagagaccagttgtaaatttggagggctgacctctggggctctaccaatcctgacttcttctgtgcatcaggccgctattagcttttagctttgcccatttattgtcaaaatatttacatactttgacctaaattactctatatcaggtaatctgttcttagagatgttcaaaataaagacaagggctgggtgcagtggctaacacctgaaatcctagcacgttaggaggctgaggcaggaggattacttgaatccagactgggcagcaaagcgagaccccatctctacaaaaaataagaaaaaattagctaggcatggtggtacatgcctgtagtcccaggtccttgggagcccgaggcaggaggattgcttgaggccaggagttcgaggcagcagtgagctctgattgtgcctctgcactccagcctggatgacagagcaggactctgtctttaaaaaataataaatgaa

SEQ ID NO: 118956 - DNA, 1006 bp, Homo sapiens
gagagaaaataggagatatgccaaatgttataatgttttatctttgattagtgattctctgaatgactctgaaaactctacattttcagatctgctacaatgtgtgtatggatatatatgtgtgtgttttggttttatgagatcagtacaaaaatgcagtcacccaaaatggtatttacttgtaaaatatgatattgatgatcccttcataataacagtactgtgtcacatttgttagaattaggggaaaagttttattttaaaagaggagaggaaagcttgctgtttccttttctgccaaattaaactgagaaaaaaggtggcttattcagattctgccacgctctgcttttggaatcccttatggcagtgtgaaatcgtcatctgctaagaatatcaacatttttacacacacacacacacagaagatttcaatataagaaaacacagaactttgtgagagtgctgtttttcttctcttgcttttgatctattcacagggaagaaagaaaccagacccaagtgctgagacaacagcaggatgaggcctacctggcctctctcagagctgaccaggagaaagaaagaaagaaacgggaggagcgggagcgtaagcggcggaaggaggaggaggtgcaacagcaaaagttggcagaggagagacggcggcaggtaatggacgtgtggctttactccctgtggttcccaaactgccgagactttgccatcttggtcttaagtgtgaaaggaaaaaatgatagccaccttaaacagactaagagggaaaaaaaaaaaggaaaaaggaaagaaaaaattacaacatgttggaattaggggtgatttaaatttttcataccatttaaatattcattcttttttaaataaaaatttaaaaaaagagacgggctttgccatattggccaggctgctctcgaactcctgacctcacatgatctgcctgtcttggccttccaaagtgttgggattacaggcgtgagccaccatg

SEQ ID NO: 118957 - DNA, 3059 bp, Homo sapiens
cccaggcgagtgctgccctgcatcccttcagaggagtggcccaatccccctacgctacaggaggccggactcagccacacagaagttctttttgttcaggacctaactgacgaatgacatttttttcttcctgtcccctcctaccccagtccctaaaagaaatggggaaaaaagaaaacaacagcaagtcagaaaaaaaaaacaagagagagaaattcatattattattattattataatacaatattttttttaaaagactgctgcatccttaggaaggatcagaaaccatgctgcccgtaagagtcacaacctgtgtgtgcgcgcaaggttagcaacaaacgtacccgcttggcaagcccacccttcctgtggcctctgtgcacgcaccttccagtgaacagagactcttcaccttcgacccatccattgtcccagctgggaaggggacattcccactagttctcattcattcttgcttttatgaaaaataaaagtgaaaaacctccatcaaccagctacttgcagcatctcctgaggacttgcttctcctgcctctggggaagagagggaagagaaagcacagagcagagaagcagagatgttccttgaactgcccacaagttttcaataacttttatttctgttttgtaatgaccaaaggaatgaggctgacataggtatatatatatatttttttcctttatttgataaagagccaattctttaaacccatgagtttatgccctgggctccttagcccacaatagtgtaataaaagtgccccgggctggtttgtgcttatttctgccattgtccctctcacgttcccagagaggtcattctttttggtccaactcttgctgtcctttcttaccacctgtgcaccccacttggagcagtgggaggaaatctgggtttgtggccccacaaaggctgtatatgtaaagatacacctatgtatgtggtggaactcacctttacacacaactgcagcttttccttggagtctgtaccaggtggtggttatggggtctgaaccaaaggatagcagctcttcattcctcttctgacatgtgcatgctgctccccccagccctgggctttcctgaattgccaagcctggtgcctttccaaaggactagcagggcctgtggtggagccagcagaaccacaggagagtgccctgcctgtctcagtggaagtgtattattgttttaaggatagaaccagaggccttgaagggagccaagacagaactcccagcctgtgtaatctattggaaggcacattttcatttctgatgcagccaccttctggaggcagcttttatcctttctctctattgctatgttgaagtaatagggttttttttaacctctggatgtctcgtctgtggttgagtttatggtaatgggtacatgggtcaggccatgtattaacagatgccagtgcgctctgacaagtattccaaagtgttctgtagctagactggtgcaggctcgttgtaccactgcaaccgactgacgttactgtagttcctagaatgctgtgagggcggggggttcagatcaacataaagcctaacttgctggagttgtagtctcaaggctttctctcttgcttaactaaaacctaaggaccactgtttttggtagcaattatatggttactatccactgcagtcctcagttgttggggtaaatcccacatggcagagtaaggcaccccacagaaattaacttggagagcctgagaaattcccagtggccttggcatagctgtctagaacaccatctctaggaaaatttaattctgtccctggccagctattgttcttccacttcgttttctgctgtcccaaggccagatgagtggaatcaccatctgactgctgtcaataaaatgtatctggcgtgaacagcaggataacccatgttctccacataaggataaccttacgtgaaaccttcctgctgacaaccatgcagaggaatttttccacttaagtcagagccttcctccccatctggaattcacagctgttccctggcagcacacaggagggtattaaggacctttgtgaggctaggtacactgtccacacctctttggggaagttacgattttttttttccatcataattcagtctcttcttattctacagtgtgcactttatgcctctcgccttttgataatagttgttcagtgaaggaagtcagctgccagaatattaagaagggtctccctttatgtcagtacaactgttagggcggccttcccatttactttaggtttcaagaggattcaccggaagcacatgccccggtctagtcccatttgaaacagttctgctttactgagaccctaggccggtctccttgctgaccctagcgctgctgcctaggtgccatttcctttcctcctcagtcaaatacaggctgcacattttgtcacttaatgccagtacaatctgtgttactcctaaggacttttgggattttgatgagacctgcgagggagaagacactgagaagccagtgatctgcaagcatttgctcttgtttccacatcacctctgggatatttcagctgttgtttccaaatggcaaatcatcaactaaaagcacttgtttcaagttttgttctgcactcccacgactgaagttgtagattgagctgaataaccatgggaagtgaccaagcaaagacactcgattggagtcagttgaatatttgtaccctcagtggagcccttctggtcttttcttccacttctgcagaatttcctctagcaaatacttctttctccttgcttgcctccaccatgatatttgaataagagatggccagaggataacacttgtctcttaaaaactaagctaaaaagaacctagaaccttcaattgagcagttgtgaaaattgctaatggtgccaaggccaagcaaagagtttcagaaaatgactgagaaggagcgataacccccagaatgcaaaatcaggggcatcattatccggtgcttgaacaaggagctccgctctacaactggttttttt

SEQ ID NO: 118958 - DNA, 2878 bp, Homo sapiens
gcggaccaagtccccccaggtggctgcacagatgtggtgggttggggctggtgagagcaacgcctgacgtgcatgttcccacaggccaaccggacgtgtcccatctgccgggccgacgcctccgaggtgcccagggaggctgagtgaggccacgcagccgcctgcccgggagaaccctgcctgaagctctggaaacttgtgggtggggcccagggaggatggggagggagtggcccaggcctgccccttcgctcctgcctgcatttccagagctggtgccagggtcagcccagcgaggagtccctgcaataagcccctgcatttgccaagctccaaagactccctccctagtctgcctgcctgcccgcccgccacggagctgcctgagtgtccctgatcgggtctccctcctgtgcaccctcaggtccctccttttcctgctggcactgagtgccaggggtccgctccctcagtggggccggtggagatccttggccccaggatgggcagacagagcaccatcctgggtcagaaggtctcatgctctgaaatggcgtgccctctgcccaggtggcactgccaggtgcgtagacagacggtgtcacgagccatttcctgagccccagggctgaatcccccctccttgaccccgaacagtgaactcaggcagctggctctgtgttggctgctgtgagggctgagtctggttccctaggggaccctcatcccaggaacaacattccagccccaccctcaggctggagggcgtcccagcctaatcccgagctggggcacacgtatcctgaggggcttgggccatacggggagagggagccctgtgttcccggtggttgtccctcccagggatgcagccagacccgtgcccaatctcctctccctctgttgttttgcatgaacgtgaggagcagcagtttttgttcattcatttggcccaaaatcacgtgtaggatttggggatgtggatatttaagacaatttcttttttcttttggtttaataggggcgggtatagggaccaactgggaccgagtgcccagggggccgagcacggtcatgctggccggcctgcatgcatgcgtgtgccgggctgggctgggcggccggcggtcgtggggcagggttgggggtctgtgctcagctgataactgccatgcactgtactgcacacgtccctagagcctaccgggacccgacgcttttcagggcatttctccctccagccagggcccaactcccacctgcctgggcgaatctcctccaaggaagtcccaggaggatggggaccaggaaggctgtggacccccatctccagggggccttcccagcctgatccctgtcctccaagttctggaggaggccgctgtagggtctggctgagcttcccacccactttccctggtcccaatcctttcttgtcctatacccagctggggttgctgccctgaacgaactgcgtgtggggccggcacatcctagcaggcagcccctggcgcctgctgcctcagggatgctccaaccaccctcgttctcctcgcagtggccctggctcccacctcccgccccagcctgccgtggggcccgtcagcctggtcccacccccatggagaacccaaagtcttactgtatataactccaggtgacgtttctatatttatagcagtgttgaaaacccacgtgttttacacagaaccaccctctccaacccctcccttcccgaccccaacaaaacgttttcaaaccccttacagttcctggggcaggcggaaacaggctcacagattgtgtgtcggctgcagcagtgattccaacaagcagctattgggggggaaacacagcatttaaaaagatcatcattaaaaaacaagatttatacaacaattacttaggatgtttgtgatctgccgaccttgctatagatgccatgttaccaatgatttcctgtggtgggggcttgccattgtttactctcttatttaccaacttctggcctaggcatgacagtgggcaccttcccccagccctggctgggcccagcgcctgtgttctgtgttagaaaggttttatatatatataaaattacatatatatgtagaaatatatgtaattttgggggccctgttccttgcacattttacagttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtgcaatcattattttttttaatattgttgctgatttcagagggatattcactaataaatgtatgatgtataccaacgaccgcccacgctgcctttggctgcccgtgtctttttggtgggaggtgggatggggatgaggcttaacacctgtaatcccagcactttgggaggccgaggctggtggatcacttaaggtgaggtgttcgataccagcctgcccaacatggtgaaaccccttctctactaaaaacacagaaaaattaggccgggcgtagtggctcatgcatgtaatcccagccggtggctcatgcctgtaatcccagcactttgggaggctgaggtgggcggatcatgaggtcaggagattgagaccgttctggctaacacggtgaaaccttgtctctactaaaaatacaaaaaaaaattagccgggcgtggtggcgggcacctgtagtcccagctactcgggaggttgaggcaggagaatggcg

SEQ ID NO: 118959 - DNA, 1004 bp, Homo sapiens
acctgcacctggcccctcttgcagccatattctcacatgatgccacggagactgagcacccagagataccgcctgcagcagccactgcccccgccgcccccacccccacccccaccaccctactaccccagcttcctgccctacttcctgtaagtatccgcacatccgccccaggtccctgatgccctgttctcctggaacctccagtggttagacctaaacacagctccaggggccccagggcctctgaagccacctggcgttccccccttaacctgacaggcacgccagctgggctcccttccccgctgcaacgttctgggctctgtttgcaaggagggagtcaggagagcggctctgtgtgccccactcctgaccttgaccctgggcccccacacttgtctctctctagctcgatgctgccaatgtcaccaacagcaatggggcccaccatcagcctggacctggacgtggatgatgtggagatggagaactatgaggtcccatggagccccatgctgggaggtggggtttgggagacctgcagccctgggcgccgctgaccccgtctcctgcccgcatgcaggccctcctgaacctggccgagcggctgggagatgccaagccccggggtctcaccaaagcagacatagagcagctcccgtcgtaccgctttaacccggacagccatcagtcggagcagacgctgtgagtaccctgccccacctcccacccctctgaacacagctggctgccgtgggacgcccctctcaggggagtcacactccactgagccttcccatggccctcagcgtggaggtgacgctccgcgcccctccacaggtgtgtggtctgcttcagtgacttcgaggcgcggcagctgctccgagtcctcccctgcaaccatgagttccacaccaagtgtgttgacaagtggttgaaggtaacactgcccaggtctgctcctgggtattcctcatgcagtgacggggggatgggctggc

SEQ ID NO: 118960 - DNA, 1776 bp, Homo sapiens
ggagtcaacgtgtggccgggcggccaaaggtgagtcggtgccagggcccccaacttcctattcccccacccatggaccttctgttcccctcccctgggaatgggggccgtgatctaggtggctccgtaggggttaatcacgggcggtccagactgcgggcagcgagaccccagggatcaggaaccccccccaaggccccccgtggccgggccgtatctcccctctcctgcagctgagcgctgcggttggagaggaaggagccgcccccctccccctgcggccgccacttcctttgttgttgcttttgtctcacgccgagcacatggtccgggatcctcggctcttaaagtcgcagcgttctggcccctgcgctgcagtctcgcctcccgcccccggtgtccctccgagagcggcgcaaaagagtaggaagcggacgagggaggcccctctcggggctgtgtccgcgcctcggccccccagcactatgcctggggaggggtggctgggtaagcttcccagagccccacagcgtgcacttggcccgcgttggggagcccccccttccccaggaccctggtttcctcccccactagtgtgaccacctggtttcttctggactcttctggttttatttgggcgctgtgggaaggaaagatttccacccccattttatagctgtgccaactgaggcgctcagaagcaaagggatttccttgaccaaggtcactagggagtcttctctcctagtctggtggtccggccctcagcggcctccaggcaccacacgttgggaagctctgcttgcgctgggcagagcctgcttgtttcgggtggggtgtggggaagtaggaaggggggcttctcttcctggctgagtctgctcatgcccccagggtctgactttgtttttatctgcaaaagggagtgtctcttcctgcaaacagatccctggggctcttagaccaaggtcagggtaggtgcttggggcactggacttaaggggttggccggctctcatgggtgggtgtggggggttatgttaactgcaaaatgcattgcgtgcctggggcggacggggctcagcgacgggactctcaagacccgttcacacagagctccgtgataggacagcatggagatgtggacgggcagagcagttgttaggggaggccacctggccacccttgctatttgaccttgagcaagttgctagctccaactctgggccttgcttgcttctctgtactacagagctaaagatgggtgcctgaaagagagtgctctcccagcctcctgtatggcttggagactcgggattaggtgatttcctccagctactgatgccacaggagttatggcttgggggagtttgggcctaggaggccaactaggaccaattccgttctctctggtcttgtggcctagagtaacttacttcctttctctcggctccagttttctcagccatgaagtgggtgtaacccttctacgccacccctgttcctggcagggcttaaagaaccaggatccactcttaccagctgaggtattcccctagagtggcatatctgcctgctgccccggaagtggcacccttcaagctctgcttgaggttggaaatggaggtcagcgtgtcgtattcgctaataatgatcattcacacccaagctaagttcaaactttacaagttgcttctgctgttgccttggagcagtccttgatgggaaactgggaggtagttattgggctgttcccattttacagatgaagatactg

SEQ ID NO: 118961 - DNA, 1066 bp, Homo sapiens
actgtgatggatagagtttggcgttccagggagcatcgatagcactgcatcatgaccttgctcttgtgttgcttagagatctgccgacagccggctcagttccatcttcagtcattgtgttgcacagtgatacgatcattgctggtctaaacattgccataaacatgtctgttccccaagctgaaagggggtttctgattctaagggaacaaaaggttttctggcttaaaagacttaagacatagtctttataatagctttctttaaaaatttcagtgggttataatgcatagggtttttaaaaaagagctaatgtgcaatatatacaatagtctatcctactgacccaacttctcccttccagttctccctaaggacaattgttaatcagtttcctgtatacccttccagaaatatatgcagatgtggcatatgtccaattaaagaaacctgatacatactgttagaactgttcagcatcttggtttcaatttttatataaaatttaggattacgaaatataccaaagcagcatagaaaatgagccccccatccccctgccccatggcccaccacacaggttaacagatgttaacattttgcattggcgccttgtttatggctgtcttggagatagccccgtgtcgcctccagctgcctctttgtggtaactgcccaagagtcgttattgattatatgcatgcacccaatattcattattcgacctgttccagctcttggatatttagcaaattactgattttctgcttatataattgtggtggaggtaataccccattttgtataaattttgcccgggtgggtgggcttcgaggcaaaggagaacgaggctcggctttggattaggttcacactcctgctccgccacacttctagttgtgtgatctggagtaagggaaggccctcactttccccatctgtaaaatgaactggctatagtaatccctccgtctcatagctgctgagaggaatagaaaactaaagtatagacgcttcactgggcttagttcccagtttccctggctagggaggtctccgcggggac

SEQ ID NO: 118962 - DNA, 1032 bp, Homo sapiens
ttcagcaaccacggggcccctgtgttggcattcatggttcacaaaccacacttaatgtgagatgagaatgggatcccaggtttgccccttgatggctgcatgacactgggtgagtcctgtcacctctcacctcatctgtaaaatggggccaatgctggtggccagctcttagaacatgatgaggagaggatcaggataggacttgcccagagcttgtagaagactctaggacccccatttcccccatagaacctcacagcagatgccagagcagaggtgggccactcccatctgaggtttcacacttctgggctctgtggcgagggtctgcccctccatggctctgaaccgctttcctctgtgcgatgaaagtaaacgacgtctccctttgagggcttggggtacggggagaacaaggctcgcacagtaggtgtgcaggccacgtccccacagcagggttccaaagcctaagatccatcagtgaccctgaggagggattcgaagaaaagttcagatttcagatttctggcttcatttgaaaaactggaaaattctgggaaaattgtgcctcccttcccacttgctccagagtgatttcacatccacgcgtgaaggtttttcaggttggtggagatgtgttattggtctctggcgctgaggggaaactcaaatgactggggatttactgagggtttcctggggcagggacagggcagcggtttcctggtcctgcaggagaagaggcagatccagagccccattcctgggcatccgccacccagcgtgagccaggtcctggactgggtgttgtgggccctgctgggagcaggggcagcagtcacatggagatggtcttctgctctcatgatgcaatgtgatggtaatcctaacactgaggaagccagcgcaagccggcagggcagggaaggcaccatccaagggagtggtctttgagctagtcccaaagcataagcaggattttgcccagtaagtaggggatattgaggacatattaagcagggagaatgccac

SEQ ID NO: 118963 - DNA, 1046 bp, Homo sapiens
tcggtcaggtgtagaggctcagtatactggcgccgtcgctacccccgctgacacagctgctattgctccttggcaggagtgtcttggccaccgtctgctccaatttggagttccaggaaggggcccctgatgtccatcccaaggctagcagagggttcagtcctccaggctgtgtcctgtggggaagaagcactgggatgtgttcttgggaagatggaaaggaccccggatcccgttcacagcccttgtgcctcttcctctctccgctggaaaggccctggctaccggggaaggatgaggggggagggtcctggggctgctcccagccctgagctctttgttgctgcccttgcaggtgctgggagccctgttcctggctatcggcctctgggcctggggtgagaaggtaaggcagcgggcgggcgtggagctggtatgggacgaggtggtgggaaggtcagctccccacacctgcctctgctgcccggcacagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttgtgagtgctgccctcaagatcccctgggaacccccatctcctcccatccagttcttgcaatacagttggagcttaatgatgggtagctttattattatgctataatcgtcatcgttagattcatgttgtctatatttactaggatcctttccgtggtatggtaagtgaccgagacctggtggcccaagcataaaatatttattgactcaaataagaaaagtccagggttgtgctggctgccggtgcattttgatccaggggctgccacagtttcacttggcctggtttctccctgtttctcgggctccccccgtttggctccattcccaggtggcaggaggctcaggaacagagccggcttccccatgccctcccaggaactcctgctggaggctgagagctctct

SEQ ID NO: 118964 - DNA, 1129 bp, Homo sapiens
cgcccagcgtgctggaacttttctaaggaaggggtgctccttgctcactgtgagagtgagcaggctatgagctagagctactggtggctgccatgtggtgagagcccgcctgtgaggaaaaccagcagagaggagagcagagccaaagcacggagaataagagcagtcctaacaagcccctggatccagctgggcctgaagccagctccacttctggacttttcagtaatcgatgccaatacattgccttttataacagagcctgagttgggttctgtcatttgcaatcaaggagttgtatgtgctgtattcctgaaagggacaaatatgtgcctgatacacagtaggctctcaatacatgctgaagataaggataagacctttgtgagaacagccagtctcaaaacatattctatgatttcctgggcataacactccacacacggcagaattatagagatggcaagcaggctggtggctgctgggagctagggctggtggagggtggaggtgggtgtgacatcttcacggggatggaacaggtctagatcttgagtgctgtggtggcttcatgatctccacatgtgacaaaatgacgtagagccgtatgcataccctgtgccaatgtgggtttcctggtctggtattgtactagagttatgtaagatagaaccactgggagaaacccagtgcagggtacacggcacctctctgtactatttttgcaagttcctgtgaatctgtaataatttcaaaacaaaaagttacaaagaagaagttctttgtaggcgtaccacccagcagctcttggaccccaaaaggcaaatcatgggcattgaaatcagatggaccagagctcaaatctcagcatggctgttcacctgctaagtggccttgggtcagtcacgtctcttctcctaccctcagcgttctcatccgtggagtggggctcactggggcttatgggcccgccccatggggtggtgatgacagaggatacagtcaagaccgtgctctgtctcgctcaggacctggctgtgggaggcgataagcttcagcagcaggccatcaatacagggcttggcagggggccttgcgcggacctggcaaggtcttgggttctgagcca

SEQ ID NO: 118965 - DNA, 1069 bp, Homo sapiens
cacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgctgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaacctgagtgctacttctctcagggaaagccagggagcaaggccaaatggccgcagaggggtcacacatgggatgtcccaggagtcctgggtggctgggcctggctgggaaacaggcagaccccgacccggctccagcaaggctgcggcggagacctcctcagcctggaggtttcctcagacacgagtcaactgcgcaaggcggcaggcaacagcggtgaccagggccgcacctttgccggacccatcctctgactgcaggaacgtgaccacacagcgaggggccagctcccgcactgtggccgccaccaggctggagaagctgtgagaggagggctgaggtgagcccaggccaccagccccacctggccacacctccctccccagcccgcacacccagactca

SEQ ID NO: 118966 - DNA, 1025 bp, Homo sapiens
gcgattctcctgcctcagcctcccaagtagctgggattacaggcatgtgccaccatgccggctaattttgtatttttagtagagacggggtttcaccatgttgaccagactggtcttgaactcttgacctcaggtgatccacctgcctcggcctcccaaagtgctgggattacaggcgtgagccaccgcgcccggccataggcaagtcctttatctccattagccttcagggggtggggaggattagactttattttcctccattttactgatgaggaaacagagactaagagatatgaaatggcttacacaagagtttcctgctcaagggtgtggtatgagacagcttctaaatcttggtcaagatgacagaaaaagaagaaactcacttctgagcaagcctcaggcatgagtttggcactaaaatcgtctgtgtgcctgattgtagcggctacattgagggagacatgcaggaggaactggagaggcgggaaaggaaaggtctcaagaacacaacttttgaccagataaccctgagaaagtccactctagactgtgtcacccacttggggcgggagcggcacctgtgtggcaaggtggcaaaaatgacatgtttggagctgaaacacctcagctcaagctcctgtcatgtcttaaactcaagtcataacacttctctatatccctcttcatcacctgtaagatgatcagcccaaccttgcagttgtttggagcatgaaaggagatcgttaccagctcagatatgaaaagctcagtggaaaggggctgcatgggtgagagcccagggccccatggcagcttcagtcacgctgctcttgaaggccttagacaagcatgaaacaggaacccagtgctgaacttaccagctctgagctgtctgagggcccgggcaagccctcctcagagcaactcagggtttcttccccctgccgcaaccctgaagacccaatggagtccatgagcttccacagtggaaggtggccacctatgggagaaaagggaca

SEQ ID NO: 118967 - DNA, 1025 bp, Homo sapiens
tagtgaggaaagactggttgtattaactgttctgagccacagttttctcactgcagaacttttcagagttttgtaaagattggagctcatgtaggcactcggatggctatcattactatatttcatagaggacctcacttgagtgtgtgtcataccagatagaattttgcttgggaaagtgtaaatccctcccttgagtgctgcaagctgggatagtacacaaaaaccttttcttggtgtggagtagatctttagatctcatggcttagcatacagcggaatatcttgtggcggacagaatattgtcaaaacatttgttttggtgcaaatgttacaatcgctattctcaattctagaaagattgagacttcccaaacaatgcacttcttccagtgggataaggttttaaactttgcttcttcctgtgcattttgtcttttatattcagagtctactggcagctaactatgtgtatatatatatattttttatattaaaagtattgactcggagacaaaaagaggccaagaccaagagtgacagtgggacagctgcccagacttctctagacattgacaagtaagtaggtatgctgcattcacggagctcttgtataacataccatcgtttggactgaataaaaagaccaattcctatcttaccctgtatttctttggcctgccaattgcttcattgcttggatgcctgaattttcttttcttttcttttcttttcttttcttttcttttcttttcttttcttttcttttcttttcttctctctctctcttttttttttttgagatgaagtttcactcttcttgcccaggctggagtgcaatggcgtaatctcagctcaccataacctccgcctcctgggttcaagcgattctcctgtctcagcctcccaagtagctgggattacaggcatgcgccaccacgcccggctaattttgtatttttagtagaggcggggtttctccatgttggtcaggctgtctcgaactcctgacctcaggtgattgg

SEQ ID NO: 118968 - DNA, 1315 bp, Homo sapiens
aggaattcttattatagatatgcctgagagttaacagagaaggaccaaggcctaaaataggcttgacttgtgactaagcaaaaatgtgtaagacctcagtatctctaagtaaaacttatttcttaaattagacaaagttgggacttgttctgttctatatatgcctacctaaatgtaatttgtaccctgtccagtcttctcacttatattaatgtggcctttgtggtacccaggataattaagtatattgctgcattgctactggtacgtagctactgagatattgacaattgtgaaatagcctaggtttcatagaagtaataaggattttggggacagactgacctgtggggatatatacaaatcaaatatgggccctgatctcactgacatttcagttcaattaggtagataagacatgaacatgcataactgtaatgcaaggtcagaactactaagggacatacaaataaaaatactgtagtgtttcagaggaaatacaattagagattgagaggggagggtattaatgtaagagaacggtaggctaaaatcacataaatagaaaaatgtgaagagtgtgtaggaaagaacaagcaattcagtgtagttatagtgtgggcattatgaaaggaaatggtgggcagttggagaatgacaaatgtaacttgaatcatgtgggttaacatttgtatgaattatgtgggtctacattatggaacagcatttttttcaactcaaataattattggtgagtgttactaaaataattatttgtgtgtttaccccccttgtggtatataggactcttggatgcaggtgttggaaatatgatttcagtaaccttaagcaaaaaaaccaagttaatgtgtgtaataattggcaagtctggttagggcttaggctgagctggatctgggagctcagataatgtctctccatctttgaatccagtggtctctgttcaacagatggcctcttcttaagggacaagcaaaatggctgccagcagccatagcttttaatggaaagaaagaatttttttttccctcagaccataggttagtctagaggaagactctgataggcctttcttgattgaagtgtccacttacggtgtagtcactgtaaccaagtagatgggtacaagtcagaacaagtaaaggaaaacccttttactaactatgagaaattctgttagtatctgtcagaaaattctgtaagtcacaataacagaaaacatcattaacagtgggtttaacacgtgggatttctttctcctcacgtcacaagtccagagtgaggcagttggctc

SEQ ID NO: 118969 - DNA, 1043 bp, Homo sapiens
agtggtgcgatcttggctcactgaaagctccgcctcctgggttcacaccattctcctgcctcagcctcccgagtagctgggactacaggtgcctgccaccatgcccagctaatttttgtattttttttttagtagagatggggtttcaccatattagccatgatggtctccatctcctgacctcgtgatccacctgcctcggcctcccaaagtgttgggattacaggtgtaagccaccacgcccagcctgcacctggcccatcttttaacgtattaacttattcttttacataggtaggctagaaatcagtgcagtgcagtggaccttgcatttcaacttatgtattcaaatattgagattcctgtggaacttgaactaagttccacgtttttcattcagaataaaccccttgtaggttttttccctctttttgtagtttgttttaatagaaattttacctagagacagcagctgaaaaatatcactaatttacattcatgtcctacatatcatatctctgctgagttaccgaggagctgttggtttatctctttaagagtgtaccagaggctgggcgcggtggttcatgcctgtaatccctttgggaggctgaggcgggtgggtcacctgaggtcaggagttcgagaccagcctggtcaacgtggtgaaaccctgtctctactaaaaatacaaaaaattaaccaggcgtggtgccgggctcctgtaatcccagctactcaggaggctgagtcaggagaattgcttgaacccgggaggcagaggttgtaatgagccgagatcgtgccattgcactccagcctgggcaacaagagtgaaacttcatctcaaaaaaaaaaaagtctgtaccaaaatccctacttttcagacagcataagacattgatcaagaaaatcttgttaatcacagcccttgaaataccacctctgatttggcctgtttatgattttaaactctaaatatagtcatgtcagcacagctctctgtggtctaacatgctgaatgtaaacctaggtaattggaa

SEQ ID NO: 118970 - DNA, 1003 bp, Homo sapiens
cgtgtacaaaaggagtgtgctaataactttgtaagattaaatgagtaatacatatagagtgtttaatacatagttgtcagtataaatatacttacatataaatgagtaatatataaacttactgataaacgagtaatacatgtagagtgtttaatacatagttggcagtataaggcactgaataagtattgactctatcagtagtatctctcaatctttactcctgaatttgataagctgttgttgtctctttgaaagtaagtgaaatatggggtggagtctcttgcagttcgttgtagggaatgatatgaactaaagctgttatgattgctgtttgtcatgttcttcaggttggtaacaaggaagatgctgagaaggaagtagctatttctaccttctcatccagtaaccaggtatcctgcccgctatgtgaccaatgctttccacccacaaagattgaacgacatgccatgtactgcaatggtctgatggaggaagatacaggtaaagacccagcaggacagccaaactcttacttttttgtgtggtggttttataatcctatacattacaatgcagggaaaaaacatagctgttcttcaaagttaaagttgttgttggtcttgggttttttctatctagttatttttctagtacttttatgttcatcattacttttagcaggtattttgtcctgttacacatgcctcaggagaaggggaagggaaaagtctttcattttttaatgtttttgtttgtttgtttgttctgtttgttttttgagccagagtctctgtcacccatgctggattgcagtggcgcgatcttggctttctgcaacctccgcctcccaggttcaaacgattctcacgccttagcctcccaagtagctgggactacaggcttgcgccaccatgcctggctaattttttttgtactttttttcagtagagacagggtttcgccatgttggccaggctgctctcgaactcatgacctcaag

SEQ ID NO: 118971 - DNA, 1017 bp, Homo sapiens
cctcatgatccacccgccttggcctcccaaagtgctgggattacaggcgtgagccaccgtgcctggccgaaaaatagttgtataatattttaaaagaagtagaaggcgagcggggagggatagcattaggagatacacctaatgtaaatgatgagttaatgggtgcagcacaccaacatggcacatgtatacatatgtaacaaaccagcacattgtgcacatgtaccctagaacttaaaaaatatatatatataaaagaagtagaagcaactctgcaaagaaatccctgactgcatggtcctaataaaagctgctttgcttgcctttttcccccttgaggttcttccctagtagttaatacttaaatagactttttaaatgatgctgggaaaaaataccttattttaacataaaaatgttcagaaaccttcagggttgcctatgaacagtggttggaagtgggcttatattcataataagacaagtgactactccctcttgaatacattaatagttaaaggtacattctctgcattgtatagagctgtggtgaatacaaaggagtatagtgctcaatgtgggcaccagtgacacatttgcgtcatgtaacatttctgtgcttagtgaactttagaaggccaagtaactgcccattcaccaccaactttaagtaattaaagactacttgcaaattttagggtatattgatcccctttacccccctgccatccttctgctcaaatggctttgctatttgtcttttcttttttgaggccgggtctccctctgttgcctaggctggagtgcagtggtaggatctcggctcactggaacctccacctcttgggttcaagcgattatcctgcctcaaccacctaagtagctgggactacagacatgcgccaccacccctggctaatttttgtattttcagtagagacagggttttgccacattagccaggctggtctcaaactcttgacctcaagtgatccattcggcttggcctcccaaagt

SEQ ID NO: 118972 - DNA, 1049 bp, Homo sapiens
ccatgcccagctaatttttgtattttagtagagatgggattttaccctgatggccaggctggtctcaaactcctgacctcaggtgatccactaggcctcccaaagtgctgggattacaggcgtgagccactgtgcccggcctgggatttttaaaaaagtttttacaatagaagttagatcctctccctggtctctgcgctgcaggtaactgggtaaatattctgccttcatgaatcatgcacactgcctggttctctggaacctgatctgtcacaattgaccaagattccctaatgccagtggtggtaggaaagatgatgacactccctgctgcagagtgactgacgacagatcctgctccataatgtcaaaatggcctctggattgttttctcaggaagaaacagaatcttctaaatgggaatgagggaatagaatattattaccatagtcatcctaacatacagaagaagcccttagttaaggctgatttcatacccatccatgactgcagacgagactgttctttgggtcaaagagcatgaaccctgtttagaatttatggtgtacacgtctgtgctactatatatcaaatagatggaatcataatagcctttctcacattgaatgtcctctttttggtgttgctgtttgctgatatctgtggatgtctctaaacagtcttagaagtttgcattaaaagggtgcagcacaccaacatggcacatgtatacatatgtaacaaacctgcacattgtgcacatgtaccctaaaacttaaagtataataataataaaatttaaaaaaataaataaataaatttttttaaaaaggggaaaactggagttttaactactagaccaagattacacattaaaagaatgactacataaataaatatagtaggaaaatattttaaaaaaaagtttccattaaaagaagttagatatactgtagattttaaatcatgtactagttacaagtcacttattagacagaatggaacattttatgtgcacaaagatagtataaagggtgtggactcttgcc

SEQ ID NO: 118973 - DNA, 2097 bp, Homo sapiens
caaccttgaactcctgacctcaagtgatcctcccgcctcgtcttcccaaagcattgggattgcaggcatgagtgactgtgcccagccaaactttttaaaaataaaagactagataggaaatattttaggccctgtgggccgtatagtctgttgagactatttggttcggccattttagtgcaaaaacagccatagacagtacatagatgaatgagcatggctgtgttccaataaaaccttacttagaaaaataggcagctgacaggatttggcccatgagctgtatctagttttctggcccctgaactagactacaagggaccccatcttagattttcatattactgatagcgagtataatgcctgggacttgatgttcaattatttgttgaattaatagatgctgcttaaagaatatattaaagaaaggcatatctttgtctagaatgtatattctatttctggtcccaatttctgtttttgctaatcatctctttaacctcagcactaacattggcaggttcttgttttctgtcaaatcagtatactttaaaactagaattacagtggaaataagccagttgatcagttggtcaatgaataaacaaattgtgatatatctatacaatggaatgctactcagcagcaaaaagtatgaactattgatattatgtgacgacatgggtccatctcagacacattatactaagtaaaagaagctggacacaaaagacatgtgattctatttatatgagagacaaaattataggaacataaagtaaactggtcattataaagagttcattgcagtgaccaaagaggtaggagattgactgcagaggggtacagagaactttttggggtgttggaaatgttttatatcttgattatcgtagaggttacatggtataaatggtagtatataaatggtatacatttgtcaaaacacattaaactgtatactgaaaatttatgaattctgttatttgtaaattatgcctcagtaaagctttaagaagaaacaaactagatctattaatatattgccaccacagtattgtcatatcctaaactttaggtgaaaataggcatgtttgtttttttaattatgaaaacacaaaatgaaaattaatgggattttaacttttttaaattacagagacccagctaagttcctctgaaacttttgaccttgaaagagaagtctctccaggtagcagagatatcttggatggagtcagaataataatggcagataaggaggtgaatattttcctctatattttttctcagtggtttctttccgttggcagtcctctctctgatgcaacgttgacattggctgaaaagatttaggtggcagggggttttagttttgggggcccttatgttagggagagatttttatagttaagattagttcagcattgtttctaaaaataacagtagttaccatttcttgagtacttttgtatgcattattatttctattagagatggggaaacagaggcttaggatgtttaatttgctctaaatcatactactaataatggtagaaatataatttgaacacgggtttgaatccaaagttacagggcattttttattatgtaccaataagtaacagagacaaacagtcttggaaaaaattactatatttatattatgatgtatacataacttccagccctaatttgatcagaaatgcaaagtcaagatagctgtctgataaaataaatctatttgcatcattacctttcctcactttacatatctggcagtaaccataaagctgattgatacaggttcatacttctgattaagattctcggtgtgtatatttttccttttcttttcttttttttgggatggagtttcactctgttgcccaggctgcagtggcagtggcacgatctcggctcactgcaacctctgccttcctggtccaagtgtttctcctgcctcagccacccgagtagctgggattacaggtgcacgacaccatgctcagctaatttttatatttttagtagagacggggtttcaccacgttggccaggctggtattgaactcctgacctcaagtgatctgccca

SEQ ID NO: 118974 - DNA, 1019 bp, Homo sapiens
tcataaaggtctttatttattttaaaaatcggactatgttggcttttttcttttttttttttttttgagacagagttttgcccaggctggagtgcagtggcgcagtcatggctcgctgactgtaaccttgaactccttggctcaaatgatcctcactcctcagcctcccgagtagctaggactacaggcatgtgccaccacacctaactaattttaaaaattattattattatttttttttagtagagacgaggtcttggtgtgtttcccaggctgaccttaaactcctgagctcaagtaatcctcccgctttggcttcctaaagtgctggggattaggcatgaaccatcgtgctcagcctatgttggtttttattgaaagtggctccttaattcatttgaaatgtgtttggattactgcctaacaatacccactaagagactacactaccgagtgctcagattttggcaggagcactcaagaatactgtgctacctttgtgaaaagaaagctttccccctctgtctgggactactgacttcctagaaggaaatcactcagtctgtttaggatgatggcgtgtgacatcaccatgggatcttgcaggaggaacctgcaaatatattgatcttgaaaggcctagttaatgagagggaaaagcaggcccttcatactgaggttagatagcttttatgatcatgacttgctgtcattagcctgctaattaagtccaactgtttgctgacataaaccacttctaaatgagattgcaaaaggtattcattacattaatgttccttttgctaagaaagtataactgcttcaccatgaagccaaactcctgggtttctttttaaatatataatttagaagttatatatataaattatctgaaaaaatttgttccaaatgggtgaaacacatatttagtgtagtagactgttacctgtttacttttgtttcatatttctgacagttcaggagtctaatatttaagattacaatatctttttagtgtt

SEQ ID NO: 118975 - DNA, 1030 bp, Homo sapiens
attttcctgctgttaagacagttttggaagtggttttaacagagtatgcctttactccctataggcctctctgctttattgtggtgagccttgtgcagagcagatgtaggttttaataaatgattatacactttgtcaccaggagagagttggaatcgcaggcaatgtggtttgacttcaaattgattagcccattttataaatgtcagaaaattgttttgtgatggaccctttgaatagagcactaatgttacatgcagagtaaactgtctggctggggtttataacaaatgctatgagatgttttatttagagataaatcacttgtggttttctatcaggatttagttatttatcatgagttcagttgtagctattctgtcttctctgtggttcttggttgatgtgaggatttttgttttcaagcatcctcttgcatacttgatcaaactaatcgtaaagccctgtgaagcatgagggggctagctcagatgctcagatcagccatgtattcctatgtcaggaagagattgcactccatgagcagtcagggaaaaccagaaggttggatgaaggaagccattcataattaagtttttgttagaaaagagattcaatttatgtgggcagatttttgctgtagggcagtttggaattgttttttatttttgttgcatggaaagcaacatcttgagataaagaggagatttaactgcaaaaggaggagaaagtgtgttgtcagaagaatctctgtgtcttctcttgtcagtttacaaatctctagccttcagaaggctgagatggaggctataaaacacctttgacatccttatattggagtggagtttttgccttctctgatattcacagacagttctcacccttcaaccttcctttgtgaaaactccaaaagggaatttgttttcattcagtgatttcactggaactgaagttgtaagcatatttattttccatatttctggtctggagttttcagtactgattccttgctttcctattgtgcttttgt

SEQ ID NO: 118976 - DNA, 1028 bp, Homo sapiens
cttaccagttaatattgatacaggtcttgcatgttatgaagtgcattgtgtacattatcttgtttaattttcacaacactctgtgaggcaattgttaatacccattttaagatgaggaaagagattcagatgtcatttacccaatcacaaatttagtaagtgatttagttctgatttaaataccagtcttctgactttacaggatgtgcttgttttattgacacttactggcttatggaaaatattttcttcttattgttaattgttgagggagaacattgaacaattaaatttttttaaaaaaggaagagaagccagttcacctgtgcctgtatatttaagatactacgtatttctttgcagtcttcccaagggattgttgaagaaacttctgaagagggaaactctgtacctgcttcacaaaggtgagagattatatgttgctatgcattctcctctgatggttgccagcataagggagatgaaccacatgagtgagactgtacgtggacagcttgccagagaacttttagctcttttataagtgaagactaggagaaattttattagtatctctaagttctcagatgtgcatctcatagaagcccagaatattaagagctggaagagatcctagaggtcatcttgtccaggccagctatcttggcataaatctcatttacattatttctgaaaagcggtcacatcctgcaattctcttaactaattacactagttttctatgccaatttgaaggctctagactgatttctttatagtccttctattcttagcccctttctctcttttccccaactctgcttatgcttattttatctgtatatctaaaccttatacatcttttaaatttactcttgagacttaacatcctcttcaaagtcttcatattattcaggccacacaggacctgtgtcactctcactgtctgtcctgtgccacttttaatccgtttgtgcctcctatctcctgtaaaggatggtatttgcattacctcctccattgttctt

SEQ ID NO: 118977 - DNA, 2543 bp, Homo sapiens
acctcaggtgatctgcctgcctcagcctcccaaagtgctgggattacaagcattagccacctcgcccagcctgaaatgattttaaatgtgaaggatacttgccagtggcaggtcctgaaccatctttttatgccatttgcctccctgttttaaaaaagggtttagtatagtgatctagtacaacactttgcacatagacattcagcatatgctgtgaaattaaattgagccatttacattttagaaagagaaagtcttatgaacggtggcctcccattttgtccttcctgtgacccttcatatatagttattttaataataaacctggtctggtatgggatcacttgtttcagagttgccggccttctgatgcttccgctaccagatctcgacctctggccactggaccgtcttcccagtcccatcaagagaaaaccacagactctgggctcactgaaggcatgtctccctgttctgactccttccattcatcaagtataactgtaccacagggatctcatgctgagagtagatacacggaaataccccagatccttttggtgataataaagaagttaaatcaggaagtagttgagatcataagaatatccggcatacttttatctccaaggaaaaaccaacatttggttaaacccaaagaagagcctttcttacccatattatgtaattcttggtaagtgataacttaccaagccctcttaataaaaaagtttgtccttagccctactttttctcaaatacctacaggcatatggcagctggtacctccatcactgtttaaaggctcacatatcagtcagggaaacgaggctgaggaaagagaggagccttgggaccacactgaaaaaactgaagaggagccggtctctggcagctcaggaagctgggaccagtcaagccagccagtgtttgagaatgtgaacgttaaatcttttgacagatgtactggccactcggctgagcacacacagtgtgggaagccacaggaaagtactgggaggggttctgcttttctcaaagctgtccagggtagcggggacacatctaggcactgtctacctaccctagcagatgccaaaggtctccaggacactgggggcactgtgaactatttctggggtattccattctgccctgatggagtagaccctaaccagtataccaaggtcattctctgccagttggaggtttatcaaaagagcctgaaaatggctcagaggcagctccttaataaaaaaggttttggggaaccagtgttacctagacctccttctctgatccagaatgaatgtggccaaggagagcaggctagtgagaaaaatgaatgcatctcagaagatatgggagatgaagacaaagaggagaggcaggagtctagggcatctgactggcactcaaaaaccaaggatttccaggaaagctcaattaaaagcttgaaagagaaacttttgttggaggaagaaccaacaaccagtcatggtcaggtaagggtcagtgatgctgtaattaaggatgatttattcacagattaaaacaaggattattttagctgttatttttgtggtcttcccctccttgattattaaagtaatacatgttcactatagaaaattaggaaagtacaggagagtataaagaagaaaaaaactaccatttttttttttttgagttggagtctcgctctgtctcccaggctggagtgcaatggcgcaatcttcggctcactgcaatctccacctcccgggttcaagcagttctcctgcctcagccttccaagtagctgggattacaggtgcttgccactatgccctgctaatttttgtacttttagtagagacggggttttaccctgttggctaggctggtcttgaactcctgaccttgtgatctgcatgccttggcctcccaaagtgttgggattacaggcgtgagccaccacacctggccagtcatcatttctatgcatacaaaaatacatgaaaaaattttttgaacaaaatgaagactcttctgtgttaagttttgttcctctccctactttatagtttatcttagatcatttcttaatagatgacttattctaccatagataaaccataatttattttttgtataaattttttttttttttttttaaagacaaggtctcgctctgtcacccaggctagagtgcaccgatgccatcttgggtccctgcagcctccacctctgggatcaagcgatcccccaacctcagcccgtcgcaatagctgggaccataggtgcacgctactacgctgagctaatttttatattttttgtagagattgagtttcactttgttgcccaggctggtctcgaactcctgtactcaagccatccacctaccttgttctcctgaagtgttggcagtgtaggcatgagccaacacgcctggtctaaaaattattattatttctgaaaggttaaatttttgaataggtaacaatattcacatggctcgaaattcaaaaatatataagtaaaaagtcttaacttttctc

SEQ ID NO: 118978 - DNA, 1014 bp, Homo sapiens
tacaaaaatacaaaaattaggctggatgtggtggctcatgtctgtaatctcagcactatgggaggctgacacgggtggatcacctgaagtgaggagtttgagaccagcctggccaacatggtgaaactctgtctgtactaaaaatgcaaaaattagccagtgtggtggcgtgtgcctgtggtcccagctactcgggaggctgaggcaggaggattgcttgaacctgggaggcagcggttgcagtgagccaagatcgtgccattgcactccagcctgggcaacaaagcgagaccatctcaaaaaaagactaagttgaatagcttctagaaaacttatactttaagtaaattatgatctttttattctagacaaaattattgtccttttattctagacaaaaggatgccacggagaaagaaaaaagttaaagaagtctccgaatctcggaacctggagaagaaggatgtggaaactaccagttctgtcagtgtgaagaggaagcgtagacttgaggatgcattcattgtgatatccgatagtgatggagaggttagtgaagtagagctgaaaagtagagctgtagctctcaaactatgcttctttacccatggggagtttgtttcgtgactgacttcaccttaatgccagctcaccaaaaccatgaaatttttactcagctttgttttaatttgtaaatggaatgaagaattacttaaggtagtaatcctgttgcttggttgaggatggatcatagttcttcagttttataatatagtaatccaaagtggcattttggaactatttgaatcatctaaatcaattgtaaatcttagttttcatgtgtctagaaagtgagaggaaaaacacgtgaatgttcttaagtctcttgatatgttctacatataatagcacctagccatctgtagctgtttaaaaataactaaaattaaaaatcagcttctctgttgcactagtcacatttcaagtgattaaagacacataaggctagtgtca

SEQ ID NO: 118979 - DNA, 1031 bp, Homo sapiens
aagtcatggaaattggagtccagttttcatgtcaggagacaaaagtgcaagtgcctactgtgtttgggcaagttacttttctgaacctgtgtttcctcataatgatatattctggtttcttaggatttattgaaatattcactcatcaaatatttattattattattattatttttgagacagagtctcgttctgtcctgagctggagtgcagtggcacgatctccgctcactgcaagctccgcctcctgggttcatgccattctcctgcctcagcctctcaagctgggactacaggcgcgtgccactacgcccggttgattctttgtatttttagtagagacggggtttcaccgtgttagccaggatggtctcgatttcctgacctcgtgatccacctgcctcggcctcccaaagtgctgggattacaggcgtgagccaccgtgcccagccatatttattatttttaaaaactttttattaagatatcatttatatacagtagagtgaacccgtcttaattgtacagttcaatgtgtacacccgtgtaagtaccaccaaggtatggaacattttcagaaggctcccttgtgtctttcccaatcagtaccctccagaggtaaccgatgttctgacttggatcaccagaggttaattgttttattttttatttttatttttttgggaaaaggtctcactgtcaccagtctggagtgcagtggtgcaatcatagctcaccacaacctcgaactcctgggctcgagatcccttctcctcagccttctgagtagctgggactacaggtgcacgccactatgcccagctaatttttttttttttgtttttttttttttgagacagtcttactgttgctcaggctggaatgcagtggtgcgctctcggctcactgcaacctctcccttctgggttcaagcgattctcgtgcctcagcctcccaagtagctgggattacaggtatgtgccaccatgtctggctgattttttttttttttttttttttgggaaacagag

SEQ ID NO: 118980 - DNA, 2122 bp, Homo sapiens
agagctgggagctggcacttggaactcaacaaatagtatgtattattagcagtaatatggaaccttagctgtactactacttactagtagcgagctcttgagttaaccatttttaggttctgggcctcagtttccctgtgaatgaaatggcgaaaacactcccacataacgggaccttgagaacgaaatgaaaagtatcaagggctgaccgtgagcaaggtgagagccatgagccaaaaccacacgagcctctccgggaggggggggtcactgctgcggaatcagcgacaggtttccgaatccacggcacacgctctgaggtaccagaggtagcaaagcaaaataagcgcggggtcccgcacggcagcgcgggtgcagcgcccaaacctcgcgagatttgttggctgggccaagtaccacccaccaaatctcgcgatacctaggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaaggtgagtcgggggctttggaggcagaaagcccctcgcccgctgcgcggctcgcggggaactgcggaagcgccgacggtcacaccccctggcccgcctccttgcgtgctgcgccccgggacccccagacttgtgctccccatccgggcgcgggcaccccaagaatcgggcccccagcgcgctgagggtgaagggccgctcacgctcaggccctgggttttcctcctcctccttcatcattcactacagcgcagtttttcccacattcgaggactgtcatccctatactcgtcctgtcggagacctacagtctttgccatcccggtaagccaagccgagtgcccctcaccactccttgactccccatcgtcccaatctccagatttcctcctagggcctctcgcctcccttctctcaagccccacacttccgagggctctggaaggccttctccttaccccctgggttcctcctggtcttgatgactgagccctggcttacccgtttttagctctctggcctctacttgctgggtcccttattctaaggtggggacaaggagcctgagaaactggtctgggtttgctttggctccagcttctttgtgtcctacacttgacccaaagttgctgagaacagtgtatgcaaagccacgttaggggtcactcctgggccgaagcgccccagcttgctctgcacttgacctgagactgggtaagatgggatgaaagaaagagaaggatggaaaagagctgtcctgacctgcttgtgtgactcccttcactgtcctttacagagccagctgcttgatgctaacccagatgtacaagaactctatctgggcttctctgctaaccttgtcaggtatctggagggaaatcagatttctccagtgatttgtttgcttgctgagcagacttgtcttcgaaagtttaatatgctatttgtgaactgactgccctggataaaattggataaaattgaaattttgaccatatctaaggaaggtacacagacctataccctggtatatacttctccaatttaaaaacaagtctagcctgtctcctaagtttatatatatatataatgtatattatatataaaaaagaaggagacagggccccagaaatggtgtgtgtgtatgcgtatatataatatacacacacataaatgtatatatataatatatacacacataaatctgtatatatatttttatatacacttgtaagtattttatgtatacacacacacacacacacacactatttctggggccctctctccttttttttttttttttttttgagagagtctcactctgtcacccaggttggagtgcagtggcacaatcacactgcaacctccgcctcctgggttcaagcaattctatactgcctcagcctccggagtagctgggattacaggctgctgccatgacgctcagctgatttttgtatttt

SEQ ID NO: 118981 - DNA, 1816 bp, Homo sapiens
gggttcaggcgattcccctgcctcagcctctgaagtagctgggactacaggcacgcgccaccacacccagctaatttttgtatttttagtagagatagggtttcaccaggttggccaggctggtctcaaacctctgatctcaagtgatctgcctgcctcagcctcccaaagtgctgggattacaagtgtgagccactgcgcccagccgcctggctgattttttaaaaaatttttcgtagagacagggtctcgctttgttgcccaggctggtctcaaattcctggtctcaagtgatcctcccacctcaggctcccaaagtaccaggattacaggtatgagccaccacacctggcccttttctcacaatttataattcagaaaggcaagataaactctatgaccctgggcaagttattttacatatttgcaccctattcagagatcaggctttctgagagagatgctgggatccctttatgtagtcttgaaatacatggtttcctagcctaatcataatcaacaagtagaacgcaatgggaggctgggtgcggtggctcatacctgtaatcctagcaatttaggtggctgaggcaggcggattgcttgagcttgggaattcgagaccaccctaggcaatatggtgaaaccccgtctctataaaaaatacaaaaattagccgggtgtggtggcatattcctgtagtctggctacttgcaggggtgggtgggagaattgcttgagccctggaggtggaggttgcagtgagccgagatcgtgccactgcactccagcctgggcaacagagtgagaccctgtcttaaaaaaaaaaaacctaatggtccacttgttcagcaaactctgagcatctactgtgtgccagactccagctgggtgtgaaggataagaaacaaaaatgagtcaaatagtccgtgttccaatgtcacacttgagttcacagaaaagtctcctaagctatgacactgtcagtttagggtggcaagtggtatgacagaggtctatttaatgtactctgggagcacagaagaggagcagggttaattcttcctggaatacacaaagggacttgacagttgtttactgaatgatgtttttttttttttgagagaaagtcccccagaggaaaagcttatatttaaattgggtcttgaaggctaagcagacacgctgccaagcaggaaaggaaggaagcacattttagacagcaggaatggccaaagcaaagcaaggaagcatcagagaataaagtgggggatggtgagtagagtctgggacaaagtagctggagaagaatctagaaagtaggttggggttaatgtgtgaggggggccataaatgcctgttctgttatgggcagtggggaaccattgaagattttctggtggggcagtggtatgatcagacctgtgttctttcttccaaccagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaaggtactggttttcctgagtagtgctatagtgggacccctgccgtcctcagggcactactgccaggggctcacagagatcctcactgaggccacagacttgaagaagttgaattgcttttgagaacccttaaaaatctccaagtagacccagcttcactgaaatgcaatctcagaattatgctcacctaacctccctttctttggttataggtttttctctataggctg

SEQ ID NO: 118982 - DNA, 1060 bp, Homo sapiens
cctttttgtgtttactgacaactgtgttttggaagccttcaaaggtagggtgaaaaatcactcataattttttttttttgagatggagtctcgctctgttgcctaggttagagtgcagtggcatgatctcggctcactgcaagctctacctcccaggttcatgccattcttcagcctcagcctcccaagtagctgggactacaggtgcccaccaccatgcccagctaatttttttgtattttttagtagaaacggggtttcactgtgttagccaggatggtctcaaactcctgacctcgtgatccacctgcctcggcctcccaaagtgttaggaatacaggcataagccaccacgccggccaaaacctttttttttaaatagagatggcttctcactatattgctcaggctggtcttgaactcctggccttaagtgatactcccatctcagcttcccagagtgctgggattacaggcatgagccaccacacctggccactcataattacacctttttatcacacccacatctagttattcatggtatgaaacagcagaatgtggactttgaagtcacagagtcccaggtttaaagcctggcactgttactgtttatatgacttttttgtgtctgaactgcctaacctataaaatgataataatactgtctacttcatcggttgtgaggatacaataatgtgtattaaaaacacaggacataggccgggcatggtggctcatgcctgttgtaatcccagcactttgggaggctgaggtgggcagatcacttgaagtcaggagttcaagaccagcctggtcaacacggtgaaacccaatctctactaaaaataacaaaaattagctgggtgtggtggcacgagcctgtagtcccagcttcttgggagactgaggcaagagaatcgcttgaacccgggagctggaggttgcagtgagctgagatcgcaccattgtacaccagcctgggggacagagcaagacctcgtctcaaaaaaaaaaaaaaaaaaaccaattttataaggtcacagacttctcttcccac

SEQ ID NO: 118983 - DNA, 2120 bp, Homo sapiens
aaatcctcaaaacttccccagttgaagtgatacaggtatggaagagcatctgagacatatcatctgtgagtcctgctgagccccatcagtcctccaccactggtgggggcttctgggccccacatttttaaagcagtagttgctaggttgacaccatttcagccacatggacttgttagtgagtcgtggcatccgctttatgaggcagcagcgcagcctagagtcaacatcaagccatatgttgatgcacaagaggctcgcatgtatgcctataccaggctctgattcactgaattcattggccagaatcagggatgttttctgaaggcgtaagtaagagctatagccttcaggtcttcttgccacactggcagcctggcatagcaaagagagcacaggctttagggtcacagacctggcttcactcactggctgggtcaccttgggcaagccacttcactcatctgagcctcagtttttctgaataatgtggcaaagtgatacctacctcattggggtagttctgaggaccaaaggagaaaatatatgtagaaaacacatcactaatttttttttttttgaggtggagtttcgctcttgtcgcccaggctggagtgcagtggcgcaatctcggctcgctgcaacctccgcctcctgggttgaagtgattctcctacctcagcctcccaagtagctgggattacaggcacacgccaccatgcccagctaatttttgaatttttaggagagacagggtttcaccatgttggccaggatggcctcaatctcttgacctcgtgatccgcctgccttggcctcctgaagtgctaggattacagatgtgagcaaaacgcataactaaatgttaatggtcctcttttctctctactcagcctataatatgcaatgtagcctaaaaggcatccctagtatggttaccttttctgaatgaccttgtatgagctccaggaactcaagcctcaatttctgtatctgtgcatttgttcccagctctgcaactgtattactttaaggatgagaataaaactcccaaacttcgtgtcccacttgctgtgaagttctgggaagtactgaggtatccctgcaagagtgcaagtgtgcatctctagtctattgtaacttggcagcctgacaggagaagctcagggcctcctaagaatatgagaaccaccaggatttgtgggcttaaagtagttaaagccgctgaatgaaatagccagtctttgggctccctcaaatcttcccaggtttcccaattagagaatgcattcacctgtgtgactcacacaggcagtgccacatctgcagtaggattaactggtgtcacagccctttctattcagcatactcaaaagcctgacaccttctgggttttttcattgtttctgtttgaactctctcactgcagctctgtcaaaacgccttacaaatcctttccttgtggcctccaccttagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccaggtgagggggcctagctcacacccagagctggaccagggtttggccactggggctacccggaccagctgacgttgtgcttttcctccttaggtcttgtaagtagggtttgcgaactcagatggctacagaagccagatgagaaattaaaatgagagccaggaaggggatatggtcagctgaagagtgaatgccattcctactcagctgttaccatatctttcaggttttcttttcttttttttttttttttttttttgagacagagtcttgctctgtcacccaggctggagtgcagtggcgcgatctcggcttactgcaagctccacctcccaggttcatgccatccttctgcctcagcctcctgagtagctgggactacaggtgcctgacaccatgcccagctaatttttttgtatttttagtagagacggggtttcaccatgttagccaggatggt

SEQ ID NO: 118984 - DNA, 1050 bp, Homo sapiens
cactttgtcattggagcagccctgagatagggtctgtgattcccagggtagaaagacagattgattatcataaccagcgttctcactaattactgttaccgcaagccctaggagagtggcaccttcccagagatctctcagtgaaggacgtccttaatgaggccacttagcacagtcaaggtagaaatacagaccaaatgtcacctctctgttctgtcattcttttatcactcagcagacagctagtctgggccaggctctacgctggaacgagggacacaggaatgaggatcttcccaaccccaggaagcacataggcacacagtctgtgcctccttagcactgtggcctctgggttctcatcagggccagcaacctcacctcgcctcacctgtccgtccttagaagggcatttgtacactctgaaaagcaacggtcttcaggttccttctttctggattactaagatcttgattttgatgtgtttcagctggaaagggctacccctgcaaaacatgtaagatagtgctgaactccatagaacagtaccaagctcatgtcagcggcttcaaacacaagaaccagtaagtaaccattttttgaaattctaggatccatagcaggagctcaggacttctgcatcagaacaaagccaggtagttctcggctgaaatggaatcctggcagtcttttttcagtgaacagaagatgaatcatgtaacaggaacaagtgtctcctctatatgtatttctccaccagcttctgcccagcctttagacctgttggactcaagggtttaatagagaagcatacatgatttccttggtgggaccctaagaacacctggctgtcctagtctgtagcactctgactggggaagtgcttttccactggcctggagaccctctccttttctggcaggagttccctctataggtcattatcaaatatgaccaggccctctcattccttaatcaaatatatattgagcatcttctgaatgatggccaagacagacccagtctctgctctcctgaccttacagcctg

SEQ ID NO: 118985 - DNA, 1790 bp, Homo sapiens
actgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtttgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtcccagc

SEQ ID NO: 118986 - DNA, 1037 bp, Homo sapiens
gcttccagcaagcattcatctatcactgtgtctgcgagagaggactggccttgcagggcgcagggccctaagctgggctgcagagctggtggtgagctccttacctgggtgtgtgtgcgtgtgtgtgtgtgttctgtgcactgggtgtgtgacctaggaggtccaggcagcatgtgtggtataagcattatgagggtgatatgccccggtgcagcatgaccctgtatgtggcaccaacagcatgtgccttgtgtgtgtgtgtgtccgtatgtgtgtgtgtgtatgcgtgtgtgtgtgtgtgtgtgtcttggccactgtcgtgtgcactaaatgctgtgtgtgtgacatgccccaagagtgtggcatttgccctgggtgtggcatccgcagcatgtggctgtgtgggtgtcaaggagtggtggctccttcagcatgcgttgcaaagtgcttgtgccctgcatgtgcggtgtgttctttgtacacaggaggctgcctcagatggggctgcggggtctgctgacctctgccctctgcccacagagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtggtaagagactctagcagggagtgaagggatgcctggggagacagacctgcccctcttggaccttagatgcttccctctgtccctgatgtagactccttgacctccagcaacgatgatgaggaccccaagtcccatagggacccctcgaataggcacagttacccccagcaaggtcagtaggtctccaaggacttgtgtccccgctgctgctcatctgatcactgagaagagga

SEQ ID NO: 118987 - DNA, 2462 bp, Homo sapiens
cggcctccgcctcccctcaggtagcaggctgcggggcgcggggccggctgccctcccgcagcaaactttgcttgctgctgaatattgatgagagcgatcggctcggctgggaggtgctgccgcggctgcgggaaggagcgcggcccgggcaggcggcggcggcgtcggcagcagccatgtttttcgagctgtagcagctgctgctaccctgactgggcttcgctggccgcctcggtttctccctctgccgggtccaggcctcttcgccctgcagctgcggatccagcaggcctgcattcaggaaggcgagctctggggtgcagccgcctcggccggctcgcctgcggcctgcgcaccgccgctgcaaaggctccggcgctggctgggcgcagggtgcagcgctattgtgaccgctgcgccctagcgagccaggaaggggggggtacctttttgtgcagggtccaggagcccccctcggaccccgcagccttttgcttttgagagatccagctgctcgacccctggcgagggagggggaggactagtcctgtttgagaattgggaattttgacgggcagaggggttttaattttagttcatcccaagtgtccaccagtctacagaggaggaaaaagagacgggctgtttctatgtagcaggatcggcccagcttcgggaaaatggagttttcagaggctcatcgaggccattttttcatctccagtcgggggaactttttctgcccatggaagtgcagcagaaaggcatagaggccactaggccttgaagtggctgccattttaaagagtcgagtcagatggcctattaactcagattaattgctgtgcttttggattccaggttgatgccggcccaggatggatcagacctgtgaactacccagaagaaattgtctgctgcccttttccaatccagtgaatttagatgcccctgaagacaaggacagccctttcggtaatggtcaatccaatttttctgagccacttaatgggtgtactatgcagttatcgactgtcagtggaacatcccaaaatgcttatggacaagattctccatcttgttacattccactgcggagactacaggatttggcctccatgatcaatgtagagtatttaaatgggtctgctgatggatcagaatcctttcaagaccctgaaaaaagtgattcaagagctcagacgccaattgtttgcacttccttgagtcctggtggtcctacagcacttgctatgaaacaggaaccctcttgtaataactcccctgaactccaggtaaaagtaacaaagactatcaagaatggctttctgcactttgagaattttacttgtgtggacgatgcagatgtagattctgaaatggacccagaacagccagtcacagaggatgagagtatagaggagatctttgaggaaactcagaccaatgccacctgcaattatgagactaaatcagagaatggtgtaaaagtggccatgggaagtgaacaagacagcacaccagagagtagacacggtgcagtcaaatcgccattcttgccattagctcctcagactgaaacacagaaaaataagcaaagaaatgaagtggacggcagcaatgaaaaagcagcccttctcccagcccccttttcactaggagacacaaacattacaatagaagagcaattaaactcaataaatttatcttttcaggatgatccagattccagtaccagtacattaggaaacatgctagaattacctggaacttcatcatcatctacttcacaggaattgccatttgtaagcagtttttggtacaacttaaatatatacatatatgtatatatacaggccacttaaagggaaacttgtaacaaatttgtttttggttgcttatcagttcacagctgaaatcctattgctaatcataagctttgggcaaaattttactttgatttttaaatttatctctgttgtatgaatttggttgttttaagctttttccaaataactcttcattgagagtaggctaatgcttttaaaggcatttgattgagttcaggtttaatttctcaagttggaggtatacatatatgattaaaaaaaaaaaaaaaagatgggttttggcctgccagcaccatgagtgcaggtgaaccaatttagtacttggagtcctgttgctatatgtggcagattatttttttacttgatgacttgactcttacttcaggttgaagggcattttgaacacagattaaagtggctaagatgaagttttcttggacattgtcaaaatctaaattaggctagtttttctgaactacctgttttgaaggtatagcatcctgtgcttttgataactgccaccattagctcttttttttttttttgaggtggagtctcactctgttgccaggctggagtgcagtggttgatcactgcaacctctgcctcttg

SEQ ID NO: 118988 - DNA, 1248 bp, Homo sapiens
gtatgtgtgatatgtatatattccgtgtgtatagaaatggagagtatcttatttgagttgttgttttcagtaatgctgtcaagtattgttagagggtgataaatgataacatttgtttttatttgagcttatgaagaatttcttgactttctagctaaatgatcagttcacttctcttagcctcaattttattgcgtctaaattccagaagttcttgattgctataagattccttcagctttaaatattaatatttgatattgattttgtttctgcccaaacacattgtttggtcaccgccggtaatgttagcaaagagaattttttttggccaacaaatgtctcataccacattcagtttttataagaaaaacttttatggtatgttgttattctgagttcattaaacattcgctttaccttatatccctgctgttctttaaagttacagagggagaatgtgggtgtgtcacttttgtttctgttgatttgtatcttaattatgccttggtactccttggtttcttggcaattgcagatttaaaaaaatttgctttagtggttatcttgagtctgaattgtcctacacattagggtgggtaggctgttttgaaaacctattggcagctcagacaaatcctttttcttgggttcacgttgaaatttattttatatatatatcgtgtctttgtttttgcacataaatttaaatctgagaatggagatagatgtttctctagaagcatacaaatagaattgtaaacctgtttctcgtcaaagagatgttagtggagtattggttctattaaaaaaaaaatgaaggctgagtgtggtggctcacacctgtagtcccagcactttgggaggctgaggtggacagatcacctgaggtcaggagtttgagaccagtctggccaacatggtgaaactccgtctctacaaaaattagccgggcgtgatggtgggcaactgtaatcccagctactcgagaggctgaggcaggagaatcgcttgaacccaggaggcagaggttgcagtgagccaagattgcgccattgcactccatactgggaaataagagtgaaactctgtctcaaaaaaaaaaacaacaaaaaaacaaacaaacaaacaaacaaaaaactgaaaatattggagcctttagatagtaggttacatgtctaaaatgggagttagcaaatgtataaatgtagaagtttttttttcagggagaaattgaaattgctcaaa

SEQ ID NO: 118989 - DNA, 1121 bp, Homo sapiens
caacctccgcctcccgagctcaagcgattctcctgcctcagcctcctgtgtagctgggattacaggcacccgccacgacgcctggcttttttgtatttttgtagagacaggttttcactgtgttgtccgttctggtctcaaactcctgagttcagggaatccaccgccttggcctcccaaagtgctgggattacagtcgtgagccaccgcgccctgccacaaaccatactttgaaaacgttgcttccatttttagataatttgttaggaaaccaataaaatcatacatacttgtgattttcccttagtaaaacacaaattttagtgttttttgctgttattattaatacttctaaagttcctttcacattgctagtgaccttatataaaataccataatgctcttctagcaattgctggaaagataaaatctattttagagaatgaacaattatattttcacattagattaaattaaaagtaattactggttatgtgatattccctcacataccagagtgagtctgaaggtagtctttctttgtaaattatgaggctatatttcctgtgttatctctgatttctcttgatgctgtaattggagttgttgggtctccctggtgaaagtaggtgatgtgcaagttgtgtctatacccagtgaaaataacagacattaatgctacactaatttgtcattggaattttacattcaaaagcatttctttttaaaaatatgattgtaaattggtaatttatagttgtatataccaaaggcatttctttaacgttatagttggttcaactgaaaatacgttaagtctgtttttataattagtatattgaggaacagcacttccatcgtgtcacaatatattaagaattgccagcagggcacggtggctcacgcctataatcccagcactttgggaggcctaggcgggaggatcacctgaagccaggagtcgagaccagcctggctaacgtggccaaacccctatctactaaaaatacaaaaattagccaggtgtgatggcgggtgcctgtagtcccagctactcgggaggctgaggcaggagaatccagaattgaattgaacccaggagacggaggttgcagtgagcc

SEQ ID NO: 118990 - DNA, 1044 bp, Homo sapiens
gggtttctccatgttggtcagactggtctcgagctcccgacctcaggcgatctgcctgccttggcctcccaaagtgctgagattacaggcatgagccctgcaccaggcctaatttttgtatttttagtagagacggggtttcaccatgttggccaggctggtcttgaactcctgagatgaggtgatccgcccgccttagactcccaaagtatggggattacaggcgtgagccactgtgcccggctgatttaaacattctcaattattctgttgatgccaggaaggtgttaggccatttttctaatgtttacattgtccggaatcaccttttagtatatttacgtatttctactttaatcaggtttgtatcattttttataatataaaagctgaaacaattgtaaatgtttattaataattttgaagtttaaaattttaatttggagtatttcctttaaatgctattgtttgtttttcagttgattgttgtgtttgaatcttaggtaccttagttttaaattactctaaaggatggggctgaaacttgatttatttttattttattttattttagagaagaatttctgctctgtctcccaggctggagtgcagtggcgtgatctcggctcactgcaagctctgcctgctgggttcatgccattctcctgcctcagcctcccgagtagctgggactacaggcgtccgccaccatgcctggctaatttttttggtatttttagtagagacgggatttcaccgtgttaaccaggatggtcttgatctcttgacctcgtgatctgcctgcctcggccttacaaaatgctgggattacaagcgtgagccaccgtgccgggccaatttttgtatttttagtagagatggggtttcaccatgttggccaggctggtcttgaactcctgacctcaggtgatcctccttcctcagcctcccaaagtgttgggattacaggtgtgagccactgcacctggcctgaaacttgatttgagctgtccttttttctgttaggatggtagtgattttatt

SEQ ID NO: 118991 - DNA, 1816 bp, Homo sapiens
gtttttcacgttttcttgggtttttttttgtatatatatttttgttgctgtgggcttactatatacatcttctgtatttttggaacaatgaaattatagactgatagtgaaggaaacttacctgtctactatcttaatttcttctttgtagttaatctacatttagctggttttgaagctataccacgtcatcagactagactactgattctttcataacctcctgtgtattttcttgccacacatatataatacttaaaattttccttgtgtatgatctattctaggttgtctagttcagtgggcatgttagttgtttccagacagtcttctttggcggcaatgatgtggctgttctcttaatgatgagaagtaatttctttgatctaatgattctggttctcttacccttacctagtttccaaccggaggccctatcggcagtactacgtggaggcttttggagatccttctgagagagcctgggtggctggaaaagcaatcgtcatgtttgaaggcagacatcaattcgaagagctacctgtccttaggagaagagggaaacagaaagaaaaaggatataggcataaggtaggaaacgaaaaaggctttttattgagtgacagaagcaagtaagaaaaagaaagaaaatggcctcttatttattttcgagacagaactttgctctgtttcccagattggagtacagtggtgcaatctttgttcactgcaacctccgcgtcccaggttcaagtgattctcgtgcttcagcctcttgagtagctggtattataagcgagcaccaccacgcctggctaacttttgtatttagtagagacaggatttcgccatgttggccaggttggtcttgaactcctgagctcaagcagcttcccaaaatgctgggattacaggtgtgagccactgtgcctggcccggccttttaaaaatcattatctacttgggagttagcagagaggaggcagggaagaagcattatatttttgaaatgtaagttatttcctttggtagtagaatatctgtgagaaaagagctagggagcagatgcaggtgggttttttttgtttgtttgtttgtttgtttttcctccccagtgggctggggctagcttgtgacatatttatactaaattttttgataaattattttagtcaactttactgtgtcactcagtagtgaaaattatgacatagcgtgaccattcttttgttatcttttatgcatgatgaaagtatcattaaaatgaaatattctgcttcttgccacttggactaattatttctgttaatgagaataatgtggtttttttgtttgtttgtttctttgtttttggagacagagtctcactctgtcacccaggctgaagtgcagtggcacactcttggctcactgcaacttccgcctcccaggtttgagccattcttgtgccttagcctcccaagtagctgggattataggtgcccgccaccacacctggctaatttttgtatttttagtagagacaggttttgccatattggccaggctggtcttgaactcctgatgtcaggtgatcaactcgcctcagcctcccaaagtgctgggattacaggcgtgagccactgcgcccactgagaaccataaagtttttaataattttcttttttatgtttgtcagtgcttaagtctaaagtttctactctagttatatttcaaccatcagtattgtggctttttttcttttgcttgatgttttatgttaaatttggctgagaaaaataccagcttattttaatactcttttttcctccagttt

SEQ ID NO: 118992 - DNA, 3473 bp, Homo sapiens
aactacctggctggttccataaaagcaggaggcctgacaggtttgtaaaagcttctgatttcaggccgggtgcggtggctcatagctgtaatcccagcactttgggaggctgaggtgagcggatcacttcaggtcaggagtttgagaccagcctggccaatatggtgaaacccctattctactgaaaatacaaaaaattagctgggtgtggtggcgggtgcctgtaatcccagctactcgggaggctgaggaaggagaatcacttgaacccgggaggcagaggttgtggtgagcgaagattgtgccactgcactccagcctgggcgacagagcaagactctgtctcaaaaaaaaaaaaaaaaggaataaaaaaaaaagcttctgatttcatctcccttttcccccacccatttctttgataagtgataattctttttctcctttaaatttaaggttcctcagaaaattttgagtaaatgggaagccagtgttggacttgcagaacagtatgatgttcccaaggggtcaaagaaccgaaaatgtattcctggttcaatcaagttggacagtgaagaagatatgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtaaggacatctaaatgtgataaaaaaaaaaaaattggagaaagtgctgataaacattgtccttctgaaattggtctgttgtaatggtaaagtgaagtataaactagcggggaagaatcatcacttcaatgaagaaggagttttatgtagaaaggtctgaattttgaagatgagatttccatatatattcaaaagttaaactttaccagaagcccttttccccaaccttttcaagtaaatctctataacatctttctttctcactttctctctctctctttctctctctctcttttttttttttttctaattttttttttcttttgagacagggtctcactgtgttgcccaggctggtctcaaactcctgagttcacgccatctgccagcctttgcctcctaaagtgctgggattactcttgcctgacctgttccccgtttcttaccttttaaaatcccc

SEQ ID NO: 118993 - DNA, 1039 bp, Homo sapiens
ctgatcccaagcgtttcagataaggcatacttagcctgtaactcaagatgtattttacctatttacctgatctagatgctacatttttgttaggtatatattagctttatatgtacaggtgtcagtgactataagacctggctttaaatttaaccttttccttaattttggatgggccacatatattctattatttgtgtatataaggtaacacaagtccttttgtctccccccagctccttttgcatatgagaaaacataagccattttgtgcctcttgcatcttaagccatagtctattttactatgtggtttcccatctggttacttttgggagtatcagatggtctcataaaaacagtgggttttcctgaagctttttgattaatgttgaatttgtttatcatcttttagctgtgcggtcagagaagaaacgccttaggaagccaagcaagtggcttttggaatatacagaagaatatgatcagatatttgctcctaagaaaaaacaaaagaaggtacaggagcaggtgcacaaggtatgttgcaaaatttcagcaaactttcactggtccttaggaaactgcaattttatcttcaatgtcatactttatcttcatgaaacaataatttccttaactgagatcttgttttttattctcagcttctagcacagtacttaggatttagtggttattcaggaaatatataaatgaatctacatattgtatttatttatgtatatatttttccctctttgccttcaaagagtaatgacttaggaatattgttatgatttaatcttaagtaaaaatataggctataaagtgaaatatatatagtctgaccctaatttcaaaagtaaatatatcttatttgtcttatttttcaactcagttttttaaaatgaaatagagacatcttgacattctacccctacatagtttaatatgtagttaaaaaatggaacattttcctttataatcaatttaacatatttacatcttatataagatctgtttatctgacatcaactgtc

SEQ ID NO: 118994 - DNA, 2590 bp, Homo sapiens
ggtagccaggatggtcttgatctcctgacctcgtgatctgcctgccttggcctcccaaagttctggaattacaggcgtgagccaccacgcccagcctattttatccatttttaagtgtacagttcagtagcatgaagcacagttagattgttgtgcaaccatctccaccatccatctcgataatttttttcatctttccaaattaaaaatcaatacccattaaccaataactcccttttctgctcagcccctggcaattgccattctattttctgtctcaagaattttcttattctagatacctcatatacttgaaatcatacgatatttgttctttgtgtcttaagtaatttcccttagcatacataatgtcttcaaggttcatccactttttgtagcctttgtcagaatttcattccttttaaagtgtgttattctttttgacacttaaattacaacaattttggcctgtggactctatttttattttttgttcttaggtaagttcccgctgtgaagaggaaagccttctagcccgaggtcgatctagtgctcagaacaagcaggtggacgagaattctttgatttcaaccaaagaagagcctccagttcttgaaagggaggctccgtttttggagggccccttggctcagtcagaacttggaggtggacatgctgagttgccgcagctgaccttgtctgtgcctgtggctccggaagtctctccacggcctgcccttgagtctgaggaattgctagttaaaacgccaggtaaggtggggttggggtctcagtatttgagcagatatgattagaggaagcaggagattttagtatgttttgatgtaaagccaacattgtatctatatacaataaactacccccttttgtcctgggaaatacttaaaatgatggttaattagatatagttactaaccatgaactgtggcacactatcaagaagatgtatttttaataactatgctccttgctccagtgttgctcttcatgattgttgatcagccactgtgtaaattaacaaccaggataacagggcttcaagaggagtactgcacattagtggaataagcactatgcttcaagtgctggctccaccaatccttgtgttacttgggaagttgtttaatctctgaacttgtttcctcatctataaatggagatcataatgtattaatgtgtaatgttatatacctgacaacatagtaattaccagttcattagaagttaattaccagttacttctcacttgatcattctttatatatcacctggggagagttggatctaaacatattgtctctaattcaccttgtaactattgaatattatagtcagtcaaggaatggcaagaatcctcttttctgtacccctttaaattttggatataacttttttacattatcaacagtagcttttgatgttattccttaaagaaacgattccaattgtgcttaaactagttgggtataataaaaaagatttttgaaagaacagtaaagatagttattatttcagtacctactatgtgccaaaactctattaagtcagctcttttatattattcttgagtgatcctatgaattatcttttacctattgaattttatttacttaggggcagagcagaaactataatctttgtccatttatgaccatgatccaagttctatttcactccacttctccttattttatcctcaccaacaatcagttgttataaaggcagttccgtccttctgacttctcccttagtgattttgtgagttaaagtcaccacacacacatccctcacattagttggtgcttgcattgaaaactgtttacttgttttgtttactaatattttataataagcaaattaccatcctgcctcttcccataagatgacggggaaaacatcaaaaacattgagattcattttgtgtggtatacagattttttaaaaattaacttgtgcccagtttctaaatcatctaatgtaaagatacatgcatttcaggaaattatgaaagtaaacgtcaaagaaaaccaactaagaaacttcttgaatccaatgatttagaccctggatttatgcccaagaagggggaccttggcctttctaaaaaggtatgttatttttgtaagttctaaaagaaataaactcaggaaatgagaaattttaaaaatgacattttgagtagcagttataacattgatgtacatacatatagaaattagtgtgtgtgtcagcagtcatacatgatctgagatttcctacatgaaaggctgttttgcagttgtgtgaccatgtatgtgtataaactggtttcaggtttcctttccaagtgaaaaaaatttttaaatgctttgaagattaagtttgtgtttgttataatttcttttctgggttcaaatcctcttacctgttttctactaaactactatctcaaatatcactagtctactctcctattgccgtgtcgtcgtagcccttttgttttgtttttttgagacagggtctgattctgtcacccaggctggagtgcagtggcataattttggctcactgtaatctctgcctcccaggc

SEQ ID NO: 118995 - DNA, 1031 bp, Homo sapiens
catttcagtcacagaaagcattgtgtatctagtctatatgttggaaatctctggcaagtctttattttttcttaaggagtaggtggtgttcacaggtctgttggagcattgtttttgttttgttttaagatggagtctcgcttttgttgcctagactggagtgcagtggtgcgatcttggctcactgcaacctctgcctctccaagttcaagcaattctcctgcctcagcctcctgagtagctgggattacaggcatgtgccaccacacctgactaattttgtatttttagtagtgatggggtttctccatgttggtcaggctggtctttaactctcaacctcaggtgatccacccgcctcagcctcctaacgtgctaggattacaggtgtgagccatcatgccctgtctgttggagcattttaaaatctgattcctttccccctgaagtttccgttcaaccctttactgtggtcaggttgatttctttaattgctaaaacaagtcaaaattcaatatccatggcagctgacaattcagactttggcatataaagtaaagggtttattttttcattcctctgtaaatggtgttgttttcacttatttatagtgctatgaagctggtcacctggagaatggcataactgaatcttgtgccacatcttattcaaaagattttggtggaggtgagtatttttgagatttaaaaaacgtaatgcagtagtaagtttgaagtgctttgtctgttaaccacaaaaattgttacatgtgtaagcccgaccagtgaggtacaagttttaaaactggtttgcccaaaatctgcttcctgaaaaagaaaaaatattgataaattgaatatctactctaccaggacttttagtaggaatgctacctgtaatctctctaaagcgttacagagagttaggttattatctatagtattcctgttttatagaagaaatgtgaagatgaacaaggtagcaaggtcagggaactaaatccacacctgaccaatttcatggtcatactc

SEQ ID NO: 118996 - DNA, 1017 bp, Homo sapiens
ttaatctttaaatcatatagtgatttgtattattgtctccagtcttgaagtctagggagtggtatcttttgatgactagtaaaatgcatttccccttcatctataggatttaattcctttgaagaactacaagatttgtcatttcaatcatataaattaaaatttctgtaataacctatacacttactatttaatctatatgagggagcagttacatatatgtagccatttcccttcttgttatgtcatcatgagttagtctcaattattatttcccccgttttcctaatccacaaagctggagaattaaatgagttttaaggttggtttttattctaataataggataagagattttggacatgtgtgttagtagccagcagttaacacctattttcctgtcataggcactaccaagatatttgacaagccaaggaagcgaaaacgacagaggcatgctgcagccaagatgcagtgtaaaaaagtgaaaaatgatgactcgtcaaaagagattccaggctcagaggtattactcagttcctgatcttttcaccttctaaagagaagctacttttcacgccagaggccacatccctctttcccttgagttttcttaagaatactattctactgaaatggctgatggccataaggaatcttggaggaaaagtagagccttatcctaataataaggcaaggcatgtattgcagctgtcaatatggtctttttaaaagatcatcacatcctatgctgtaggtgtccaatcaggtatataagtgtttcatcgttaagtaaacttgtaaaaccggagagtacaatatcaagtcaacatatgatctgaaggaacatagatactgtcctataaaagttgagactggccaggtgctgtggctcacgcctgtaatcccaacactttgggaggccgaggcgggaagataacttgaggttgagagttcgagaccagcctcgccaacatggtgaaacctcatctctactaacaatacagaaattacctg

SEQ ID NO: 118997 - DNA, 1103 bp, Homo sapiens
aagatttaaaaccatttacttgcaaagcatcagtgcaatcattgatattatcttcgggtttccaactcaggttaaaagagagaagtcaggtcagcatcacacattatgatgcagaatgtttctttccaggacaatttgaatagaatgcccaagaggggcattatttaggaaacactgatcttggaaggacaaataagtaatcaaataaacttaagaatgttttctctcccttagtgaaaccttaaaatggaacagctcagaaagttccagtggaacaaacagcctcagagcagttagtggcagggcatgaggcgcccactacccgcccaatcacagcagggttagaactaacattgcatgcagtccgcccgagtgattggctgaacatctgtaagtgcttaatggctagacaaatagcagcccagagggagggggtcaaatggaagagacatcaataatacagatgtgggacattattttttctttgcaagggagaactaatgcctcacaggacggccacaagccccaaggagactgttgaggaaggtgtagaacacgatcccgggatgcctgcctctaaaaaaatgcagggtgaacgcggtggaggagctgcactcaaggagaatgtctgtcaggtagagaaatgtttgcccacttgtgttttcattgcatgttcatctttaaagggaaacccactccatctctttatgatggtttcttggtagaataacaatgcttttggatgattccagtggagtcactttctttaaggatttgacccctttttttctccccacaaagaaagatacttggagaaatagtttagtgttggtgaaccacgtgcccttaaggcccatgaaggaatatatgccgcgaaacaagtctgagatggaatatgtgaatctctggttgcttattcaaatataattctccagtacttctcatggtgtcacaatctttgggtttgtaagaaacttttcaagggtaattttagctttgagatgtttttcctttaatgtggtgactttagaaagcctaccacctatattgttttatttatttaataaatatttgtagagtatttactatgtatgaagtattgt

SEQ ID NO: 118998 - DNA, 2526 bp, Homo sapiens
cagttcgtgcctgtaattcccctgctggggaggctgaggtcattggatcacctgaagctggggaggtagaggctttagtgagccatggtcatgccactgcactcccacctgggtgactgagaccctatctcacaaataataaatagtaatagataaataagttgagatctctaaaaaagtaaactcagaccagaaaatgttattgtggccaatataatttcaatccagtttctttgcctattatcttcactattacattcttggaccagatcccaaacaacagtcttaatcctcaaaaacagttatgcccattatttacttagtgagacaagtcagagtgtaaatacattttacaaagatcatttaatgaaaaggttaaaggtaaggtgaccctgtggtcctggcttgtctggatcagtctttgtgtaggtcccttgtgctgtcacaatttattaatagcacttcttttcactctcaggtgtcccggtttgaaagataaattacgtggttatcccagttgaataattagtctataacatttagttaatgcaaaaactttatttctaattcacgttgtaattaacgttttcctatttaagtgctgaaggtcagtttttttttttttttaccatatatagaaacgttattggcactctgaatatgcaaagtacaatatatagtgctatttttcagtttttatatgtgaatagtagataatggggagtcagacatttgaggatatctcagactataggttgataaagtccctgagttcccctatcaattccaggctacctctctaacctttctccctaaagctgtcctgttttttatttaagctttgattcttaagtgatcaagacctattctgtttctatgagttcttgaagctaaaacttacttagtcacctttccccttgtttgcttttcatagtagtacaaggctttaaaaatatttgggctgggtgcggtggctcacacctgtaatcccagcactttgggaggccaaggtgggtggatcatgaggtgaggagtttgagaccagcctggccaacgtggtgaaaccccatctctactagaaatacaaaaattagctgggcatggtggcgcatgcctgtaatcccagctactcgggaggctgaggcaggagaatcacttgaacccgggtggcagaggtggcagtgagccaagattgcgccattgtactccatcctgggcgacagagcaagacttcctctcaaaaaaaaaaaaaaattgataaatcttacaatgttttatagtgacagatgcccattgttatttcctaagcgcctgtcttaagtgaggccctatcttagctgagattatttcagaaaagtgatctctctctgggatggttgtaggtatgtcccaaaagggctgtttagaccttggtgggagctcttttggaactttatgatccaactctagctagccagtgtctgttgcttgaaccattcagtagctttctggtttatctctatgctcttttctgacctttctactcttgaactcgttttccatgtagcagtcagaacagtctttttaaaaatgaatacctgattttagctttcctttgttaaagctctccaatggtacacctttgtaactagactaaaatctacaactacgggcccttgcctctttctcacctccttttctgccacttttaacctttgtttactttaacccactgacactggttttactcttgattctcaaacatggaaaaacagatagatgttttctttctcttaacagaattgtgaaaaattgggtgagctgctgttatgtgaggctcagtgctgtggggctttccacctggagtgccttggattgactgagatgccaagaggaaaatttatctgcaatgaatgtcgcacaggtaaagtagatatcgaacggtcttcctccaaagaaagtttgaattttaagtttttcaggaaagacatttattggagacactattttgtggcaacactgggctagttgttacagatatagaaatggtgctgtggggtcactgctttcagaaaagctaccaagtgaataataaatgggtagcataatacagtgcaaaaagcattgtgttggtgatacatttagaatgtaatgtaagcaaagatgagctgatgccatagaggaagatatctgtgtttagctttaagagagaaagagaaattgatgtcgggaggggaagtgcagaaggtctagtaatgaaagcgtgtaaaacatttggggaatatggaatacaggccaatgtgtttatagagtttaggatattttaggtaaaaggcataggcagtaactaagagggcttcttggttactggtaatattttatatttcttaatctgcgtagtgattacatgagcatgtttacttcatcaactatactcttaggatgcgtgtactttatggtgtgtacattatacatcgataaaaatatttaccaaaaaagtaaaaagattatttgcgggttataatgcttagattgggttagaaaata

SEQ ID NO: 118999 - DNA, 1339 bp, Homo sapiens
tatgtcgggtgatttcctgtagtgtaaacttttttatacatctcttaagtttctacttatctttaacaatactgcccccacactttttttttttttttttttttttttgaggcagggtctcactcttatcacccaggctggagtgcactggtgtgatctcagctcagtaaacctccaccttccaggctcaagcaatcctcctgcctcagcctcttgagtagctgggaccacaggcatgcatcaccacgcccagctaatttttgtatgtttagtagagatggagttttgccacgttgcctgggctggcctcgacttcctggactcaagccagccactcacctcagcctcctgaagtgctgggattgtaggcgtgagcctcctctcccagcccaacttaaatttcgttggttgcctcctggaggtatccccttaacttgttcctctgtcatccatatttcctgtaaacttgtagttagtccaggggcttgattaggtttaatttcagttttttctttttttggcgggggtgccagcggcaagcattttctgtagacaatatgtactttctgttgtatcacgtcagggagtatctattaccagattgttcatttataataatactaagattgttacagtgggttcagacgatgtcaaaccgatcagtccattataaaatttcttatgaacttttcacctaatggtttagcatttggtagattcttgaattcttactaatttatcttcttttggcttctcaggaatccatacctgttttgtatgtaagcagagtggggaagatgttaaaaggtgccttctacccttgtgtggaaagttttaccatgaagagtgtgtccagaagtacccacccactgttatgcagaacaagggcttccggtgctccctccacatctgtataacctgtcatgctgctaatccagccaatgtttctgcatctaaaggtatggatttcttatgtggaccagtctaattgtaaaacctcagtttaattggcaacagatattttcttttttctttctttttttttttttttttttggagacagagtctcgctgtgttgccgaggctggagtgcagtggcgtgatcttggcccactgcaagctccgcctcctgggttcacgccattctcctgcttcagcctcctgagtagctgggactacaggcgcctgccaccatgcctggctaatttttttgtatttttagtagagacggggtttcaccgtgttagccaggatggtctcgatctcctgacctcgtgatccacctgcctcggcctcccaaagtgctgggattacaggcgtgagccgctgcgcccggccg

SEQ ID NO: 119000 - DNA, 1101 bp, Homo sapiens
tggctaccttctcgtttttaattgttattacagattgcattagagggtttggtggtggtttcgtgatggtttataatagatgaagtatttgaggggatgtgtttcctctggagagggtagagaggttcgttcacttgaaaggctttaaaagaatcacagagttccaggcaagcattattgttgtctcccctctccctatttattctggggctgatttcctagttgtcaggacagtggtttgagttgggctttcccttgttgaagcaggctcactgacagttacgggatttgattccttttggagacttatcacatagctcccatctgagttttcttgatggatcgagtgtttaagatccatcatcttagtggtcattccttctatttgtgacattttttcagtgctaacaaatagacttgaataactcacattctttttatatttaatatttttgtttttcttttgcttgtccctgattttcctgctttaggtcggttgatgcgctgtgtccgctgtcctgtggcataccacgccaatgacttttgcctggctgctgggtcaaagatccttgcatctaatagtatcatctgccctaatcactttacccctaggcggggctgccgaaatcatgagcatgttaatgttagctggtgctttgtgtgctcagaaggtaagaaatcatttcttcctctatttgtagtctaaaaagggattaaatcaatgttttaattggaacaaaaatacttttcatcatattgccactggaaaaaatattagaaatgatactattcatctgccattcaggaaatgatgtcccgaattaatgattacatagcagaactttttttttttttttttttttttttgagacaacgtttcactctgttgcccaggctggagtgctatggcacaatctcagctaactgcagcctccacctcccaggttcaagcagttctcctgcctcagcctcccaagtagctgggattacaggtgcccgccaccatgcccgactaattgtttgtatttttagtagagacagggttttaccatgttggccaggctggtctcaaactcctgccctctagtgatttgcccgcct

SEQ ID NO: 119001 - DNA, 1013 bp, Homo sapiens
taaccatatggagatactacttatgtgtcagacgctactaggtaatttattagctaggtgaatcttcaaacagatgtggttattgtttattagagaaaactccttaccgctgaggaaattatagctcagcaaggaaagtgaatttcccaagggcctgtggtcctagagctagaattccaacctgaacctgacgagagttaaataaagcttatgctgtttatactctggtcattatgtgtcactgataatgtttttatttagtatatcttttagtgaagagaaagaaaatatatatatatatgtgtatggatgtacacatacatgacttgcagtcttgtgatctgaatgccacatttttttattcccacaggaggcagccttctgtgctgtgattcttgccctgctgcttttcatcgtgaatgcctgaacattgatatccctgaaggaaactggtattgcaatgactgtaaagcaggcaaaaagccacactacagggagattgtctgggtaaaagttggacgatacaggtaagcctgaagaatagcactcatctcttttaccatcctctgtttcttgagacctctcagatacaatgcttaacgtatttctaatgatctacttaattactcatggtactcctcccctcttcttcttgatttttttccttataggaagagaaacctaactttatgatttacaattataggaataatacatgttctctgtcgaaatttttttttcttttgtgtattttgtgaaaagtttttttttttttttttaaatgaaaagacagtaataatctcacaaggcaggcgcattgttaacatttcggcatatgtactcccagacgtaccaatacgcagttatgccccccaccatccaaaataactgtttttacagattatactctgttatgtgtcttgggttgtttgttttgagacagggtatcctctgtcacccagtctggagtgcagtggtgtgatcattgctcactgcaacttcaaactcctggg

SEQ ID NO: 119002 - DNA, 1034 bp, Homo sapiens
gtaccatggataatactattattttcttgatgttgagcatttatactttttccagtttttccttcttataatgcttcagtgaatgttattgtcataactctctgttcctatatcattatttcctttaagtagaatccttgaagtagaataattgagtctaagggagtgcgcgcctgtgtgggaatgtgggcagatgttttccagcttctagcacatacgacttgtttgtgttctagttaggttgtaagaatgccgtaagatggactttaatgtggacagacagacattgctaatccttacttttatatgagtaggttattttcctaatgccttgcagccttctagaggttttccttctccttttcacctttcccaggtggtggccagctgagatctgccatcctcgagctgttccttccaacattgataagatgagacatgatgtgggagagttcccagtcctcttttttggatctaatgactatttgtggactcaccaggcccgagtcttcccttacatggagggtgacgtgagcagcaaggataagatgggcaaaggagtggatgggacatataaaaaaggtaactttatcctttttgtttctcaggcaaacacagacctctgttacctgagtgtctgatctgttttagaattcacatatgctccattttgaaactgcctttgtcctctcagggcattatctggctgcaaatacagtattttgcaaggaagttgacccatgtaactcattatttttgagccttaacctttacttaatttgaatttccttgagcttttttttgacttatcagttgttttgtcagcattccatcaaataatggagttctgaaactatttcatagaagaaacacttcagtttgctagacagaggctcagatctctagcagagctacatttgctccaaggagtcttgtcttgtcttgtcttgtcttgtcttgtcttgagctcgttgggaagaagtaaaattcaccagatattgtagaacaaactagtaaaggtcaaagcataaatg

SEQ ID NO: 119003 - DNA, 1040 bp, Homo sapiens
ataaaaaaaaattagctgggcatggtgatgtgcgcctgtaatcccagctactcgggaggctgagggaggaaaatcgctggaacccgggaggcagaggctaatgccactgcactccagcctgggtgacagagcaagcgagactctgtgtgtccacccacccctccccgcccgccccaccaccatcaccaccaaaaaagaaagaaagaaagaatgagactaatggtgaattgttcatggggatggagaatatgatttatattggatagatgttaaggaggtagactaggacatgctgaataatgttctagtctacctccttagaagaacacattttaggaaaatttagatgattctcctggaaagaacacattttaggacaatttagatgactccatggaacacatacaaactctggtagatggctacaaggaaatgaagaaaaaaggataggtcagaggggagaatttctttaaaggattgacagacttggggaaaggcacagagaaagtgggaagaatgggattctcagagtttttaatgtgggtgaagaataaggaattacagttttaagtgcagaatgagaatcttaagattttgttggacttttcagatactgcaatcttttaaacatgagaaagtacaggggccgggcacagtgactcatgcatgtaatcctaacactttggaaggctgaggcaaacagataccttgaccttaggagtttaaggccagactgggcaacatggcaaaaccttgtctgtacaaaaaaattagcctggcatggtggtgcatgcctgtagtcacagctacttgggaggctgaggtgggaggatcacttgagcccataaggtcgaggctgcagtgagctgtgattgctccattgcactccaaccagagtgttagagtgagaccctgtctcaaaaaaaataaagtacggtacttgagtgtagattagctatgaagatctgtgtatcattagagctaatagtttatatttacacaacaagtcttaggataagaggcaagaaggagaacaaagc

SEQ ID NO: 119004 - DNA, 1080 bp, Homo sapiens
cagttgtctaatcttttggcttccctgggccacactggaagaagaattgtcttggaccaaacataaaatacactaacagtaacaataactgatgagctaaaaaaaaaaaaaaaaaaaaagtccatgcataatttttatgatatccgccaccacagataagcaaaaaagttctcgtattcagatggatggatgccagtgatctaaagggtgatagtctgtattgtgccatttagttctggattatgttttgtcttaatactatgtctgaataccctttggactacattacctgtttgaaaatagctgttatgtgttttctttttcatatagcattggtcgatttttgtgtaaaacatggagtttctccaacttaaaggggaaaaagtaaaaaataagtgaataaataagtaattccacccagagattttgaagtgacttgtgctgtctgttttcatagctcttcaggaagctgcagcaaggtttgaggaattaaaggcccaaaaagagctaagacagctgcaggaagaccgaaagaatgacaagaagccaccaccttataaacatataaaggtgaggagaaaatcttgggggaccttctctagaagagaaatggaatagctggctcttcccactctgttcatgacaagaacggaagcacaagcatagttcgttttaggtagaggtatgagcttaaaagaagatcagaaatagccgggcacggtggctcacgcttgtaatcccagcactttgggaggccgaggcgggcggatcacctgaagtcaggagtttgagaccagcctggccaggcaggtgcctgtaattccagctacttgggaggctgaggctggagaattgcttgaacccgggaggcagaggttgcagtgagccgagatcgtgccactacactcaagcctgggcgacagagtaagactccgtctccaaaaaaaagaagaaaaaaagaaacaagtaccagaacaccattcctagcgcattgccaggattcccagtgtcaggagaattgattttaggtggacctaacctttaacctacctagtgaaatagtcatcaccattatcatct

SEQ ID NO: 119005 - DNA, 1374 bp, Homo sapiens
ttattttattttattttattttattttattttattttattttattttttgtgaccgagagaccgagtctcactctgttgcccaggctggagtgcagtggcacgacctaggctcactgcaagctcagcctcccaagtagctgggactacaggcgcccaccaccacacctgtctaattttttgtatttttagtagagacggggtttcaccgtgttagccaggatggtctcaatctcctgacctcgtaatccacctgcctcggcctcccaaagtgctgggattacaggcgtgagccaccgtacctggctcgtattttatttttttgagatggaatctcaacatatcggccaggctggagtgcagtggtgaaatcttgtctcactgcaacctccgcctcctgggttcaagcaattcttgtggagttcatattttgtatgtcaagtgaggctctgtttttatatgaaactaagtgttgatagttcaaaatcatgggaaatgtggctgcaacttcaaggaaaaaaagtttgcctttttcaggacgtgaattgtcttctgctgacttgttttatgcggtgtactttgtgttacttttccaggtaaaccgtcctattggcagggtacagatcttcactgcagacttatctgaaataccccgttgcaactgtaaagctactgatgagaacccctgtgggatagactctgaatgcatcaaccgcatgctgctctatgagtgccaccccacagtgtgtcctgccggagggcgctgtcaaaaccagtgcttttccaagcgccaatatccagaggttgaaattttccgcacattacagcggggttggggtctacggacaaaaacagatattaaaaaggttagaaaaagctaaattaccatatactttctcctctttgcagttgcttgatatcattgatccttgacattagaaaattcatcatagaagaaaataacacagttaataattaaccttattgttgtgtcttgccatatccttctaccgtttagaggcttacgaatggatggttttgatctcccaagtcctttgtattgatcatggtcactgtgtaggaggttggaaaaaatgggacattcatagagatgctatggctttgtttgcttttttgtgaatatcctacagctggtaattaagagagatgacagtgagcacatgatacagagacattgatccacctactaataaaacatttttagtgaggaaaaaacaggtctggcttcatgaaacatgaaggataagaaggttaagccttattggatgaaaatgcagtcatgtcttcaacttaaaacttggcaggatctctaagtttctaataaataaataatattgtatagtcttttttttttt

SEQ ID NO: 119006 - DNA, 2838 bp, Homo sapiens
aaagtataaagggctctagagatgtgtgacaaaggaactgaaactagtttgtctctgatgatattatattttattttatttattttttgagagagggtctcactctgtcgcccaaactggagcgcactggtgccatctccgctcactgcaaccttcaacttccaggctcaagtgatcctcccatctcagcctcctgagtagcagggactacaggctcgcatcaccacgcctggctaatttttgtattttttgtggaggtgaggtctaaccatgttgcccaggctggacttaaactcctgggctcaaattatcctcccagagtgttgggtttacaggcatgagccatcactcttgacttgtgaggctattttaaattgagacttgaaatataagtagctgttgacccaggcaaggtgcattaaagccctgcaggttaggagtgaacacgtgtgaaaagccagagtgactgtagcataatgaatagggaggatggtactttgaaatatagagcagagcaagcaccaaggaagatgaacatagtttatttggggaagccaattctcgggctctggggcaggtagagattggccatccatctctctttataaggacgctctagtttacttactaatcttccattctggaggatctttagtatccagtgtatcctaatctttctgctgctgacagtggtaggagtaaggaggtgtttctcattatcaaatagttggggatcgtaaagtaattatgtgtgcctaaaattatactcatgtaatctgctttgtagaatgtgatgttttcattaattttttaaaaaaatgtatacatttggataccagtgtccttttttgccattaagtcaggaggtatttcttgttctagggtgaatttgtgaatgagtatgtgggtgagcttatagatgaagaagaatgcagagctcgaattcgctatgctcaagaacatgatatcactaatttctatatgctcaccctagacaaagtaagtaatgggaaatgctgttttcactgttacaagattgtaaatttgtgttgtcccagccatagtatttgtaggcatgtaacgcagttcccaaggtagggtcttttcccatacccattgggattgctggattggggttctggagtaggtaagagtgctcattttctgggtattcatggccagaggcaatacagcagcttttagcattgtttttgaacaattcaatgaaaattggagcttatatctttgagtattttttctacaggattacaagtttgaactcagaaaagtacataattcttttttattttattttacagttgagaaaattgttaaatatttaattattttactgataagattatgtaaatttttttttaaaattattttgagacagagtctcgttctgtcacccaggctggagtacagtggcatgatctcggcttgctgcaacctctgcctcctgggttcaagcgattcttctgcctcagcctcccaagtagctgggactacaggcatccgccaccacgcccggctaatttttgtatttttagtagagacaaagtttcaccatgttggccaggctggtctcaaactcctgacctcaggtgatctgcctgcctcggactcccaaagtgctgggattacaggcatgagccaccgcacctggccttagtttttataataaaaccctttcttggtatttacctttgtaaacatttctcaaattgtgcactaggatttgtgagatcttcacttccagatattctgatcttactttgggattgggactccgcattagtatttaaatctccttaggtgatttctaatgtgcatctgggttgaaactacctaaatagaaagtgggacaagctgctatttgtagggcagtggtcctcaaacttcaatgtagtcagaaacccctggcagccttgttatatataacgcagaatgctgcaccccacagtctctgctttagtgtatttgaagcacaacccaggaatttgcatgtctaacaaattgccaaatggtgatggtgctggtccagggatcacactttgagaaccaaagttctttgggatcttttctctgagaggttcagtctttacaaatagaaactccaacttattagagagaatagtcaaattttaatccacagcagaggtctcaggaagtctgatgtgtagcttcttttggaattctaggaccgaatcattgatgctggtcccaaaggaaactatgctcggttcatgaatcattgctgccagcccaactgtgaaacacagaagtggtctgtgaatggagatacccgtgtaggcctttttgcactaagtgacattaaagcaggtaagaatcatttcaggattctgcagctgacatctgaatttcagggcttttgttttttacaaacagcttcctcagattataattttaaacatttctatatgtaccgttctctggaattaagttcatttacatttttgtgcaaccatcaccaccatccgtctccagaactcttttcatcttcccctgctaaaactctatacctactaaacactaagtccccattcttctttttcttcacagcccctggcaactaccattctactttctgtctctgaatttgactactatatgtacttcatataaatggacaatatttgtccttttctgaccacctcatttcattcattcattgattcatttttaatgtttagggacagagcattgctctgttgcccaggctgcactacagtggcaccatcacagttcactgcagcctcaaactgggctcaagcaatcctgctgcctcagcctcctgagtagctagggctatag

SEQ ID NO: 119007 - DNA, 1123 bp, Homo sapiens
cttgggaatggaaagactgtttgcaaatgtggagccccgaactgcagtggcttcttgggtgtaaggccaaaggtaccacccttctagacttctgctttgggattagtggtgcggtcctccctccctaacagtgttagggcagtctacattttaagaagaaatctctttgaaattaatgacattcagccaggcatggtggctcatgcctgtaatcccagcactttgggaggctgaggtgggcggatcacctgaggtcaggagttcgagaccagcctggccaacatgatgaaaccccatctctaataagaatagaaaaattagctgggccgtggtggcatgtgcttgtagtcccagctactcaggaggctgaggcaggagaatcccttgaacccaggaggcagagattgcagtgagctgagatcacaccactgcactctagcctgggcaacacagcaagactccttctcaaaaaaaaaaagaaaaattcaatgacattgaataggtgttgatagggccacttgcaattcactaagcattcggctgatcaattatataagaggtttttggggatattgttgaagtgttttgggccatctgactttaattggtgctacttttctaactaataatgctgtgaaataggaccttataaagaaggttagttacctccctcgtcttgatctcacatctcctaataagccatatagattcttggtatatctgtgtctgtccctgtctttctctcactttctctttctgaagataccaaaaaatctgcagtttaagcttctaaatgtagcataacatcatagataaaagtagaactcttaatctcaccattataaaaaagtataagcattgttgtgtcttcctgtttttttagtatgcactttctgaataattgaattctaattctgtaactgttaagtatcatttccatgtctatattctccttattttttttgttgttgttgttttgtgtttttttttttgaggtggagtctcgctctgttgcccaggctggagtgcagtggcgcaatctcggctcactgcaagctccgtctcccgggttcacgccattctcctgcctcagcctcctgagtagctggaactacaggcgccc

SEQ ID NO: 119008 - DNA, 1047 bp, Homo sapiens
tgagtatgttccatatgcctttttgattgtgaagctcaacattaagaactgaaaaatgcaaattaacatagaagccaataagaaaagagtaaataaatttttttttttttttttgagacggagtctcgctctgttgcccaggctgaagtgcaatggtatgatctcggctcactgtaacctccgtctcccaggttcaagtgattctcctgcctcagcctcccaggtagctgggattacaggcccctgccaccacacctggctaattttttgtatttttagtggagatggggtttccccatgttggccaggctggtctcaaactcctgacctcaggtgatccacctgcctcagcctcccaaagtgctgggattacaggcgtgagccactgcgcctggccagaaatgaagagcactcaatgatcattttttaatcttgttaaataaggagaatcacctctatattatactggattttattgtgctttttgtttagttttgttggtttaacggtgttgttccttaagatgttgacttgtttcctataaattaaaatagtaactcagtttaacctgtacttaatggtattaagtgtagtgcggatgtcagtttcagcatccttgatgtctgcatgggatagcatttcacaggagtcagtcagaggtagatgctagagaggtcactgtgtgctcttagtagatactggtctgtcagaatagggtggacctccattaagccttacagattggtcctggatgtttctgggttaaaatgaagaatgtgataagatgatttggtgaccaagtgtgggctgcagggaacaaagagagaacatctgctggctgctccagggtctgccttgggagtggtggacctgaagctaatttgacttgatgtgtagtcttattgacggcagggaccatgaattaacttttttgtgtcttaacacattgcttatagtaagttcagttatgctttgttgaatgaacgagaaataggcatgtgtacccacacacagaagtctagtttagttctgaaagtagacgaatat

SEQ ID NO: 119009 - DNA, 7609 bp, Homo sapiens
ctgggcaacacagcaagactccgtcttgaaaaataaataaattaattaactaataaaacttatgaaaggcatgtcatttaacaccagccttatggatcagcaaaaacacaaagatttttgtcttctgttttgttcaggtggcaggagtagttgatacaaaaattattgctacgtatctgtgatgtaccaggtacctttcctgcattttatcttcatgacaatctcttttcccagagaagagaatgaggctcagagagggtagttaacccggttaagattggtactaatgtgttcacagaatgctgactgttcaatatctgacctgtagaatcaacccattgccacggaagaaaagtcaaagaaattcaagaagaagcaacagggaaagcgcaggacccagggtgaaatcacaaaggagcgagaagatgagtgttttagttgtggggatgctggccagctcgtctcctgcaagaaaccaggctgcccaaaagtttaccacgcagactgtctcaatctgaccaagcgaccagcaggttggtgccaaaatccatttgtaccgctactcgttctctccatcatactcagggtctcatgccatttgcatcagccttgaagaaagtgccatttggtctttccatgcataattttgaggggtatggtctattttcttattttggaaataatgaaagcaaaggcttagaattcttagttatgaagaatgggacagcggtgcacttgctgtgtttcaggtcctttacttacagtcatgtttatttcattcccccagcagcccataatggttggttttcttccataatgcatgtgaagaaacagagtgaggattggggaggtgatctttcacacatagatagaggagctggattgagagctgggtttttgactccaagactattaaatcatgttgcctttctagagaaagaaagattgagatagtaaagcctttaggtggttctagtcagtgagagatggattgccacccttttagcacttcctaccttgctcccctacgcctagtgcagtctccccccatgcagagtagacttttttcctctaaaggagatttggttgtatcagttaatacatgagaaagctgctcaggtggatgtggtacccaggaaatttgtagttgaagaaattgagaacctttgagtagtgatttggggttagagaattttagggatttggatatgccatctattttaatgaacaaaaaagagaaaccagtagggagccattccagggtgaggagattatacattactagtgacctgcttccaagagttgcagaacgttaagaactttagggtataagtaaaaggaatttgtccccaaattggctttccttcactgtatattggccagggtcatgaaataaaagaaactgaggtaggatgagggcaaggccatcacattgacctgtcagcaccaggaagtagaattgtttcagaatcaactgctcagggtcgtcactggcgcaggctatgatagaaccaatcttgcctgtgtgccaggagtgggagctggtgtagttgatttgaaggtggaaacactgtccctggtcaagaccctcaggtttcatgaaatgtggggaggcaggtaaaagcttaggtcagctttgggtcttttctactgattccatgtgaacaacatataacgtgctgtgctgatctcaagacttaaaatagagcaaaggtaaatcttccatttttcatgattttatatcttttctattactgttaatagcaaataagcaggaatctaaatcaccaggatatttctctttgagttgcttatttaaaagctgtatagtacaaatggagattgcaaaaatataaaagtaatatcttaagtttcatgtaaaagaaactttttgttgtccccacccccgcccccccctcacctccttgctggaaatagtcatagaaataccaatttactcttctgcttgtatatttagttgatagtagttgctatttgataattcgctgttactttatgtattctgtgcacaaaaagaagctggaattctggggcaagaggtggctggtgagtggcataagctctctgaagcagggacagtgtgaaggaaggtcatcatccacaccttcggactgtagcatagccttggcccatgtgatatgtatctcttttttcctaaacttttgatttacttctgtgttttcagggaaatgggaatgtccgtggcatcagtgtgacatctgcgggaaggaagcagcctccttctgtgagatgtgccccagctccttttgtaagcagcatcgagaagggatgcttttcatttccaaactggatgggcgtctgtcttgtactgagcatgacccctgtgggcccaatcctctggaacctggggagatccgtgagtatgtgcctcccccagtaccgctgcctccagggccaagcactcacctggcagagcaatcaacaggaatggctgctcaggcacccaaaatgtcagataaacctcctgctgacaccaaccagatgctgtcgctctccaaaaaagctctggcagggacttgtcagaggccattgctacctgaaagacctcttgagagaactgactccaggccccagcctttagataaggtcagagacctcgctgggtcagggaccaaatcccaatccttggtttccagccagaggccactggacaggccaccagcagtggcaggaccaagaccccagctaagcgacaaaccctctccagtgaccagcccaagctcctcaccctcagtcaggtcccaaccactggaaagacctctggggacggctgacccaaggctggataaatccataggtgctgccagcccaaggccccagtcactggagaaaacctcagttcccactggcctgagacttccgccgccagacagactgctcattactagcagtcccaaaccccagacttcagacaggcctactgacaaaccccatgcctctttgtcccagagactcccacctcctgagaaagtactatcagctgtggtccagacccttgtagctaaagaaaaagcactgaggcctgtggaccagaatactcagtcaaaaaatagagctgctttggtgatggatctcatagacctaactcctcgccagaaggagcgggcagcttcacctcatcaggtcacaccacaggctgatgagaagatgccagtgttggagtcaagttcatggcctgccagcaaaggtctggggcatatgccgagagctgttgagaaaggctgtgtgtcagatcctcttcagacatctgggaaagcagcagccccttcagaggacccctggcaagctgttaaatcactcacccaggccagacttctttctcagcctcctgccaaggcctttttatatgagccaacaactcaggcctcaggaagagcttctgcaggggctgagcagaccccagggcctcttagccaatccccgggcctggtgaagcaggcgaagcagatggtcggaggccagcaactacctgcacttgccgccaagagtgggcaatcttttaggtctctcgggaaggccccagcctccctccccactgaagaaaagaagttggtaaccacagagcaaagtccctgggccctgggaaaagcctcatcacgggcagggctctggcccatagtggctggacagacactggcacagtcttgctggtctgctgggagcacacagacattggcacagacttgctggtctcttggaagagggcaagaccccaaaccagagcaaaatacacttccagctcttaaccaggctccttccagtcacaagtgtgcagaatcagaacagaagtagtaccaatcaatgtcacatgaacaaacaagctgcccccagggtaccatttggggaggggaaatcttttctttctttcccccttaaaaaaaaacacatctgccccgaacactttcccactgttattctttcctcatatcccaacactcagaactcttgtgacattagccagtgggggcttatggttgtgtgaaccatgtatgaaaatccagtgggccccaaccaaggagacagacagacttgggtctctttcccccaacttttccacatggtcatcgtgaaataaaaagtccactctggagtcaagtatggaattcaattccgctggtcaggttggaaggtataggggctctcaaagcgatttccccaaccagacagagccccattgagggcacctaggaacccttgggaggaaatggtgttctttcaaatcagtggcgatttcctgagcattcacgtgttctaggccgggtgctagtcactgatgagagatacaggcctcatccctgtgagcctggattccaaggctttcaggaacctttgaccaggaagtaacaggaagttctgaggggccctggggctttagactcattttgaaatgtcctttgtggcaccagaagtggttgtgttgaggaagtgtctcttggctgcggtgtgcatgggtgcgtgtgcatgcgcgcacactcacagaggtctcctctatagatgcaagggtgctgcattgaggccagcaaggctgttggctgtggggtcgccgctgctgcttttgtctgggctgtgcagagtctcaagatcagtccttggaggagcaggtggtcaggggcagtcgggctctgtgcgaatgtagatttccagcagtggaagaaggcatttggcaagcttctctttctttgcttttgtttctacctatttttctctttgtacatgaatccaccccatccctatttccctaaaacactcaggtgctttcagatttcagagcctcgggcagtggacatagggaatctctggcaagctctgagctagacacaccagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctttatctaaagattaaaaatagaatctgcttttatttcccaaagtctgtctctgaggttgagacacttgaactcaggcagagggacgaggctgggcagggctgtcctgagtttaggggcctatccctgcatttcactgagacctcggaatctcctctgtgaattccacctgcctagttctcccctttcatcctctctctcttcccacatcatcaaagaggaaaagctctttgttcaaaaggaagagaaaacgtaaagcatcttattttcttttaaaagaattttaaaccatgaaaaagatatttttaaagaaattcaccgagaacattaaagttcattatattaagtatttatcatgtgtgagaataataaatatataactgcagctagtaggtccctttccctaatcttttaggtcatatgagtagggtttgcttggtgccagtcctgtgcccttttctctccagtcatctgtagttgtgatcagaaaaaggtatctgcactgcactgtcagagtctcctttcactatgttgtgtgttaaattaccgtagctctttgtttcatgaaataaactgtgaatttggggggggcggggggagggcgtgcaggccatgtaaaaattttccgtggagaagtttgattctaaagtagcttctctaaagtaggctttggtaggtaatcaacttgacagcagtctagatgtctcacaggacaggagggagtgagggaaaggggccatgattggctgctttgtggttttattttggttctttccattctccgccattcattggaggcttcgttccagacctgcctgggaaaacagcttctgagccattttggggagcagttcttcatctgaatggatggacatctgggcttccttcaagggccattgaatgggaactagaaaaccactggaaactagaaatttgagctattgggcccaccagtagcagcatgtgatactagatggttaaaatcatgaaagcagtcactatccaattagaagcagagtcacaacaactgttgggaaatgtgactcttggaggaaggtggggagggagtggccttgccagccctgtgggacgtcccctgaagtttgtaataagaccccttttccaaagggatgtgaattggagtgaaaaggaaatctttcatcttagaaaacttctggtccttaacgcagggtggtatttgggtatgtgcttggaaattgagatctcaagagtgtttgccttggagccagctccccaggaggccttttccagggacaaggcaaaagttgaaattctccatgggtagctagaaagccaatacatctagccctgctaagtcagaaaaagattatgaaaaatgttgaaatttacattcaaagcctcatttgcttatcttgctggagccaacccagtctaatagcaaaatagctgtcattgatacagaaacatcctcatttttaaatgtctgctttaccctgttactgagtttgagatgacttaaatcactgtgttgaccctcttctgaaccaaatctttagcattgatgaaaatagttattttattctttacatccttcaccccacactatggtcagggcatgaaacaccctgttgatcccttcccaggctcggcactgtctgctcactggagccggactcccaggttgtaattctaatgttgcctcatgagaacagaatggcagaaagtttagtcctgacagattcccccatagggagtaatgaggacagcatgaaacttggataggttttacccttagtccctataaggtggattttactaaggttttttaaatgatactgtcatcctcttggggtttatcagccaggttagaggagcccagtgtcctaacctctctcagatcatggcagagaaggagctgcctccagcccctttcttgctgagtttcatttgagcagttccatgtgtagacattccaagtcactgcttggtagttgctgtgggagcctgtcattggctatggccagttagttctcagctgagcttcctagggccagtgcaacagggccagaggctgctatagtgtaaattgaaataagaatagatcattgttttgtacacacacacaataaaatgtaatgatggtgctaatttcacggtataaataagcactgccaag

SEQ ID NO: 119010 - DNA, 1069 bp, Homo sapiens
catggagaatttcaacttttgccttgtccctggaaaaggcctcctggggagctggctccaaggcaaacactcttgagatctcaatttccaagcacatacccaaataccaccctgcgttaaggaccagaagttttctaagatgaaagatttccttttcactccaattcacatccctttggaaaaggggtcttattacaaacttcaggggacgtcccacagggctggcaaggccactccctccccaccttcctccaagagtcacatttcccaacagttgttgtgactctgcttctaattggatagtgactgctttcatgattttaaccatctagtatcacatgctgctactggtgggcccaatagctcaaatttctagtttccagtggttttctagttcccattcaatggcccttgaaggaagcccagatgtccatccattcagatgaagaactgctccccaaaatggctcagaagctgttttcccaggcaggtctggaacgaagcctccaatgaatggcggagaatggaaagaaccaaaataaaaccacaaagcagccaatcatggcccctttccctcactccctcctgtcctgtgagacatctagactgctgtcaagttgattacctaccaaagcctactttagagaagctactttagaatcaaacttctccacggaaaatttttacatggcctgcacgccctccccccgccccccccaaattcacagtttatttcatgaaacaaagagctacggtaatttaacacacaacatagtgaaaggagactctgacagtgcagtgcagatacctttttctgatcacaactacagatgactggagagaaaagggcacaggactggcaccaagcaaaccctactcatatgacctaaaagattagggaaagggacctactagctgcagttatatatttattattctcacacatgataaatacttaatataatgaactttaatgttctcggtgaatttctttaaaaatatctttttcatggtttaaaattcttttaaaagaaaataagatgctttacgttttctcttccttttgaac

SEQ ID NO: 119011 - DNA, 1102 bp, Homo sapiens
tgggtgaaggaactgcgcagcctagaggaggtaggtgaacagacctcactagaacactaggggctggggttttgttggcctgtggaggtgacccttgtcttctgcctcagggctgccaaatctacttatgtggcaccaagagtgacctgctggaagaagaccggaggcgtcgacgtgtggacttccacgacgtccaggactatgcagacagtagctgctcctcagccctttggggggtgggggtgtgtggctgtctgggtggatcaaagaaaatagggactgccttggctgccagggcaaggtgctctaggaggtcttcctggcctccttgaactgtggggtccaggagactccctgaactgctagccctcccttttgtctgtttatctaattctcaggtatgaggctttagtcacttctctttacagatatcaaagctcagctctttgaaacatccagcaagacaggccagagtgtgggtgagtgctgtgctggagcctcacagcaggaacatgcaggggcaccagaggaagctgaatagggcacagagggctgggtcactgggagatcccagggctactggcattgggccctcgctgatcatcatttttcctgccagacgagctcttccagaaagtggcagaggattacgtcagtgtggctgccttccaggtgatgacaggtgtgtgcttccccagcctttatggagacttactctaggcccacagcatctagcccctttcctgagttacctgatcccaacagaatggtgctgagctgccacctctctttttgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgca

SEQ ID NO: 119012 - DNA, 1064 bp, Homo sapiens
gtgaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggtaagtcccccggccatctattcttgggagactcattcctgaggaggtgtaggtcctgcctattactggttgatttgtggcctcacagacccatttctcatagacccgtttccttatctggaaaatagcggggtctggagaacgtggccttaagtttgactcaggccttactctttaggacacagcaggctctgagcgctatgaggccatgagtagaatctactatcggggtgccaaggctgccatcgtctgctatggtaaggggggggggggtttgggctgtctcacaagaaaagatgggtgccaggctagccagagaacagccc

SEQ ID NO: 119013 - DNA, 1274 bp, Homo sapiens
tttttagtacagacaaggttttaccatgttggccaggctggtctcgaactcctaacctcaagtgatccgcccgcctcggcctcccaaagtgctaagattacaggcgtgagccaccgcgccgggcaaatgtttttatttggactgtcaggaagctccagagctgcagctggtggaaggcggctaaaacactgcatgcgtctagatgcacaaaacaaaatccaggagcaggatgggctggaaggccctttgttgatctcaagagagagaccttttgccttctagtttaagagtcagaagagaggttttcgagagcaaaacgaccttatttatggcttcttgttctgtcagtgccacttggaggtgcagtcaggggaaggaatggattttcattgtattgcttcgcctcatgaaaagtgacagggagtcagatttatgtgcaagttggcaaaatgaaagactgttccacgattgtggttggcctctgcataggtggtggaggaacgatgtgtttactgtgtgaactctgacaacagtggctggactgaaatccgccgggaagcctgggtctcctctagcttatttggtgtctccagagctgtccaggtgagcagtgttgttggggctgctggggctctgggacccagtgctttcggtgttggggctgggctggggtcagtgggcaactcagtatccttcccattctcatctcatgccaggaatttggtcttgcccgattcaaaagcaacgtgaccaagactatgaagggttttgaatatatcttggctaagctgcaaggtgagtttctgggtatgtggatattcctcatagggagaggctcattcagcctagcgggcgtggagtctgggttagtcattgccctgctctgagctgggactccttgtctgtactgggggtgggaggagggtgaataccacctttttagtggagcctggcccagaggagattggtgtcatgggggagggaaattaggttggtctttcaggcatcttctaaaggcagccacctgccgttcgcgacaggcgaggccccttccaaaacacttgttgagacagccaaggaagccaaggagaaggcaaaggagacggcactggcagctacagagaaggccaaggacctcgccagcaaggcggccaccaagaagcagcagcagcagcaacagtttgtgtagccagtctaccaccaccacagcaccccagacagctaggcttagcctctctgccctcccttcattgtactttatcattaaaaatcaa

SEQ ID NO: 119014 - DNA, 1115 bp, Homo sapiens
gggctggcaggggcggccgagcgggagcggctgcgggcggacagtctggactcctcaggcctctcctctgagcgctcagactcagaccaaggtgagtgccccgaggctgaggggttgtgtggccctcggggcgagccaggtcttctgaccggacccctccccgcgcagaggagctggaggtggatgtggagagcctggtgtttgggggtgaggccgagctgctgcggggcttcgtcgccggccaggagcacagctactcgcacggcggcggcgcctggctatgatgttcctcacccagggcgggcctctgccctctactcgtgccaggcccacttgccaggcaggagccctccccaagccttcagggctgctcggagtcacctgttggaatggactaaaaggacccttgtgtgggaacaggtgctccccaaacaccctgctgctggctgccaggcaggccctctggaagggaaggggcaggactcatcaggacctccctggacccctgcagggcaggcagcttgggcccgagcccaagcatttggctctgctgcccccaaggggacaggaagcctcttgggcctcttcccttcctggacaaggccccctgcctttgcctcacataaactgtacagtattttcattaaaagcctctttcataacttcccgtccatagtcttgcctaatgaaaacgggggaactcccaaccacagacccactggaagaggaaataatatcagttcccatcactgacactgttggccgtgccaggcagtgcacttaattctcacaacttgaggctgttctgtctccacttcacggatggtagaaatgaggctgagtgacgtgactcgcctgaggtccaaaaacagtgaagccaagattcaaaccagagccttccgactccagagctggggccaactgaattcaacaagtatttattgagtgtctattatgtgctagatactgagacacatcagagaacaaaaccaaaagccctgcccttgtcgggcttacagtctagcacttaccgccagttaacctgcaggctacctggagccccgggcaagtcaccgcacctctgtgcctcggtcctcagctgcccaatgggagaa

SEQ ID NO: 119015 - DNA, 1814 bp, Homo sapiens
ccagtttctccattctgctgctgattggaggtggtttagggcttttgctctgctacatgatactgctctaagcactcctggatgtgtcttatttatttatttatttatttatttatttttgagacagagtcttaaactctgttgcccaggctggagtgcagtggcacagtcttggctcactgcaacctctgcttcctgggttcaagcgattctcctgcctcagcctcccgagtagctgggactacaggtgtgcaccaccatgcctggctaatttttgtatttttagtagagaaagggtttcatcacgttggccaggctggtctcgaactcctgacctcaagtgatccacccgtctcagcttcccaaactgctgggattacaggcgtgagccaccgcacccagcccattttcagttttactagagggtgcctcgctgctctccaaatcgggccgtgaccacagtggggtggcacctgccgagatcccctctgtccctcagcacctgatatagtcagagctttccatttttgacaggtggatgcaaaagctttcgtttgtttctctgctagccatgttgggatgtgtgtgcgtttattggcatctgtgtttctgtgtggtggtttagtccgggccctttcttccggccgtgtaggagtgcctgtgcggggctcctctggtgatatgcccttggcgcataccttccagtgtgcctgggggcttttgcttttcaatgacgtcatttgatatacagcctataatttagtgtgatttcataatctattctaaagattttgtttttgcttaaaagctttaaaattttgcttttcaaatttggcatttaatcgaagtggagttaagctggcgtagggtgtgatgtagggaatccatttttccaattgtctccagccagttccagcaccatttaccgacccctgggtccttctgcaccctctgaggcgcacactcaggtggccacgccacatctgctcctaaccctgcccctcagcttcctcccctctcgggctggaaggctatatacttggctgagctcccggctccttccagctagggcggccgtgtgcccactgcggctggtcagatgcccgagcctgccgacgagggcctccagttcctctgggtttccccaggtgaggagatctaacagcagctggtgtggccgggcccgctcccgtcttcctgtctggaatgtggaagggacccctggcatgcagaaccccccgtgtgaccacaagggctgagtggagcacccggagcctggtggagggagagtccttggcgtggctgaggtgctgcccagcccggactgccagctgcaggggttttatgttaaaaaaaaaaatgcctatttgttcaaactactgtgagtcatgttttctgttcttttgtggctaaaagcagccctgcctttatcccctccgtgtggtgagttttctgacatgtataggtctgctccagactgccgctgatggtcacagtccattctgtgccacacacggcattaggcactggggatacaacagaggacaaaagggacaaagatctctgtccccatggagctcatagtctagtggagagatcgggtgaaataagtatgttacatagtgcttacattggtttcctagggctgccataaaggaccacaaactgaggggcttgaacaacagaaagtgattggctctcagttctagaggccggaagtctcaagtcagggtgttggcagagctgcgctgtctctgatggctgtagaggagagcccttcccttcctgttcccggcttctggccattctcagca

SEQ ID NO: 119016 - DNA, 2646 bp, Homo sapiens
acttctgaggagaaagcctcagctttctcctttcacgatcccttctctctcggtgaatggccagtgggttgggctctcttgcccccacccatgttggcattgcttgccttttaggtacccatgggacggctcctgtttctcccattctgagagcatctgcttataattctagggcctgtgtttggaagcaaagataacttccacggcttagccatcttcctggacacctaccccaatgatgagaccactgaggtaggcccctgctctatcctgctgagcaggaaaggaaggactgggcagtcggctagaggagggggccctgggacttccatggtcccagcacaagaggagcctccagggattggggtggtgggtgcccctgctcgccccacaggctgggctgcttgtggagtaaccgatgtcttggtcccagcgcgtgttcccgtacatctcggtgatggtgaacaatggctccctgtcctacgaccacagcaaggatgggcgctggaccgagctggcgggctgcacggctgacttccgcaaccgcgatcacgacaccttcctggctgtgcgctactcccggggccgtctgacggtgagcaggctaggcggtgggggtggcagctggtggccctgtgctggtcccacagaggctcaggagggcaggctgctgtcctgcgaggtgcttagcgtgctgggccctgcaggtgatgaccgacctggaggacaagaacgagtggaagaactgcattgacatcacgggagtgcgcctgcccaccggctactacttcggggcctccgccggcaccggcgacctgtctggtgagtgggccgggccaggcgttggttcccagcccagctcaccctgagggactgggagctttccatgcagttgattgcctgccttcatgtggtttctgagctcacctggctgtgttcctcctcctcctttcttctgtaaatggcctgtccgggcctcagttcctgtggtttctgggctcacctggctgtgttcctcctcctcctttcttctgtaaatggcctgtccgggcctcagttcctgtggtttctgagctcacctggctgtgttcctcctcctcctttcttctgtaaatggcctgtccgggcctcaggccttgaacggtcccttggcaaccttccccatcaacaggaggcagcgggtcagttagatttgggcaatgtagattcccagatttatctccagcccagaccgctctggacctgctcagcccttgtgcccacagctgaggccacatcttgcccatcgggatgtcagtggcacctgtgcccctctatttgcttgctgtctttccggacccttctttctctcacatggcacctctggtccatcaacagtccctgtggctttattttcacagcacgtctcaccacttccctcccctccctgactacctggcggcttcaggccaccagtgtctctcacaggagtctcccaagtggtcccctccttcaccagcccccaacagtctctcgtgagcacagcagccgtgtaatcgccttcagtaatcgccttcagcccgtgtgaggcctcctgctgctctgcgcagagctctgcagggggcgccagggcctctgtgccagccctgccacctctggctccctgctcactgctccccctgcctactgtggcttccagctgctgcctggatgcgcctgtgccctcctgccccggctgtttcacccttgtctcctagggccttgctcagatgttacctcctcagtgcggccttccctgatgccctcgtggaatgtcgtgccccctcctgtgtccccagcccactccccagcatctttgctggctttatttttcttcataatatttaccatctttgagtctaccgagtaattaattttattgtctctggccctcctgctcaattgtaagctctataaatggctgtttggcccagggcaggtgctcagcgagcactggggtgcctctaacctgctcaggcctcactggtcaccaggccgtggtggcccttggctgtggttctcggtttctctttggggccctgagcaggtgccaggcccagggccagctcctgaccagaactggcacgtgacacgggggacctgacatgggcggtttatcctcaggatgacccattccagggcctgtagtctgcccactgcccaggagcctcctctctcagcatggaagtgcttgggtccgctcagaccccagaacatccattgtttgggggtttttcagtcacatacccagcagaggagagaggtctggtaagcacccttcctgccaaccagctttcatcatttccagctcgcgcctggctggtttccctcctgccccgggttgcctggaacttcatcacactgtttcagcccttgtctttggagggttcttgataggagcagagcagcaccagtgctgtggccggtggcagctctcacagctgttgggagagcccagcacagagtggaggaggcaccatgaggggagccgtgtctgaccactggtcaggggtcatcagtgccaggcaccttacgggtgatgtcacctgatgtatttttaggcagatggccatctcgttccctttttactcaaccattgggagtttgaaaactgaaaggatttttcct

SEQ ID NO: 119017 - DNA, 1029 bp, Homo sapiens
agtcagttagcctctctgggcctcacagccccaaaacagctgtgcccacctgagggttgtggtgagggttctgaagaagattgtggctaccacactgcagagctggaagctgttgtgggggcccagggcctggtggtgtgggcacatgccccacccatgtgctctcgggctgtggacccagcagcttccatcactgccaacagagcgtgactatcacagcctgtgcgagcggcagcccattgggcgcctgctgttccgagagttctgtgccacgaggccggagctgagccgctgcgtcgccttcctggatggggtggtgagtgcagcccagccctgcccagccccgcgggtggccgaggtcctggccccatgtgcccctcctccccacacctgctgcttgccctgcccagacctccagcttctttgctttccaccctgcaggccgagtatgaagtgaccccggatgacaagcggaaggcatgtgggcggcagctaacgcagaattttctgagccacacggtgagtgagcagcgatggagagatgatgggagccaccagagccccgtgtcaggcacaggagtgaccacagtgtcaggcttctgagggtggtctcttcatacagacacatgtaacacacagcctggacagagagtgccctggagctgctccaggcagcacggcgggcatgcagcccagggtatgggctgggcttgggccaggcggcctcccagtggctctgctgcgctctgcctcatgggtgggcagcaggaaggacttcagcaaccaggctggctggcacaccctggcctgcagcctctcatggcaccagcccgagttgcctgacccctctcccctggaagtgggcagccatccaagggagcccctgcactgacctgtctggggcttgttcccagggtcctgacctcatccctgaggtcccccggcagctggtgacgaactgcacccagcggctggagcagggtccctgcaaagaccttttccaggaactcacccggtaagcctgtccct

SEQ ID NO: 119018 - DNA, 1038 bp, Homo sapiens
gtcaggggctggcgggtgagctgggcctgcctttcctcaacaggctgacccacgagtacctgagcgtggccccttttgccgactacctcgacagcatctacttcaaccgtttcctgcagtggaagtggctggaaaggtgagctccctgaaggctgggccgggacaggccaggtcgccggggttcttcataggccttgggctctcctgctcagccagcgtttgcttccccaccccttgccacaggcagccagtgaccaaaaacaccttcaggcaataccgagtcctgggcaaaggtggctttggggaggtgagtggccaggccagagcccctgggagagtgaatagggtgggtgtgttgggacctggaccaccccctggatgcccagcaatggcacagctggcccccattcgcccctgtctgtctggccacaggtgtgcgcctgccaggtgcgggccacaggtaagatgtatgcctgcaagaagctagagaaaaagcggatcaagaagcggaaaggggaggccatggcgctgaacgagaagcagatcctggagaaagtgaacagtaggtttgtagtaagtacagaaggagactctcccttccccttggccacactggcgcaccgaccgtccccaccccccaggccccaccctcccatgtgggatgccaggaagggcgggtttggggtgttgacaccaggcttggggagcaggctgggcccaaggagtggcaccgagaaggcttttttgggcagccctgccgccaagcgccccgcagctcctgcctgagggctcgggtcccctcggccacaggtgagcttggcctacgcctatgagaccaaggacgcgctgtgcctggtgctgacactgatgaacgggggcgacctcaagttccacatctaccacatgggccaggctggcttccccgaagcgcgggccgtcttctacgccgccgagatctgctgtggcctggaggacctgcaccgggagcgcatcgtgtacaggtggggagggctcggccaccccaggggcttagtcctt

SEQ ID NO: 119019 - DNA, 1613 bp, Homo sapiens
aggtattcagaaaataggagtttccttcttctcgctgatattaaatccagaagttgcaaaatggtagccacatgggcccaatttggcctacatttgtgtttaagtcaaactgtttttagtaagccagatggtttcacatacaaaatacagatttctgacttcttgtgtaaaatctgaagacccggggaccctgggcgcggcctcctgcagggccgtattcaccccgcttgatggggcctgtgctctcctactggccaaggtcccccctggccagcgggtgtgagtgtatcccagacctaacgtgcactggcgttcctggggcctgagggtccactgcccgcctcctgcccagccctaactcccatgccgcccgcccagctccggaggtggtgaagaatgaacggtacacgttcagccctgactggtgggcgctcggctgcctcctgtacgagatgatcgcaggccagtcgcccttccagcagaggaagaagaagatcaagcgggaggaggtggagcggctggtgaaggaggtccccgaggagtattccgagcgcttttccccgcaggcccgctcactttgctcacaggtacggcagctcacagaagcctggccagccagggctggggtggatgcacctttccctccctcccacccactcacctgcctggcctgcctggccgactcacccctgccacagctcctctgcaaggaccctgccgaacgcctggggtgtcgtgggggcagtgcccgcgaggtgaaggagcaccccctctttaagaagctgaacttcaagcggctgggagctggcatgctggagccgccgttcaagcctgacgtgagtgcagcccactcctgctgagggcggggcccagccagggctggggctcaggggctcttgtagtatcagccaggatgcttccagtgcaagtggcagaaaaaacaatctagtggcttagccacagaaataaagataattcacaaaaaggaaaagccccaggatgggtctggcttgtggcatgcctggatggggcttggagcctctgacaatgtcctaggaactctctctccttcccctcactgtaccgttgagtgtgtagtcttcatattggggtagctctccccatggtgcggcagcagtgggccccagcagctcagccaccacagtagacagagagcttctcttctcttttctcttctcctctcctctccttccttccttcgttcttttttcccttcttttttcctttctttcctttcttccttttcttttctttttggagacagggtcttgctctgtccccgaggctggagtgcagtggtgagatcttggctccctgcaacctctgcctcccaggttcaagcgattctcctgcctcagcctcctgagtagctgggattacaggcgcccaccaccatgcccggctaatttttgtatttttagtagagatgaggtttcaccatgttggccaggctggtcttgaaatcctgacctcaggtgatcctcttgcctcggcctcccaaagtgctgggattacaggagtgagccatcgcgcctgcccttgcccaataatttcaaaagaaatcctcatgggggaaaagaagtcccaaagct

SEQ ID NO: 119020 - DNA, 3048 bp, Homo sapiens
tcccagtgtgggtctggggaggtggagcagtgggagaccgtgccagtcctctgattggctgggagagaagacggcaagtcccaggtcatcgcagggcggggagccagggagtcaccagctccaggctctgcgtggtggtgcccagcggaggggccggctgagattcagcctgtactccccgccccaactgcatacccaggaagctgtgggcaggcgaaggaggtgcctggcattggcctttacacagcctcacagtcattgagcagtgaggaataacgtacgcagttcacagaggggaaaaccaggcttcggagagaagggcctgccccacttaggaagtgcgtggggcacctggtttctccaaatcagagagctgctggtgtcaggcagcactaggccaagacccgaggcagaatcagggctgagctgccttcgcgtgtgcgtgtgtgtgtttcctatctgaccgttgcctctgtcccaccagccccaggccatttactgcaaggatgttctggacattgaacagttctctacggtcaagggcgtggagctggagcctaccgaccaggacttctaccagaagtttgccacaggcagtgtgcccatcccctggcagaacgaggtgggggcctgccctgctggtggggtgggctccaggaggctgccctggggacagctgtcacagccgcctgctcctcagcagatggtggagaccgagtgcttccaagagctgaatgtctttgggctggatggctcagttcccccagacctggactggaagggccagccacctgcacctcctaaaaagggactgctgcagagactcttcagtcgccaagtaagccccagcagcggcctacctgggcccctaacctggctccaggggacggtgggtgggaggcagagccggtgcccgcatgcgctgggagtgggcgtcctccagtcctgttgtggtgcccagggtctctggcctcattcccgcctgtcccccacccctggctgggctcatggcctcttttctctttccagaggtgagcagtgtgggctccccgtgggttggccttgctgcctggcctcggggagccacgggcagcccttccatggcaaaggcaagatgtgggagaaagaagtctggtgcccgccccactccccctgcccactgctttgatcccctgcaccctggccccttcgagctgccagctttgcttcgcttgtctccccgtgccctgtctctgccagccccaggggagagggctgggcagaggccttgccctggcagaccgtgggatctacccagcccccttacttcagtctgttgccggcagcctctgcaatgacgcccacccacgtgtggcctgagctgctgctccaggctccttgtggagaggcccctccccagagtgcacccctcaggcagctcctggcctgccctggcagggtcggccccatgtgacgtccctcgtggttaatggcacctgctctgcctctctccctccctccgtgtcttccccgtccctccaggattgctgtggaaactgcagcgacagcgaggaagagctccccacccgcctctagcccccagcccgaggcccccaccagcagttggcggtagcagctactccgagcgccgtttacagttttgcacagtgatcttccccattgtccactcaagtcgtggcctggggaacacagacggagctgtccccagtgtcctccgtccctcagcccctggcctggctgagtttggcagggcctgggccatccctgggacaaaggtgcgtcccttcagctcttctccgtggagctcggggctttctgtatttatgtatttgtacgaatgtatatagcgaccagagcattcttaattcccgccgcagacctggcgcccccgccttggctcctgggggcagccagccctggctgggagagcgggagctggcagaggagccactgccaaactcaaggctcctctggcccagcttggatggctgagggtggtcacacccctgagccttcagcactgtgctggccaccccggcctctgagtaagactcgtgcctccccctgctgccctgggctcaggctgctaccctctggggcccaaagctgtcccttctcagtgcttgtcagcgctgggtctggggcctctgtatgccctaggcctgtgccaaagtggccagagattgggctgcctgtgatacccatcagcccactgccccggccggcccagataggtctgcctctgccttccagctcccacagcctggtccctgatactgggctctgtcctgcagacacctctttcagaaacgcccaagcccagcccctaggagggggtggggcatccctggtcaaccctcaaacattccggactcccctcataacaatagacacatgtgcccagcaataatccgccccttcctgtgtgcgcctgtggggtgcgtgcgcgcgcgtgtgtacctgtgtgggtgaaggggatagggcgaggctgtgcctgtgccccaggtcccagccctggcccttcccagactgtgatggccatcctggtcccagtgttagggtagcatgggattacagggccctgttttttccatatttaaagccaatttttattactcgttttgtccaacgtaagctgccacatgtctctgtgtgaatagtccgagcacaaacctggctagccgcccctgcctgcctctttcttgcttccggtgctccaggggtcttcctgctcccctggcccagctggaagcgggaagggattggaggtgggcctggagggaagcagggtgtgcccttccgaggcccaggagcccccagggctgactctgaactagcctctccagacagccaggctttggtagcctttgggctcacccagtgggtttcccaacttcctaaatgggatggggcctaaggaaagaagccttgggtacccactgggatgtgggtctgtttctgactgctggtaaggcgggccccgttggtgtcctcccctccaaggctaaggtggcctggctgcctaaatgtggacgtaagagtagggtg

SEQ ID NO: 119021 - DNA, 1001 bp, Homo sapiens
cgtcacccactgtctaggtctttgcccataatgtgtcaagggcaaaacagaggggtggatatgatgcacgtgcctcagcccggggcccgtacatggctggcgtccaggtaacgcaggcctggggcagacattccttacacagctcccaccctactcttacgtccacatttaggcagccaggccaccttagccttggaggggaggacaccaacggggcccgccttaccagcagtcagaaacagacccacatcccagtgggtacccaaggcttctttccttaggccccatcccatttaggaagttgggaaacccactgggtgagcccaaaggctaccaaagcctggctgtctggagaggctagttcagagtcagccctgggggctcctgggcctcggaagggcacaccctgcttccctccaggcccacctccaatcccttcccgcttccagctgggccaggggagcaggaagacccctggagcaccggaagcaagaaagaggcaggcaggggcggctagccaggtttgtgctcggactattcacacagagacatgtggcagcttacgttggacaaaacgagtaataaaaattggctttaaatatggaaaaaacagggccctgtaatcccatgctaccctaacactgggaccaggatggccatcacagtctgggaagggccagggctgggacctggggcacaggcacagcctcgccctatccccttcacccacacaggtacacacgcgcgcgcacgcaccccacaggcgcacacaggaaggggcggattattgctgggcacatgtgtctattgttatgaggggagtccggaatgtttgagggttgaccagggatgccccaccccctcctaggggctgggcttgggcgtttctgaaagaggtgtctgcaggacagagcccagtatcagggaccaggctgtgggagctggaaggcagaggcagacctatctgggccggccggggcagtgggctgatgggtatcaca

SEQ ID NO: 119022 - DNA, 1334 bp, Homo sapiens
aagtggccattgcagggtggggaggaaaccaggtaatgatgggaaagctggatcctacccatgtatcatgagaaaggagcctggggtgggtttgcccctctgccccaggctgttatgaggtgggagtgggggatttttaggtaggtgttagcatgtcataccaaagcccagccctgggcaggtatgcaagagagcgcgtgccaggtggatgtgcaggaccctgaggcactctgcctgcacctggatcaggacaccctggccagctcccccttgggctagggaggcatccagggaacttcttggctagggttaaactcaccttaaagctcttaacacagtgggtccttggcagagggaactcccagaattcatttcccaagaagcttccctgagctgtcctccatgcccagctctatggtgggaactgggacccagatggagacgaggcccctggcagcttggagctcagtctggtagggaggcagacgtgggaacagcgggacccagtgtgatcagcactgtggaagagaggattctagagctgacagggttgggggtggggcagcaccaaacagggaggccccttgaccctgaaggtgtcagaattggtgccctccaggacacagggtcagatgtacccaagtagaggagccagatggatggtctagggctttagtggtttaggatggctgagcatgggaggccaggggtggaagcaaggaatggctggagctgaagtcagtgagacacagccagctttgaaagctagattaaggatcacagggttaaggcccagatggggcctcatctggaaggtaggggattccctgaagggtttttactggttgtgttggggtgtttgctccagcatgtacaaaagcacccccagtctctgtccatgtggtttagacggggctgggcttgcaccccctgcacacgcatactccacacacatacctagagtgagagagccaggtgggaatgttgcaagtgacagaactgtcctcccgctaacttagaaggtgttccaaggatatggaggagcttcggggtcttagttgtgggctccattctcatcaggagacacccaccagaaccaagatgatagagccatttggttttgcctctttgagcccagttgcaaactcaaggagtctgagtggccaggctggatacctgcctgctgtgcactgtcagggagcagggcacttgggttcacagtttcaccaggatggcacccgtggggcagtgattcccccattgaaatcagggtgcctgtatacaaagaaaagggagcgggtactgggaggccattccctttgcataaggagcac

SEQ ID NO: 119023 - DNA, 1417 bp, Homo sapiens
tgagcttgcctgagagtgatgcaaacagaagcagatacgtgcctgacaccattgcgggaacacctggaagcaactgtgaccaaagctagaatctaccctgggacttgccagttgcatgaaccagtcccctttgagctcaaagctttttcttttctttctctttttctttcttttctttctttcctttcttctttctttctcttttatttttctttctttctgtcctttctctttcttctttctctttttttttttgagacagggtctcaccccctcccttaggctggagtgcggtggcgtgatctcggctcactgcaacctctgcctcccggattcaagcgattctccacaggcgtgcagatttttttttttttttggtagagacggggtacagctcaaacctatttgtttgggagttctgtcacttcaaccccaaatgttccagctaatatggtggtggaggggtttttggcaaatcatcttaagtgcagtagagaagttggacgaaaaacagcccagttaagaggccgatggacagccaacttcagagtggcctctgcaagcttggacctcggggtagacagtggggcgctctctaggggtcatctgttccctgctggggtaggggggaggcatgtccacggaggccagggctgtgggttcggcactaggtcctcctccccgtggcttcctagtaggcatgtggtggtgtacgcctgctgggcacctagcgagaggggtcgtgagttgggagggagccacgttggggtgcctgcctgctcgggggcccctgcccactgcgtgtgcgcagcgcctgtcaggatgtgacggggacctggacatgtgtgtgctctccgagctgagctgtgtgcgcgtccgggttctcgacctcagctgcctggctgtgcatccagcgtgcacgaccggtgtggcctgggctccagcctggagtgtggaccgggtcggccggcgtgtgcctcccctgtgagggtgccctggcgggtgtgagcccggcgggctggagaaccgggtctcggcgccgcaggtgggtgaccgtcctccccctccttccctccgggggcagcctcctcgcggcgtgtggctgggggtgcggggccctctgccggctgccgcgcgcgcgcacgccgggctcagcacccgccgtgtacgcgcccgtgcgcgcgccccgcgcctccagcccagcgctcggagccgctttcgctgccactgtctgctcccccgggccgccgccgcctccccccgcaggcccggggctctgtccgctgggcccgcgctgctcgccccgagccaggagaacgagctcgaggaggatgcctgggcccgtgagtaccgcggcggctgcgggccgggcgggcacggagcgcgggcggaagatggtcccaggactgagcccttc

SEQ ID NO: 119024 - DNA, 1092 bp, Homo sapiens
gaagactctaaagggaggctcagggaggtgagtgacttgcccaaggtcacactaccagtaagtggcagagctgagtctacactgcaggcttctctgggggcaaagctcctctctgcctgctagctaacttctcttgtaacccaggagaagaactgtagagccttcttccttcactttcctccagtgaggacattccctgtctttcgggtcttggtacatttttccttcttccagctaaatcagccacattcttgctcccccagatgcattataggatggggccagctttctccctcccttcttcacttcctccctccctccattttctccggtgagaccaagcagcaaagggctgcctcagtcccctgggaaaaccccaagccctggtcctcggctcatgggctccatggcctgctcagcttgcagtcttggctgtgggagagaaaatttagcaaagatgggtccatgcactgctgcagcctgtgggtgctcagtctagctccaggcattggaaacccacatgcttccaaggatcaggggggaaatggaatgagtgaggcgggccagggagccgctcagctccaatctttgtcactgtgtgaaatgtggacttggtatgacctgactgtccaattttcaagatgaaccagaaatccagacctttatataaaatctcctggatttttaaatgttggcaattaatcagaatgtttttaaaaatggattgtgaacatggattgtttttaaaacatgtctgagaactgtgtccaacctaagggtcctgtgtctgagacctctggtccgtgggaaagggaccgcaggttttgctgggccgcctccaggctgtgtacactgtgacaccaggggctgctttctgcatttgagcctcttgaggctgcagggtgatccctcatcagagggagttctgttgtcccctcggcaccctggtcctactgctgaagaaactccagctcaggtatgggagtagccaggatgggatcacatggctcggtgagggcagaagccagatttgagctcaggcctacccctcggcactctgcatgttacccaggctgccccccacagggtgtc

SEQ ID NO: 119025 - DNA, 1088 bp, Homo sapiens
cgcccgtggggccgcctcccctgggaggtcagatcattatttccatgccagctgcggggatgaaggcacagagagccacaggctgaggtttcagaggaggaacctggtctctgaaaaccctgccctgaggagggccggagctgagcgcagtagacactggcctgagggagggctctccacctacaagcccaccgaggcctcagtctctgtggtcttatttgtagtttcccaagccctgggttcctggcttggtgtcagggttaggtcatctacctgcaagcaagggtgcttgccactcagtaccctggcctaggcggagggcggttctggccagctccaagcctggctgactgggagtggagacaagtcctgtcaagtcctctctggcctcagttcctctgtgttgatgtgggaagggtgtaagggtgtcaccagtggctccctgaaatgcccttgctgccgggaccgaggactttgtcatcacccgggcttcacaccacctggctatggagacctgagctggacccactccttgagcctacatccttgtctgtagagagaacagcagccacctcctgagttttccttagataactagcatagagaccagtagtgggcctggcgtatgcaaggcacacaggacaggctgtcagtctgtcctgccccccagccctcaccccctgctctgagttcctgtcccttcccttgaagaccagcagctctagcctcaagtccaggtgtgacccagtgcccctgctgcccgggattttccatccccaccccccagagccctggtgtgtgcctccgtacagccttttcctttgattcacgtagacacatggggtctccacttgcttatgaactgccctgccaggcgggggctgggtgatggctcttctctgagtgacgttttggtgaatggctgacatttcccaggaatgaattggacacagagccagcccttgaggtactcccccggtcccacagctaaaagaccaaccaggtaacgagccctccagcatctccttccataggtggttcttgagccaattactgggtgccagctggtaaggccgatggtgctcggc

SEQ ID NO: 119026 - DNA, 1065 bp, Homo sapiens
gaaacagaggcaacttggaggttaagaaactcaccaagggtctcgctttcatccccctgccgtgctcccagtgagtgtgtggcccgagaaaacatgcagagcgatatggttcaaaagcactacagataaatcaagatgcaaccctaaaacatgttcaaataaccttcaagaaagtaagaaaagagaaacaggaaacagaacgtgagtaatcaaatggcagacttcggtccatctgcagggcatcgctccgagcacctgaatgtgttgggtaggtaggaggaggcacgtattggctactaccagtctggagcagtgtgggcagtggagggagtggctgggagcagcaggctgcaggcaggctctgagtctgaaaggctcccagacaagggcaagagctcacatagtaaaggagcagtaagggggcatggttttttcgggaggctttgccaagtctggcctggtcaggtagagcattttgaaaggtctgaatgaacctctgatgtttatgtattgagcacctatggtcggttagatgagagtctactgagcacctgggagggaggcttcagacaggattccagtcccgtgggcctgctgtggcactgccgagaagacagcgttcagtgtcaaatccctacccactccacctgggggtggagccaggttggggccagggggctagttatgtgaccttaagcaagagccttcctctctttggcccaaagttgcctagtttataaaatgcagctatgacggcacccagcaggtcctgggcgtggcctgccctgtatggcctaatgccccacctgctgagctgggcgccctcagggcacagagggccctctcttttgtctcttgctaacctggcgctgccattacatctccccttcatcctgtagctctttctcacactgctattccacagcagagtcgggctggtgatcaggcatgccagggccctggtgggaagggatgggaatgcattttggctgctagctggcttgtctgcccagtgcccccatggctgccacttacatctggcacagagtttggattcagactcag

SEQ ID NO: 119027 - DNA, 1045 bp, Homo sapiens
tcaggctagagttttgtggccaggcctgggttcaaattatggtgctaccacctgccatctacacagccagttgttcccccaactcctcgtctgtaaaataggaatcattccagttaccccaaaggctttcgttcaaacctgtgtgtataaggcattcaggaaaggctcagttctgttctgtgggggcggtgagcagtcacctgccacccttcactctcagagtcagggctccctcctacctccctcttagggtgcaaggttccccctctcacccgcagctgtggagaggaggaagcggaactagagatgcccatctggagtgagtgcaggaccaggtgggtacgaaagactagcttccaaccctcatctagttttcctcccctccgcgagagggaaagggagacggcggcctgaagacagaggcagagccaagtggggctgtgcaagggcaggaggcggggaagcggagttggagcaggcagggcgcctggaggaaaggaagagagtgtggcccacgcccggcgcggcgcgctaggctcagacaaaggcagggccggtggcacgcattaccagtcggagccacccgcctgagcccccctacgggagcggcgggagacccggagggcgcggtgcggagccagttgttccgggctttgggcagccaggggctgccaggcgtctgtacagggcgtcgggtggctgtctgtggggctctaggagatgtaccaccctttccccgccgcacagcaacggcgccgagacgcctcttcagggacctggtgcgcacaggctcctgaaaccctttggccccgggactgcggatggcgaatctctcgttcggactcagagctggagtccgtccttcgcgcgccccctgctggcccgcctcggctcccctcggcgcccgggctccgcggcggcggccggggctcagatcggggaaaccctaccggggaaacctcgaggcgtgacgtcaccctcctcggtgacgtcaccgggcccccggggagcgcgaggttcccacggaggaggctttccccggact

SEQ ID NO: 119028 - DNA, 1086 bp, Homo sapiens
tggccctgcattcctcatgcttgcaccagtacccccttctctgtgacccacattatttgaggggaagtccatcccaccctccctccctgggccggctctgcttttgttcccaaggcaggcatccttgtttccctggcaaccactgatggaatcattggttgctggggaaacgggctcaggcctgataggtcagccccagtcctgctgggtggggccaagtgacctgatgctttcccctgcaggccagtgaggggtacttcagtcaatcacaggaggaggagtttgcccaatcggaagagctctgtgccaaggctccgcctcctgtgttctacaacaagcctccaggtagtactgggctggatgatggggaggaatttgggtgcgggggctggatttgagtgtgggtagccaccccaccactacccaccgctcacagaggctggggacacaagcggtctgctaggtccctaactcctctccctttctaacgccacagagatcgacatcacatgctgggatgcagacccagttccagaagaggaggagggcttcgagggtggtgattagcggtggcgccagccctaggctacccttgccaaggccgcccacctgcatcagcctctggccagacggcccgccgtgcctgcattcgcagcagctccgcctggcacccactccggattccggccctggctggggacttggccgcttccctacccacagggcctgacttttacagcttttctctttttttaaaaagttgataggagacttgtacagttgactggctttcctctcgttggtagttgagacgctgttgcaaattccacccctccttccctggtccagattgtagctcttagtcctccctgctcagctggccgggttggaggcctcaccctgcttggggcctggcgtggggggagctctggtgggaaaatgtcccccacctcttttcctagttttatgtttcttgggaaaatatcactttgtattctctgtccagggcttcagatattttgcacgaattttaaaacatggcaataaatggctcgtgggctctggctccctgggaccccctccccg

SEQ ID NO: 119029 - DNA, 1039 bp, Homo sapiens
gcacccgtgggctctgcctgcgtggcctggtgcccgagtctggcctgcccggtccctcttagctctcaccctttaggtgtcgggggttcctggggcattcagcctgcttatgctgggtccttcgacactgcagggcaccacctaccagaagacggatgcagctgtggaaatgaagcggattaaccgagagcagttctgggagcaggccaaggtatggaaccctgagcccggcctggctgagccacccctcatggaccccatggggcaggtctgagtccctcactgcagtggcatggcccatgccacgtgccccgcccccagcgctgggttagggaggggctggaggggcagggtccaggcgcctaggctcggggcctacccttgttcgcaccggggcttgcagaaggaagaagagctgcggaaggaggaggagcggaagaaggccctggatgagaggctcaggttcgagcaggagcggatggagcaggagcggcaggagcaagaggagcgcgagcggcgctaccgggagcgggagcagcagatcgaggagcacaggtgagcctgcccgcccggagcgctccaggggcccccgggcgcaccctgacgggtgctggctgcttatcgttccaggaggaaacagcagactttagaagcggaagaggccaagaggcggttgaaggagcagtctatctttgtaagttctttgccaaggctcccggtctctgggtcagggaagtgagaatggtccctgtgttcctgggccttgtggggagatcagtggctcagggacagtggtggctgttctggggagctgcatgggcacagggtgccatggagcatgaggcctggcacctcatcacgtggggctctggcctctggccgtggaaaaagactactttggagaagcttgtgctctagattggaagagaaactccatctagacccagaccctcactgaccaggctccccctcccctgccctggggtttctcggcgattagacactgttctgcactctgaggggccacaggagtgaggca

SEQ ID NO: 119030 - DNA, 1074 bp, Homo sapiens
tcactaagggcccagataacattttgaaaaaggggtgtgaggatcactttctacacaagagaatatgaataccccagggcccagcatggaaccaggggtgcagtgaggtctgaagactcagaggcagaccctgcacataggtccagagggaggggtgtcttgggtaaattgctgtctgccccccgacccttaccttgcctccaatggggaggggtggttgggggagttcactcctaggtggcagggcctctgaagtgcaccactactctggcacagggagcaggggacccaggaaatgaggttgtgtggtgggaagggccactgttgtcctggttgtgatatgactcactgtgatcatacacaagttcctggtcctcttggaaagaaaagggattgggcccagcactacctcggatactgaaggcctttctagcaccaccatcctgagagtgatggtcctgcggggtccacctgccctcagcccccgactccagctcaccctccaccccagctcaccccccatcccagctcaccccagggtctctggaactgccacattccagctcccacctcacgctagttcagtttatctggctagatggcttttgagttggtgtcaatatcacacatacttctggtatgcggtgtgctggaccccaggacccagagagcaggatgtgctgattgactgagtcagcgttcctgccttcaccaggcttacagctgggggcagtgtctgtctccaggagttggagctggtgagatgtgtagatgcctggtcgcctaccccatcctgattccctgtggtttcgccagcttccacctggtgcaccaccaggctcggggtgcctctgatgtggttgagaagcactggtctttgtattcctgctgggatatggtgggtgctctgggaggggcagctcaggagaggctgctgggggccagcactgggctctgaagaacggaagcattccactgggaataggcgtggggtagaggagcaggtcttgccttccacgtgaagagaactacataggcagaggcttcagggtgagccctgtccagaaccctgct

SEQ ID NO: 119031 - DNA, 1240 bp, Homo sapiens
gaactgtgaagccctctccgtccgtcctcggttcccatggatacaagcgagaagggcacagggacggatggtaactgtagccgggagcccgtctgggaacgccgagcagcacggccagatctgccagtttatcgacagcgtccagaggttcagatttgtatgtgagatctggtgtttgaatattggcaactacattagattttttttttaatcctattagaaaaataacaaatgtgggccaaatccagcatgaggacggccagggcccagcatagtgaggaggtgagacgccggaacaccagcatcacagcactgggcaggaacagcacggccagggcaggaggacaacaacctccagggaaggggcaaggaagcctggacagggcaagagcgtgtcaagaagctgccgacaatgtcaaccaggcagataaggccgaggagtccctcgtggcatttcacaacaaggtgacatttgccagatcagtttagccgagctggggcggctgccagggttaaagaggaacaaggcgggagggtggggaggatgtggaaggagagagtgcagacagctcttttaagaggtttggctgtggtgggccaagatgaccgccaagctcagctgagaggccagggtgtgggtggcgggagaggcctgggaggcatctgctggaggatggtgggagaagatgggagaagttgggagggggccgtaaggagagagtggggtgaagggcaggggcaaatgcagaaccgtggagctggagctggcctagagtggggcaggagcaggtgccaggcacctccttgaaacagccaccctcactccgtaggccggaaacatgatgcaatcacatgtcatttaatcatcataacacctttgagaacacattattacaggcatgtttcagatgagggtactgaggctcagagaggatcagtgacttgtacagagtcacccagatggaatggcctggactgccactccaaggatcaaaggccaaagtgttccctgctgacccaccagcactccccagctcctctcatgcgtcccccatcacctgggctcccatccagactttgccgctccaccagctgtgtgcctccgggcaagacacaacccttctttgagccttggtttccccatctgtcaaataatagcagctgggcacagtggcttacacctgtaatcccagcactttggaaggccgagatgggtggatcacctgaggtcaggagttca

SEQ ID NO: 119032 - DNA, 1050 bp, Homo sapiens
tgctcagcagatttttaaatctttttgtagagatgaggttttgctatgttgcccaggctggtctcgaactcctggcctcgagcgatcctcccaccttggcctcccaaagcactgggattacagacgtgagccactgcgcccagcagatttctctttaacacctagatttcagcctgagccaggcaggcattcctgaatgaaccagtagtactgctcccagaagaagaggtcctcctccgtgtgacacagtccccacttggcccttgcagggattggatctgggatccctggatttaaactcagggccatcctcataacagcctcacaaggctgggattagcttcccagttcacaagggaagaaaccaagacttgagaaggtcaaggtctggccagacccacacatcttggaccctcataccgcctcgaggccccatgctgccctctgcctgctccagatgtgaatactgctggccctggctggccccggctggccccgagggtcctagggatgaacagcccagcccagggagagctcagccccttgtgcctctgccccttcccacctcctgcggaggccagtcgactcacccacaaagggccaggcactgtggggatagatcagctaacaaaacagttgatgcttcctgcccttctgggccttacattttggctggaagaagaggggagaggcagactgtaagcaataagcgcaataagtaggttgcctggaagtaatgttagatcacgttacggaaaacaggaaagagcagagcgacaagtgctggggtgcgtggtgcagggaaggcagctggctgctgctggtgtggtcagagtgggccctcatggagaagactgcattcgagcagaaacttgaagggggtgaggggtgagcctagagatatctggggcagagcagtccaggcagaggggacagccggtgtcaagcccaggacaggagtgtgcctggtgtgccagtttcaggcaagaggccagtgtgcagaggcaaggtgagaacgcaagggagagcagtggcggagacggttgggaa

SEQ ID NO: 119033 - DNA, 2888 bp, Homo sapiens
agtggccgtgggtgactgggtgctgagcatcgatggcgagaatgcgggtagcctcacacacatcgaagctcagaacaagatccgggcctgcggggagcgcctcagcctgggcctcagcaggtatgcgggtggacatggatgggtgcgcccgcgctggcagtggggatccctgcgggcccggcccgctgtcacgctttccttctcctccagggcccagccggttcagagcaaaccgcagaaggtacgaggctggccgggacatccgggcggtgggcggtgtgggcttggacggccaggcctgctcgccctcctggcacattctcggtaccccaatccctggccgggagtggagggcagaaaccggagctaaggcgggtctagggccctggagttgagccaggggctgctgcacggtcctggcaccacgcatgtccgcctgtctgtccgcctgtctgtccgcctgctgcctcccgccgccggcgctgcgtgctcgcccgcactcggtcagccctcggtcctgcgtggactgagatcgccactcccaaatgggccccttgaaacctgagtcgtcctctccccgtagcctccaaatagatgtagggggtggggtgggggtggggggctggagctgccgctgtcctctgctgcaggcgccccacttccacccaggcccccaccttaccctgcccgcccgccctgcccggctgtgtctctgcccaggcctccgcccccgccgcggaccctccgcggtacacctttgcacccagcgtctccctcaacaagacggcccggccctttggggcgcccccgcccgctgacagcgccccgcagcagaatgggtacgtcggcccctgcccgcccgcgcccacgccatcaggcccactgtggccccacgcccgctgcccgctgctgctcagtctgtgctgcgccccagcccggcggaaccgtgcggcagcgccccctggcggccggggtggggctgcaggcacagggcccctcccgaggctgtggcgccttgcagggcaccgccctggggaggggtctctgaatgacgccgcgccccctgctggcggctgggggttgggttgtggtgtcgggccagctgagccccagacactcagtgccgccttgtccccggctgttctgacccctccccgtctttcttcctctcctgtgtctgtccctttgtccctttatctgtctgtctgtcttatttccttcacaggtgcagacccctgacaagtcagtgagcccccctctgcctgtgcctttcttcttccttttggcactctgggtggcggcccctccccaccctggctgccctcctctccacttcgccctcctgtcctctcacctacccgcccagcagggctcctggcctcacccttacccactccctcccatcactgtaacccaaacccacatgcaccaaatcctgggaggggctgcccccaccgcccacccccagtgtggggttctgagccacaccctccccacagacagccgctccgaccgctggtcccagatgccagcaagcagcggctgatggagaacacagaggactggcggccgcggccggggacaggccagtcgcgttccttccgcatccttgcccacctcacaggcaccgagttcagtaagtgccagcccagggcagggggtactttcctcgcccccagcccaggcgtgatccctgaccctgtgtcttttttggtcaatgcctgcctctgccctctcagtgcaagacccggatgaggagcacctgaagaaatcaaggtacagggacgggcaccagcccctctcccacctcctgcctcttccattccagctactgccctgtgtctactcctgaggctcccagctggggctctcaattctcccttccttccttccttccttccttccttccttccttccttccttccttccttcccttcctccttccttccttctttcatttcttccctccctccttccttccctcctccctccctgcctcccttccatctctccttccttccacttcttcctccctctctctctgcccctcagggaaaagtatgtcctggagctgcagagcccacgctacacccgcctccgggactggcaccaccagcgctctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctcagccctgcttgctctgcctgtcttctatctttgtggacctggtttgcatttggggtgtgggggtgtttcgtggttcggactgtttgggccctgccgtcctcgttttcagtgggagggggtacctggcaaaggggccctgccctgccatcacagatggcttcctggcatgaggggaaccccaggagctgcctcagaagcgggagccctgcctcgtctcccagctagagaccgcacaccagctaactggacattgctaggagaagctgcccttcccatccctaccccagtgggacctggaatccaactcggcagtttccacgcccccagtcatctcccgtggggccagcaggacccaggttggggggtggggccatgtcaggaagctcagccatgcagggccttgaatggcagatcttgcagccaggtgcccaggacagaagccccagccccagcctcatctacaccccaggagccctggcctggtgagagggagtg

SEQ ID NO: 119034 - DNA, 1076 bp, Homo sapiens
actggcctgggggtcaggagggggtggggacttcctgcccctatatccgcctgccccaagagacccacccaggcgccgggtgggcaggcagctgttgtcaggaagcccaaggcaagcccagcctggaggggcccagagggtcgtggcctgaggaggggctcaagctggagtctgtctgtaggagctgggcgtgggggttagggtgggcaggccagcagtgctcttctcaggggtcctttgatggcattctcctggaacctgccccgccagcagggtagtgaggcagtggttgccctatgacacacgtcccactacatagccctcacacagccctgaaacctacctgacgtcctgctccctgggaaagtgctggcccagtgtgtctggggagcctgaacctcagtttcttccctgatggagatgactttcagatatggcctgttgggggcactccgggctccagctccctggtcagcatccctggcatgtgggcggggccactagctgatcccagccctggagttggacctgggcccacatgggtgggtgaggtgggcttttctgagttaggccagccccctccccctcccctgaccccagaatggagggaggtgggaggggcaagggctggctgtgggcccaggcctgggagatgaggtaacgtctgggactggggggctgggctgctcaggctgactcacccccacctcatgcagggtccagccccctggctttttccctccttggttcctctggccttaccctgcccctggcttgagcccctccctgcctctctccagccacccgcccagcgctgtcttctgctctcctgctgccctccccacgctctgaacacccctcatcctctgtgcttcctgccctcctcactctgggaagggaagccgtccccgccccccaccccctctccaggagccagctagctgcaccccaagacccccacctcgggctcagcccacagctcccaggagccagccctgtgggcagggagtggctgggccaggtttcccttctactgactcaccatgaccttgagtaagtcacttcccctctggggt

SEQ ID NO: 119035 - DNA, 1042 bp, Homo sapiens
cctccccagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatggtaagagcctggggcccaagggcatgggttaggccggaaaagggccaagccaggcccctagtgtccagcgatgggccagagactctgtccttctctctgcagtacaccggattggccgcaccgggcgctcgggaaacacaggcatcgccactaccttcatcaacaaagcgtgtggtgagtctgttaccagcgccaccttagctgttccctgggtcccctgcctgtggccacccaggttctggccacagagcccaggatgggccctgatgcttccccactcctcccccagatgagtcagtgctgatggacctcaaagcgctgctgctagaagccaagcagaaggtgccgcccgtgctgcaggtgctgcattgcggggatgagtccatgctggacattggaggtgactgcagagcgggatccccgagtccccagccggcaggtggcaaggaggggtgctggaagtcagaaacgtgaaaccggtggaccgagggtgcctaacggggggcccgaagtccagggcatggatcctggtccttgacttggctgacccctgtccccattcccccaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctgggatgggccaggctggtcctggctgcctgttccctgtgctcttcagaattactgtttttgtttcctttt

SEQ ID NO: 119036 - DNA, 1071 bp, Homo sapiens
ggcgtgcccaagacgccatgctctgggagaggttgggcacctggcaggccgccccgactccggatcagctgtctccgctgcgtacgtcttcctcttccaatgggcttggattgagccttctagcgcatattccaagtcctccaatgtcccacaatgccttgcagccggtttcgccctcggtcctggcaactgtcgcgtaaccacccatgaaagcgtccatgcctcgccgtgcgatagtatctccggaacaaatttgtccctctgcgcgatccggaactccgaggtcgttcctacgcgccgtcgttcgcctcttcacatcggattgggtctcacgcaaggatgaggcggggtttcgccgtggcgcgcatgcgtgcagcaaagaatggaggagtcggaacccgaacggaaggtaggagagaggcgagaccccgcgcgtgtgggagcgggcgtgaagaggggagcaggccgtgcctgactggcgtgtgcttgcagcgggctcgcaccgacgaggtgcctgccggaggaagccgctccgaggcggaagatgaggacgacgaggactacgtgccctatgtgccgttacggcagcgccggcagctactggtgaggggcacgcgtccggggagggatggggccgtgaccgcggggtcgcagggggcgggcgtggcctcggcctccgtggggaggagggcagtctgaggagtgagcttcagtacaccagggcgcggcccccagacaaacgagggaccgacggcttgatctgaggggtagggcagctttgcgcctcgggcacaggatcctcgccccaaagccaggatcctgacgctgaccttgtggactccatgcccatcctatctgtggatcccgggtggaacctcagctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaaggtgggctgggcagcactgcctgggcgagaaa

SEQ ID NO: 119037 - DNA, 1018 bp, Homo sapiens
agtgccaaaggctggatctactcaaggattgtcccccaccttgtcaggatcctgggactggggctctgtctcccaacccgttaacctgcatcctctgctacaggtgatccagggaatcttcaacattttcagcccagggaacaaaaatagcagccagctgtttctgctaccagagacccatgggtacccaagtggcatggggaggctggagcatggctcattgcttactgtgattctgctctttttttctttctcaggccctgcccaggctgagctgcttcagggcgtcctgaggccctgactgccagctgaaggcgtataatttttccctccgtgtgccccacctacccgtccaagaccctctgtgctccccaccatcctggaccaaccaaaagctgaacggatgccacactgtgctggggccccttgacctcagcagagccgcttcctggtgctacgcagcctccacactcagagcccgtggactgggctggcctaagggccagggctgatggtactgctggcccaacactgctctctttgtgtttggtttttttgtttttgtttttattttgtttttttccaattctttacttttgatactgtgaagatctttcgtgccgaaagataaagcaacatttggacacagagttggcatgttggtgatttgtgggtctgggcggggagggagttgagggtgtgctcagaagcatgggctctcccttagtcactaaccctagcatgcaccatgcatcagcagtttggtgctattgtcccattttacaggtgaggaaactaaagccgataggaaagtgactcagctcaacttagtctggctgattagcattgagcgcagactggtatgattatggcatctgtgcccttttctccttttgggaggtctctggtatgtgagcctggggcagccccttccccactctttcctgtttccctctttgcaagatgggtgagttggaggggttgaagatggtctctgtgcatctggatgtgagaagag

SEQ ID NO: 119038 - DNA, 1103 bp, Homo sapiens
aactcacagggcctggcctgctgcctcacagcctcaatggtcggtaaatggttgtcagatggaattgagaaacataggaacttctgaagatcaggcctgggtgtattgtcctggctctgccacttcctagccacctcctcctcctgttctttccaaagtcgaggtttctcacctataagcagagggtcatgatgcagcaaagacagtggcgaggattaaaggagacatctatgggaagtgctgacggtacagagcagaaagtgtgtgtttctgtgctttctcctctggcttccagagtgtatatggttccatatcattccctccacaccagcagttgtcaaacttttttttttttagcagccaaacttttctgtgaaatctgtgtggtgctgggggagcgaggtgaagggcccttggtcctcgttggtccaacccagggcctctgagccctactcacagctagaaatgctgctgcagctgctgcagaccaagctgctccctgagggccacgaagcccagccccaccttcgcacatgggaaaggaccccacacagactctcagctgtcctcatactgaccctggaatgtagagatgcctcttcttcctaatttacaaataggaaaagtaaggttcagagagaataagtgatttgtccaaggtcccacagaacaattgactgtagtccattgtggagccagggttcacaaaagataagtgcctgctgggacgcagggtcaccctctgtacattgactccgaggtggtagcaagccctggtttctctcaccagctgccctttcatgtttctcttcctccattcccaaatcagctggaagtacaggaggcagtgggagtcaatggcgccaggcgcaccacagcaacctccttcccgagggttttttatctgccgcctgtctccctctaaaggcatcgttggccttgaggtgggatggagaggttggggtgactgagatcccacagactttcattttgattccctagatccagatctgtcaaagccaactggcagggcctggcctctctgagccttccaggcctcacctgggcaaaggagcagctctcacatcttgctgtgtaggcca

SEQ ID NO: 119039 - DNA, 1092 bp, Homo sapiens
tctctcccgcctcaggaaatggaaagagctcagtgtctctctgctcccttctcccactgccagcccgtgacactctcaccttgtctttgtgtcttctgtctacacgaaggtgagagagtcatgggctgacagtgggagaagggagcagagagacaccctgcttcttaaaaactgcacccctggctctgtcatctgtgacctcctgccactcctccacatccactgaagactctcctgccccgttctcttcttcccaggtcaatccgtttctcactcacttgaatggagtaagcattgctaagtattggtaggagggcaggcaaattgacccatcactcactcactcactcaccagtactcaattccttgtcccgctgtctttccttcagacccactcagaaacactgcagccctgggttccaccccagcctggctctccctttctacagctcaagaaaagcacatgagtgaatctgtggcagccagccacgtgggctcccgattgccgagttcccgtgtcgccaggcgggcctctcatggttccctgggcttcctgtaccttagcacgtccattccccacagtccttctgtcaggcctccagtcttctcaaaccgctaggccttccgagcccacaccttattttttggcaaatagcctcactttttatttcaatgaggaaaaaagccattatacagggattctcccactgttttgccattcccacctgcaaacatactttcttccttgtcatgagagtcacccttttcccgcctaaggcctgtgcggtactttcttgacccctcagcccagcagcaggctcctggtctagcttagcctctcctccatgctgttcccgtccacatttcattgtgtccaccattctcttttttggaagcaaactgctccttgagcctgttacctctctctcaacccctccccagcctctttcctctcatcacagccacacttcttgaaaaatgatgtctgcattcactgtcttcccttccacccattagctcattgcaggcggttttctacccacaccctctccagagtcaccggtgacttttttgttgccaaatccatcctcc

SEQ ID NO: 119040 - DNA, 1038 bp, Homo sapiens
tgggcctttgatctgatggcaggagagggagatggaggcagggatgtctcccaggtgtttgcttggtgaccagcaagatggtggtgcctttcactgagccaggatgggatttgcagaagacagtgaattcagttgaggcatgttgactcgaaggttcccgtgagacatctaagtggagaagtgcagggctagcatttaccagcgcagagatgtaattgaagccaggggaatgaaccaggcctcgggactgaggacagaacctggtgatctattcctcggcagccctcctgccagatgagccccagagcttgatggcttgtcccttgtggcttctttacctcttcacctgcctactcccaactgcatctgcacagtgacacgtttaggagcccagcatccgaagagatttgggtgtaacaaccagctagttccagttcctgggtggtcaaacagccctagtgctttggaaagcagaagtgattcaccatcctttttcagccccaaggacaaccaggatccttctcccgccgcctgaagtagtgagccaaggggtcccaccgctgccttctgaaggtggtcagcactgtctttctcccatgcagtcacctagccagaaaggttcagtgggctgcagtagtctctggcctttcctggcttcttaggacagtggttcccagttaggtccccagagagcacatccggcagttcccaagtctgatgtgcttttcgtaaatatgtgtgctcagatgtctcttcccctttactgataatgctatcttctctcaccttttcttctgacaaactttccttccaagttcagttcagctgtttcctccttcatagccatccttgggtaacttccactgtactcccaacctacctcatatatctggaggctctgctcactcatcccacactgcacagctcctgtctggcaggcccaggcagaaccaggcagccctgcctttccagacttagtcgtggggctgcaggcagggacagacacacagtggcagcgtgatgcatcaagtgattatg

SEQ ID NO: 119041 - DNA, 1028 bp, Homo sapiens
agaggtgcaatgtagttggaccacctgggacctctgtggagtggggcaagtgaagggcggtcaggatggcaggtggtggttgggatgcttcctgggtttctgcatcaccctgcctcacctctgggccttcctccccatcatcagggatcccgggtgcaaggggcacaagtttgcacacagtggcctggcttgccagctgccccagccctgcgaggcagatgaggggctgggtgaggaagaggatagcagctctgagcgaagctcctgcacctcatcctccacccaccagagagatgggaagttctgtgactgctgctactgtgagttcttcggccacaatgcggtgagtgagcctgcccaggctagagagggctgggggccagccaaggtgagcaaaaggagcaccctgctctccccagagaccccgttgctcacggtggtaattaccgtgctggggccgtgagtccttgcacctgcgtctgctcgcttgatcctcacagcacatttgtgaggtaggggtttttaaacattttgctacctttgctcttctcatggtttctcttaagattgactttttttccttaggcaaaaggaaaggaaatggcagagagaaagctatgattctgatgagtatgtatacgtgtgtaatcccagagaagtgaacgcttgggagtgatgaaggcagagtggaagcaaaaaggctctcagtcccccaagtgtgacagccagccgagggacaggccgtgagcacagacggcgccaggaaggaggctcagatcagagggcatgctggctctggccagggggaggaagcagtgcagaagtctcataaggtgaagaggagagggccgctggttagggtagagcagctgaggatagaagaaatgaaagtaattaaattgctagtcacctttgagctaggggttattatcctcattttagagatgacaaaattgaggctcacaaagactcggtgactcgcccaaggtcatacagcttcccagtgacgaagcccgggctccaacttg

SEQ ID NO: 119042 - DNA, 2891 bp, Homo sapiens
taagtgtgctgcatgaagggcaaactcgctacccacttgaacttagaattttggaaaatttggggttaactttgaggtggcaattaaaaagtagactatgtctttcctttcattatttttcaattgtaaagaagtatgtgttttggcctggcacagtggctcacacctatactcctagcgctttgggagtcctaggcaggaagatcacttgagcctaggagtttgagaccagcctgggcaacatggcaagacccccctctctacaaaaaattttgaaaattagccaggcatggtggcatgcaactgtagtcctagctactcaggaggctgaggcaggaggattgcctgaacccaggagtttagggttgctgtgagcattgatcatgccactgcactccagcctgggtgacagagctttaaaaaaaaaaaaaaaaatagtatgtggggtttttttgttttgtgttttgttttgttttaacttggaacaattcagaaatgtataaggaaaaaaatgtcttcacaacctaaacttctaccactgtggtatattttcaccatgtttctgtatataaataacatacttagatatttgatatacctttcgtgtagtagtaattttttaacattatgtcatgatcatttccccagttaaaattcttcaagaaacttttcaatagtcatataatgtcttactgtatagctcaagcatactttatcattcccctattcctggatatctaggcatttccagttgtttaaccataatgaatgagactgtaataagcatccctgcacctaaatctgtttgaatgagaaatcatgtccttcagggagattcctagaagtaactcttaagtactaagaaaggttatactaacatatatttgaaagagaattctttggagaagatagaggtatatttttatgttagaaatcagatctgtgtttatcatgcatttctatcttcctattggaaagtctcctgtgtctggcacatgccgggttgacagtgtctgcagtctgccacccgccggttttcacttagcgttgcctcctcagcatatttgtgttctcttgtggtgttcttagcctctagcttcaaaggctggagaacatcgaccgcaattcatgttactgttctctagttgctgagcatttgggttattcggacattttaacattaccaacagtgtctctaaagatgtcttttcttaaagcctttttcctcttttggatttttcttgttggaatcaagttctcagaatgaaaaaagttactagttaaaggctgtttaggtgttttttgttctctttgagggttcttaatacacattgaaaaactgctatccaaaggggtctccaaactgatgtaaccaccaatgagtgctggtttcccatattcacaagcacactattttaatttttctaaaatcaattttgtggcctggtgcccagctcatgcctataatcccagccctttgggaggccgaggcagaaagattgcttgagcccaggagttggagactagcaagggcaacataatgagactctgtctctacaaaaaatttaaaaactagtggggcataatgtgcatgcctctagttccagctacttaggttgcgggggctgaagtgggacaggatcgcttgagcctgggagatacaggctgcagtgagctgacatcgtgccactgaactctagcctaggcaacaaagtgagagccagtctcaaaatagaaaataaaatcaattttgctggccaggcgcggtggctcattcctgtaatcccagcactttgggaggctgaggtgagcagatcacgaggtcaagaattccagaccagcctggccagcatggtgaaacctcatctctattaaaaatacaaaaaaaaaaaattagctgggcatggtggcgtgtgtctgtagtcccagctactcaggaggctgaggcaggagaatcgcatgaacctgggaggcggaggttgcagtgagccgaggtcgcaacactgcactccatccagcttgggcaacagagcgagactccgtctccaaaaaaaaaaaaaaaaaatcagttttgctaatgcaatagataatgaatggttggtttagaacaaacttctgtaagcaccactgataatgattcctgccaccatcttttttaatccacgtcacatgcttagcatcctttctagcagcagagagggctgctttggactgccctggaagctgggcctccacacagctccttgagctccgtccttgctctcagttcccctgccacctcagcctcagcccagcgttgggaccagcccaatgggtgcttcagctgctcatggcccagcctaaggcttcagctcttcctggctcaaattatgggatgtttcaggcgtatgtctcattcttaccctgggaaaatactctgtattacaagatatcccagtgcttcctgaaatccagaggcagaacaatacagtggagagaatatgagctttgcatagagagaaacgtgggcttgagttccccacatctcccctgcctgcacccaccatgtaccccttctcagggcactgtgcacatctcactttatcctcctgtttatcgtgcatcattgtcactgtctgtttgcatccttgagtcctggccacctgttgggcaaagcagtcaagtactcagcttcactctctaccactgcaaagtggggataatgacacttattttggaggacttgggggatggttagaaataatatgccaaggccgggcgcagtggctcacgcctgtaatcccagcactttgggaggccgaggcaggtggatcaactaggtcaggagatcgagaccatcctggctaacatggtgaaaccccatctctactaaaaatacaagaaaattagcc

SEQ ID NO: 119043 - DNA, 1171 bp, Homo sapiens
aaaaaaaaaagtccaaataatgactgtattgggcctatgctatgggcatacacagggtagacactttacctgctacgcagtgatgatccttacaacaactctgcaaggtaggtaggaattggagcccagagaagttaaataacttgctcaaggtcacccagccagtatgtgttcaggcaggaattagaatgcatatctgtttgatttcaaagcccagactgttttcaccatactcactacctctcaggagcaccaaccagagccttaccttccctctgacacaatttcccattgagttgatgctttctgactagctgtacaaacgcctcctccaaaatgttgctgcgatcctaagggaattgtgcaattcttcagaaaacccacacattctcctaaactgtccactgactaaaagcattctttccttccagatgggcattggtccctgggctgtacaggcagcccaagaattgtggacactcccagccatgccagagagggaagggccatcttctctttaacctttaagatttggggatgtcagagaattaggatatttgagcatgagttttggagccagactcactagggttcaaccactcgctagcttttaaccttgggcaactcatttaacttcttgaaatctgtttcttcatcttaaaaaatgggaataagaacacctcgtttgcagagctgttacaaggactaaattttaattatgtctaaaaagtgcctaacccagtgcctggcacgtaataagtggcattactaatattgttactattattttgaaggagagcctttcccctcctgggaaaccctgtttctgtctgttggacaggtcccccccgcctccagccagcctgtgcagacttgctgcctgctgtgtcaccgggaacgcaaaggctgggaagaaggcccttctcaaaatggactggtgttgcagggtgagaagctgccccctgacttcatgccaaagctcgtcaagaatctcctaggcgagatgcctctgtgggtctgccagagttgccgaaagagcatggaggaagatgaaaggcagacaggtcgagaacatgcagtggcggtaggtaaccgctgacaggggtccctgaatgcaggagggctcctccccaaggaagtcaggctgttccctgtcctcaggtggctctcc

SEQ ID NO: 119044 - DNA, 1083 bp, Homo sapiens
actaaaaatacaaaaaaattagccgggcgtggtggcgggcacctgtagtcccggctactcgggaggctgaggcaggagaatggcgtgaacctgggaggcggagcttgcagtgagccgagatcgtaccactgcactccagcctgggcgacagagcgagactccgtctcaaaagaagaaaaaaaaaagaatttcgagaataactatacaagattttaattgtatgtactgactttcgaacctagcatgcaaatgaaatgaaaccgttgtagtaaaattacatgtcttggtgctcgccttgtggtcatcatcatggcaggaaaagggactctatctagagttactgtggcacttcgtagctatggaaagtttcctctttgccttaatttctctgaataccatccttctctatccaccttccacccctgcagttgccattaaacaactgtcttgctcattgaaatgttcccttggcagacactgatttaggctgtatcttttgtgagttccacatgtaaaatttctgtctctctggtactctttttctaagttccttgtacttccgaaagtttcattatgcttctggtactactgtttggttcctttcttttttgagaaaccaaggacccaagtcagtgtaatggtaacattagaggtttaaggataccctaatgctaactcattatgagaaagtaatttcacgggagaaaaatgatggcattatcttattggtaggatgagggtgatacccttattattcccgtaggcctctgcagacacatgttacccagtgttgggtaagtttggaaggtatgtcagttaactaccattgcataacaaaccacctccaaaacctagtggtttaaaacaataccactttctatctctcatgagtctgctctcggctgggctcactcatgtttctctgatcagctggccaatcagctgggaagactttgctttctccacaagtctctcacatccctccagcagctagcctggtctcgctctcaggccatggcagaggttcaggagtgagcaagcccagccgtgcatggaaacaagtggaaatgtatacacaccttt

SEQ ID NO: 119045 - DNA, 1272 bp, Homo sapiens
cattttggctctcgggagagtcacattatttccattaactgggggcatctcattataatccctaaagaatgcagtcttttactcttaacgcggttaagattggaaccattctggaggtcaggtggacagatgggcctttctctgtaggcagcagtaatttcaagcagtgtctcattggactgcctgccggctgcattgccatggggacacctagcaaatctgagttctctaccacatggcccactgagtccatgcctgaagccaggccctgtgctgcactgtgagggatccagacaggaatcagacctggcacctgcctcttgtagaagggatggaagatacaggaaaataaattgtgcagaagacacaactactgtaaccaaggcacagtgtactaggaggagatgggagaggagaagtgaattacgagaggagaaagcctagaggaggttggacttaaattgagcctttagtctcagctagtcattggaaaaacatgagaagaaagtgggttttaagcaaggaatcacctttagcgaaagcatgaaatagaaaaaggcagagattattttgggaacttagggaatgacttcatggggttgaggggagagattaagatttctaacaagtcagtttagattcatcatatatgagagactcacgtttgtgtaaaatgcagtgaccatttattgtttcctattgttcctgtcgtgttaatgatgaataccatgtgttcagcaacatctatgtgcctagcactggactaggtgctttgtcacatttatttctcacagctgaccctacaaattaggacttaatcccattttacagatgagcaaacagagagggtaagtagaactagcccagcatcttacagctggtaagtgatagaggccaggattaatgccaaagccagtgttgtttccactgcgccccagtgccttccacaagtactttggcactaagtgcagtcacactgattacacacttaatttataagaattgtgtatttgcttttaaaaacagaaaacacacgtatcatacgttttattacacatttgaattgtcggttataactacaaaaccatatacagtcattcctccacatctgtggattcaaccaattgtggatagaaaatattcaaggaaagaaaaggatggttgtgtctatactgaacaagtatagactttttgcctcgtcattattccctaaacaatacggtatagcagctatttacatagcatttacactgtattaaatataagtaatct

SEQ ID NO: 119046 - DNA, 1385 bp, Homo sapiens
cttaatagactaaagctggcttctcatatatgcttctgtattcagtcttttgcaatacattgttttggttgaagtatatgaaaaaaaatccaacctcacacaaatatgtaagtgagaaagggaggaatgtttcagtagcctttccaaataatttccattattgaatttgagcccatatcagtgaagtcttcatactcatttacactaaaatctattggtcgagccagtgctttgaatccatcatgctttggtcatttggaaaataggctcactggattttgcacatcttccaaatgttttccatttcattttacaatgccaaaagataacatttgttaatatcaccaccaatttcatcagaaaagtcttcaagtatttggaagctgtcaaactcatggtggtagatgcaagtttcagaattttaattttcacttgaaagcttgcattttatatcattgcccacaaatactgtcagttgttttccttgaagtgacaggctcattttattcattgttcatttttttgagaaaatgtctgccaatacccaagtctaaatagtaagtcattctttcagttaaaaaatggtgttccatgaaaaaaagtggcttcctcttcctttgattttatctctcttttatccaggaaaaactagaatgccctaacttaatgcttctcaggccaagacaaaaaagtcttgggcctgatctggtaagggagcagagataatggttttaatggctacagatgccagccccctaggccctagagtgcacctagagctcacttggccccttcactgctctggggatgtgcatgctacagcatggatcccttgtgagtaatctcacactctccagagattctggttatgcttagagtgaagaaaaattatcttggagcttttttgaggagatcccaaatcagtagaacccccagaacttttcttccctcatcttttgcctaaggctagacctgcatcctcagaggctctgaaatttaaactgaggtgagcaggaacaatgggctgctgcccagggctgctggattcaagaatcagttccatcagcctttgtgatgaagaaaaatggttggagttttcattcattggatgaacatttactgatctcttctttgtgtaggaatactgtgccaggtgctaaaagtacagcttgggagcagctgattgaaagtctgggttgaccgacttttcagggcataaggggtcatgaatgccagaatttgggaaatggcagcagatcacagtcaaagggaactctgaaccaagagctgttctctgccaaagcaaaaatttgaaggaaccagtggcattactgactataaatataacatctctagggcttgggattcttatcaccctctagcaa

SEQ ID NO: 119047 - DNA, 1035 bp, Homo sapiens
aagaaataaatttggggccgggcgcggtggctcacgcctgtaatcccagcactttgggaggccgagacgggaggatcacgaggtcaggagatcgagaccatcctggctaacacggtgaaaccccgtctctactaaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaagaaataaatttggtttgggcaagtctcacttagtaagtttccctgtcatttcttccagggcagaagaggaaagaaactaacgggtattgagcacctactttgtgccaggcccaggccaggtactttacataatttatttccttctgtcctcacaactctgtaaaatatggttttattcccatttcataaatgaggaaattgaggctcaaagaaattgagtaatattccaagatcatattgaaaatggcaactgggatttgaactcacaactgtgtgtctcgtccccaaaattcatgctcttcctcctccatgagtaacgtgtgctggggttagagtagcagagtggcagtttgacctgaggattcaggtaaatctgcggcttgggccctccttgtggctcattgcacccaggaggcagttcagcggatgagctagccttgtggggatattaaaacagaaagttttagggttaaggtcactaggatcagagagactcactcccaaccgagcttgtacaaccagaaaggattctccactgactagtctcgtagtgtgaaacagctgttctacctcctggaagggcctgagcccacagcctgcatggaagtttgggtaacagctccagggcactgaggtggggttgtgtcagctctcttagaattaactgcagctctgattgtcagcattagaatagtctgagattcttctcactgattgccctct

SEQ ID NO: 119048 - DNA, 2177 bp, Homo sapiens
cccgcgtagggggggaagggcgtctccccaccaagtttttctcccagcgaactccgggtggtgaccttattcaaaatggcgcaggcggcctcgggggctagtgcggcggcgcggactccgcgtgccctctgacctgttggcagcaggcggagggggggaaccgggcgccgccatattggctgttgtcctgtgaggggagcggtagcggcggcggcggcggcggcggcggcggcggcggcggcggcgtgtggagcgagggagcggcgcgagcggcggcatgacgcggaggcggagcaggccgagcggcggtgcgggcaggcgcgagcgggctcgggccgcggggccgcagaagccccaggcgcccgagcccccgccgccgccaagcctggaggcgggagcgggtgcaggccctccggaggcgccggcggagcccgaccacgacggccccagggaggatgacgaacccaacctggtgcccggcccgcaggtaggagcgagcggggagacttcggcggctcgggcgctttcaccttccccgagcgggagcgggagtggggcggggttggggatgggccatcctgccgcggctggggtagcagccttcccccgggtccggcgccgaagctttctcccccggggcgggaatggaggctggacccctctccccaaagccgaggctcggtccgcgctcctgcgactaggctgaagctgctcccctctccccgccgcctccgggcgttccggccgtacacccacactgggactgggactgggactgggctgtgatcccgaggccgcagctccgctctcggcccgccacctcccccgggcccacctgctccctcagccacaggccatctcggggctctgggactggacgactgcagcctcttccctctgcccccgggaacggctccactccgtcccctgcagcgcctgcagccgcggccccctcagcagctgtgtctcctggcgcctcctcgccatacccagcagagcagttggagcagacagccaggctgcccggaggagtttttggtggggtttctgcactgaggtggaaacccagcagaacctgcccttcttccctcccctgctccgcaaggcagcccaccccgaccttgagatcccaggtttggagaatcctgctgagagcgaacagtaggaggattccccaaagcttccagcttgccacctggaagaaggtcactttcttttgagcaaaggagataacgggaggtaccctgccaaagttcactgagaggcgggggtgacatgggccacggttgctctgggagggttgtggcactcggggctgggtggctctccctaagcttgctctgacaaaagagttttgagttggtcttttggctgagcctgcccaggaaggcaggctcctgcaggagtcttggagggtcggatgcggcgccggatgaggatgaggcgtggcggaagatgcgtttggctctgcagacactgcatcgggcagcaggggactctgggaggctggtgcagccagaaggcatggctcttgacagccttctagtagaatctctggaattgtgcatgtgagtggggttgccgtttggggtaccttcccacaaagcctcccctgacctccccagttgcgtcaggtgccctctctgtgcccacagccctctgtgcctccctctggtagcactcccctttctgtgatgaaacattgtgttgatatgtctgttgcctgccctggactgtgaactccacagggacacaggctatgccatctttctctgatcttccacgcctcgcccagggccttgctaacacagaataaaaataactaggtgaatgagagagaaaatgaatcggtccagaacccgtgcttattgtaacccagttttcatgctgatttcctttgtgtctcagatcacaataaggtttttaattaatgaaaatgtcagcacttactgagtgtcagaagctccaccttcatccgcatccccatctcctatcctaggctgacacttccgtaggagactccccaggttggacccccaacccctactgggtctagcttccaaccccaaagctgcttcccccaccagcctactctgggacccccgtgggagtgctgttatccaaaaagggagagtgggagaagggagagctggaaagctgttgtcttctcttcttcc

SEQ ID NO: 119049 - DNA, 1048 bp, Homo sapiens
gtagaagcaaatcaagactggtagatgctgtgccaaggaaagtcagggatcctaggttcgaatcctgtctctgttcgcaattcgctccgcaacctcaaacaaacgacctcagtttcatctatgaaaagctggtaaccatcgtcagttgccaggccatgaagagagtcaacggaaataagtttttattctagggcacccgctctctctcaggtaaaagccgcgccccaatcaggtactgccgcgccagggccgcgggacatctcgggatttgtggtccacccggcggaactcgcggtcccggcaggcaccgcggcggcggcagggcgacgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggtgcgggggcggggaggaaggggcgagtttggaacgtgaccgtggtcttggggcgggggatgcgagacagtcagctctctagagccgggaggagacggcctcgccgtgcccaggcggtcgcggaacccatgccacctcgcgctcctctgacctgggctcgccctgcttccctcaaggaaactaccggacgcagctgtatgacaagcagcgggaggagtaccagccggccaccccggggcttggcatgtttgtggaggtgaaggacccagaggacaaggtgagccaaccgcccccctcctctccgccagcctctcagctaggcgggctccggtacttcctcttctagttcctgcatctgctaaagtgggagagacagttgatgttgtgggaatatcctgctgacttgcagaccccgcccggtctgtgaaatgggcggattaattgtggtgataaaaatcaaagagttttgtcaactcttaaagtcatctagacttt

SEQ ID NO: 119050 - DNA, 2845 bp, Homo sapiens
tggctccgagggcaggttcactttcacttcccatacccctggtgagcaccagatctgtcttcactccaattccaccaagttctccctctttgctggaggcatgctggtaagtgggcccatgtgagacttgcaggtttcagccttcatcctttggtgaggactgggggactggtggtgctgtgggtgtgagaggattatgtcagattttgtgtctcctaagaacactgggtttccactggatgtccaggacacagtgactgagctctttgtacatgcctcactcagagcaccagcccaggcttaatacttgcttgtgtgcccagagcctcatggggctaagacactgaagagggcccagtctgttggctaaatgaacagatgaaggaaagtcggggatgagctgtcagtctctggcaggaagatggagcagggctaccagatttcccttatctcctttgtctgtcctcagagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcgggtgagtgactgggccgggagcagtgggcttctccctagaagctgcccactggctcagccaggaatttcacattaaattcattctgagacccccaagggacttacctgcactgcattgtaggtcgtggggcgggtattactaactcgaccttgtaattgaggatacagactcgtaagaggctgtcattgccctaaatcacagttacacacagaatggcacagtagcatttgataccaacaccttgggtgctgtttcagtgggtccacatgctcccaggaccagggtctcaaacttaccggtgaccaggaaccagagattaccataagtgaatctgtgaccttaaggactagtagggcagtgacccatctaaacaagcacagccactgttcagtgtcacctgggggcttccttgcagaaataccagccctggctttacagatgttccattttttcaagaggaaataggatttttatgcgaacattttaatttattttttatttttttctattgctgctgcacaaattacctgtgttttaaatgttgacaaaagactgtgcactgtgtgaggccaacaaaacatacctaaaggccagatccagcccccagcctgccagtttacagcctgtgcccaccatcttcaaggagcagtgtgggagacctaggcagagggcttagagcaagtccactcctgtgtgctccaggacagctctgcctcgtggggtgataccacaactaccttacctctctcccaggcaccagggcaggactaggtgagggctatgcctgacagatgaagaaacagacttgggagaatgagtaggttgcctgagggtaaagatagtccccaggtagagtgacactttgcaggcacttggctggaacctgggcaaagctggctgaccttgggcatcctcttggtctgggaatcagcagttctagcagccccagccaactcaggctcaccttatattcccctgcagtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaagggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtgcaagtgactcagtcatcagtgggcacacactgcagggtgcctcagggaatgccagttcttccaaagagcaaagcacttcacattccaaagtgaattcccaccagtcagcttcattctttccttcttctccaggccttcctgtggcagggaatagtgggtttgtccaagattatacaacaagtaaattgggctggggctcaaatttacaccctttcctctgtgccagctccctggtgaagttccctctttctagagtcagtaagcaggattgtcatggatgctgccaggaagtgcctggtaaggaggtgcattgagcaggggagtgctacaggacagccaccctgggctggcagggacaaggatgttgatgggctaaaccaacagcaagtg

SEQ ID NO: 119051 - DNA, 1069 bp, Homo sapiens
gtaccaccaccaccaccaccaccaccaccacagcccctagccacttcttatcagcacaggattcgactccaaacgagtaaggctcccatcgcagccctgtcccatccaccctctcctcaccttcacccgccatcgccaacctccttacttccacactcttcacacgcccccagtcttcctctcctcacccctcacgaccccgtcacccccacactccaccttctccctactccctcctcatctccacactccccctttccccttccctcaaacccactctcctttcacccccgcggctccgttcgcccccattcgctctcccactaccgcacctcacttcaccacggcccctctccctagcctgagccgagccccggcagctcaccaaccggtccttctccagcaagaagacgctggccgtcttgtcgaaggaccccgaggctaggcgacgcccgtcgcaactccaggccaccgagtgcaccttggcgctgtgcgccagaactcgcgcgtcttgctgtggccccggaacagctcctgcatcccaagcacgtagcgcgacgggccgctgctcactgagcaccacggggccatcgagccgggaccgctctggcccaacgccgagggccccatggctgcagcggggaccgccatgccgagctccccagcttccaactcacaacactgcagcagcctccacggcgcagtcagtcctggcgccgctgccgcacgcatgcgcccggaagagggacggcccctctgcgcaggcgcgctgtaccccgccccggaagggactacaaatcccggtatgcagcgcgtgcccgcgtctgcttacttagtaatatttggttcttttaactccaaatatgcttcacacttaacgattccgagtttttttagtgttcttatttctcccttacctattctttggtagatatatgtgtattcctgtttaatcgaataaaagaaccaacactaaccttctaaacagttaactcatcacctttcttctggggttgttccctaatccctagtcccctcccttaagagcagaaagctctggtctttttgc

SEQ ID NO: 119052 - DNA, 4549 bp, Homo sapiens
gacagtcaaaacagaaacatacttgtctaaaggagacaaattcattcatgatcatgctggtgaagtagtcacatgcagagatgagatcacaagagaagtcctgactgccaaaggtgaaagacggtagattctcatgaagttacctgtctccacttcagcaatgtcaataaaatgatcttccgatgctgacgccagcattttcccatcatggctgaaactgagggttcttacaggccaatccagcctatgatacagagtggacagaagagacaagagaattaccaagtaagaggagggaacaatgtcactcacgatgaaataaaattaatgtacccaacaagggaagtgctgatagagtcacttacctggaaaagcaccgaacacacactaactcatccacatcccagaggctgaccaaagcatctgcacttcctgtggcaaagtacttccccatggggtcaaacttgatacagatgcagttggaaggatgggcgttgatggactgcacaggcttcagttctgggtagctgagaaaaaagacagcgatcaaactgcagaagaggactgtggtgctaaaacaataataggagatgatgaagaagaaaagcaaagataatagaccaccaccaagaactgtcattcaagataacattcctgaaataaaaaaagattttgaactacattatttaaaaagcacaacacatacctgagactacagaaccaaagttaccaacatcgagacagagactagcaaaattagtggactttaaagaaaaagaaaattagattattgggctttctgacaacaacacttaatgccaaaagaaaatggagtaccatatttaagaaagatacacaagcgagaaaacgagccaaggatttttacatccagcaaaactgaatttcaaatataatgatacaaacaataagcacaataacgttttataaaatctgtaagttttagaattacgtaaataagttgtaataaaaactccaggaataatgttcccatgaacgcttcccgaggaatcttaactagagaatgagcttcaattaaaaaaatgactagagacttataaggactggtgctgaacactgaatatacagtttcttgcaaaaactatacatggtttaaagagagggtataatatgtaacatgtgcacatgcttacaacatatagtactatttttttaatgggggaagaatggaaagagcatatgcaaaaaccaaaaacattttttgtttcaagtcatcacattggtggtagcagcagtaatattgttgttctgagacatctatatgtttaccatgggagataggtaataagtaaccatcggatattctaattctatgatcccctgtgcccttgagaaccagaatactcaatttgggaggaaagaaatatatttgtaatatagaagaggtttagtaaaatccctggagtcctcaattttgattgcaagttatcaatgtgaattcataaggtattttatctttaaatatatacacacacacacacacacacacacacacgtaattcctaggccaacccagcagtaatgaacattcctaacttcagtatcatttctcagtaaaagaatgtaaggctccttttttttttttttttttttttgaggtggaatctcactcagtcgcccagaatgctggagtgcagtggtgcaatctaaacttactacaacctccgcctcccgggttcaagcgattctcctgcctcagtctgccaagcagctgggaatatacacgtgcgtcaccacgcccagataatttttgtattttgagtagagacagggtttctctatgattgccaggtctcaagtgatccactcgcctcggcctcccaaagtgccaaagtgctgggattacaggcgtgagccaccgcacccagccagaatgttaaggcttcttggagaatgttctgattaaaggtctggggcaagaaatgcacaagatgaacttggaacatcttatcaaaccagagagcaaaaaaacagaagacgatgggattatgtcaaaaaaggtctcaggaaccaacttgaagaggttcttattggccaaagatgggataatttgagcttcaacaggcataacaattacaagagatggaaacacaccaactatgtttaaaaacatcagcccgtaatgattctttaaaaaaaaaaacacctaactgctcatctttggaggtagcaggaaacaaaatcattatctgacaaacagaatcaaaattttatcctgccttccctacatgaactacactactgggtaaccacatcgcagatgagaagcagcatctctttacacaacagtccaacacataaacagcatatggaatcagcaaaagccaaactgggagaatctccacaggttaacagtctggtttttcaacagctacgttttcggaagtttcttttgagtaatttaagagatacaaaacacatatcaatttttttttttttttaatgagcaaaactagggtatctaggggctgcacatgtggtagataaactatgaagaaacactataaaagtcaggatagtgtttgcttttgtggaaggaagttgtaattaggacaaaacacctggatggacttctgggatggctggaaagaactacttctcaacttgggcggggttgcacaagagttaagcctataagagttcattaagctatacatttattttatgtggttttcaatatctgtgttttataataaaaagatttttcttaaaaagttatagaatccccattgcctacaaaataaaacccaagatactaagcataaaataaaggccttttataatctggtcccaaattagacttcatcttcccattatcatgccctctcttatttcccttatctgccaccactcccccaacaaccctgacctaaccactctccaagtaagtcatgctcactcacacctgctttgtcagttatgtggttcccttttgcttattcttaaaattctgctcatctttcaagatcaagctcacaagctccctccttcaaccccccatatagtatgtctgttctttccatggaatttcacagcaaactcctggcctcccactcacagaacctatctcacttggtcttgcattgttcacctgggatagtggaaggctagaattgaacagacctgaatttcagctccacagtttcattcatttacagaacaaatatttactaagatcctactacgtggagcaggtacaggactagacattagggattcaacactaaacaaggcaaacaccatccctaccatcaaggaattcacagtctaacaggagacacaggcaaataaacatgcaattacaatatagaaagaaaagtgcttcctacagaaagtatataaaatacgcctctaacctacctctaaccttggggtagcgggggagcttccctgaaggcaaagtgatatttcagttgaaactttaagagtacgaattagccagaggtcgggctaatcacctgaggttgggagttggagaccagcctgaccaacatggagaaaccctaaactacaaaaaatacaaaattagccaggtgtggtggcacatgcctctaatcccagctacttgggaggctgaggcaggagaatcgcttaaccccggaggcagaggttgcggtgagccaagatcacaccattgcactgcagcctgggcaacaagagcaaaactctgtctcgaaaaacaaaaaaaaagggagtatgaattagccataattcaaggtgcatccagttctagcacacactagctgactactgatgtaacctctcaccctcagatcctcatctgtcaaatgagaagcaaatcatcaacccctagaatttctgtaaggactcagtaaaatataaagtatataaaatatacagctcaaatgtacttaagacaggttaggattctctcttactatttgtgttttaagctccttcaggataggctcacatctaattcatctccatatctgacacagcacccagcacaaagacatgacagtcccctaagctagaccccctcacctgaggatgttgatacaaccattgccatttgtcaggaagaacatattattgtcattgttccaggagatttcgttgacctcgaacttgaactgctcttctgctttggaacggtgtgtcttggcatcaataaaggtcaccacatcatccttgttgcctacagcaatggtctgcccatcaggactccagcagatattaatgttctcccctgggaacccagacataatcagcaagataatctgtttgctcataatcctctacaagtttattgcactatcctagaaagaagaccagagctttcttccgggcttactcattaaagtcctagacaatggaagggagctaccacttacgattcaacaataagtccagaactttcatctacacatttccccatttggtcttcacaatactcctctaacatacactttattatctccatttataaaatctataagattttatagatgaaggaaataggagataagacgacaagccaaagtgt

SEQ ID NO: 119053 - DNA, 1243 bp, Homo sapiens
cagctaaggctggtccctaaaacccacacctgcctttggtctctcagaggcctggcttgccctctgggcctttgctcccccgctgggtgcccggcctggaacacaggttctgtctggctgtgtgagtggcgtctctcccttcctttgagggaagctcagctttcttacgcgctcatcgttggacgggctgccatgcattgcgtgcttactgggcgccaggtgctgtgctgggcccttgtgagtgtgggggcacaggctgaattagatgagctcctgccgcagggggccctgcacactgatgtcagctcaccagtctcttccctgacagggcagctcagggaacttctgagaagttatctgcagagagccccacctcactccctttggctaccctggccgtgcctggcagcccctcaggccccacaggtgggtcctggttgtgaagtggagttagtgcacatggatgtcaggggacgggtgtgaggcatgagctgggggggccccctttttcagggcagagaatgaggcgtgtgcactgtctgctgtggggatggtgtgtttatggccatgtaagtggcaggtgtgtgtaaagatgtgcttgtgggtggtgggtgtgtctgagggggtgtgtttgggagcctggcctccaaaagccagtgtctgggttggagacagtgcaggccccttcttggccccaccctctaccccattccttcctgtcagccccagtctgtcttggcactggccaggcttgggtggagcctgtgtcccagacagatcccctaggcctatctgagacccatacaggcccacacctgagctcctgtctgcctgaggagggaaagggggagtggccaggtcaggcaggccagtcgtctacacacccccttggtacccattcccatttcacaaactcctccaaaccccaaaccccaaacggaaatctctgggacaatggctcctccagagggcccctcagagccaggtgctggccagatgccttgatcacagcctccatggccaggggcctgtcaagccaggggcccacacacctggtgccagggtccaccttggtataccagctcggcagaacagttccccacccagcgattagggagctgggctggccagtacagccagtggggagtgggtgggaggcaccaaaacttggcagctgtgccagaaaccaaagccaggcccagatgtagggggagggcacgagagctgaacctgagcctggggc

SEQ ID NO: 119054 - DNA, 1015 bp, Homo sapiens
caaacgtccagtcctcgtgcgaccgcgctgggtcggaagtgagcaggtgcgcaccgggctcggcagggctatggagcagggtctttggaaggatgactaggagtttgcctgtcgtttgcatgttaatgcgggtgaaactcccagtaggcgctgctgtccagggaaaatgatgggctttttcctccctccagttttggttaatgagaaaagaaagattagaaacttcaagtaggactgtatagtaaaaaaaaaaaaaaaatggaggagggcgatatgacacggtaactggtgtgagggtggggcggaggggtcagtattagatactgtggtctagcagagcatctctgaggacgggacatttgcgttgagacccaaattaggaggcaggcttaggaagatacgggaagagagtggtccaggcagcgggaacagccagtgtgaaggccctagggcagaaatcaactgagagtatagtcaaggaacagaaagcaagctagtgtggctaaagtatggtaagaaagggaaagagtggtaggagatgaggtcggataattggggtttggtcacatagagtctgtaggtcagagagaggaatgtggagttttttctaagtacagtggaaatcttttggttttaagcagaggagtgacatgtagggtagagagtggatggaggtcgcggctgcaaaagcataagaattggctgggcacggtggttcacgcccgtaattccagcactttgggaggctgagactggcagacggcttgagctcagcacttcaagaccaacctggccaacatggtgaaaccctgtcgctccaaaaaattaggctgggcgcagtggctcacgcttgtaaccccagcactttgggaggccaaggcgggaggatcacttgaggccaggagttcaagaccagcctggccaacatggtgaaaccccgtctctactaaaaatacaaaatttagccgggtgtggtggcaggtgtctgtaattccagctacttgggaggctgagg

SEQ ID NO: 119055 - DNA, 1052 bp, Homo sapiens
gctagtctcaaactcctgagctcagcagtctgcctgccttgacctcccaaaatgctgagattacaggtgtgagccactgctcccagcctatatgcatatacttttaatttacataaatggattctgcctagacctcatttttttccacctcagtgccatgtgtggagcttgtcgatgttgctctgggtatatttgggatgcagtttctaaatgctccacaggtttccatagatgcatcccccacattttacttacttgattcctctagtgatgaggtccctagattgtttcccactccttgctacaatgcaatcccgtacccatctccttcctcagctttgtaaatagaattttatcgcttctcagccttttcgctgagatcaagtgtagtaaatacaatttcaagatgctgatttgagcttggctttgataagcctggtagctcttggtgtctgacagggccggattgtttgaccttcgtgaggtcctggcttttttgagccatgtttatttttgataaattgtgattctagttcccagacactcttggccaacattctagtgtcctgccatcttccccagttgatcattctcacgagctctgtggttaattttctgtttctcatcatcattaatggttgctgtacactcattccaacacagatatttgctctttcctttcctggtgaaacagtggcctgtgaagctggtcctgggagtacctgtgatgtgaagtacgtagagaaggactctgaggccagagccagactgtctggcttcagttcagttcccagctcctccacttcccagacgcctgaccttgggcaactgatttaatctttgtgtctcattttctcatctgcaaagtgggtctaatcattgtacctacctcatagtgttttcgtgagcattaggtaaatgaattaatgtatgcaaagtcattagaacggtgcctggcacataacaggctcctatttggaatgtcagctgttaataatagcaataataataattacgtcatttcagataggagaccctgttatattttgcca

SEQ ID NO: 119056 - DNA, 1099 bp, Homo sapiens
agaacaggtgggacgggcatggcatgctctaaatgagtgtggtgtggcgcatagcaggcacgaggaccctgggtggtctgcgctgaagctataaactaaaggtatggcagatgtgagagaggaggagtctagagttcatcctggacacgaggggtcagagaagtttctagttggggagaggcatctgtgtaacagacagccccacatgggtgcagggactggcagcctgatgtaacctaccacatccagacatgtgtcaggccaggcagcacaaccccagctgcctgggcactcaccccgctggtgcagccgagcaaagggctggaagtgccgagcatagctgagggcctccagctgcttcgcggggcctcctgccaagaggcggatgaagtgcagtcggtgcagcttgaactccagggagctgttgagttccagcaggcgctgcctgtgggagacggcccatctgggaagaaaggggccagtttagtgtagagctggtgggggctaggacctgagagccagcacctgagaggagggccccaaaagcctgtgtgaggctcttgagacagggctgcaggcaagtcaagtacatctgggtgaaatgaagaccacagtcaagccctgtgccctgagaggtcgaagcagaatgctgctggcccacccaagggcctccttactccaacgcaggacccaggtcttgttcgtgcagggcttccaggattcgattcaactctaggaaaggctgcttgaaatccaagtccacattcagcgttgattcctacaaggagagagagaagagatcccaccactggaagatggtgtttccaaagttctctgctatgcacataataaaagctcacccgccaaagacaggccagagagctgggctttgcttgaggagcttggtctcctgccagccacttgggcctctcttgttcccatctcagtcctggggaggctgagtatgacatgctgacctcgagtgcagactgcagaccccaccccacaaccgtagcagtggagacagtccccaggctacgcactgagttgcatggcgagaaaattactcctcttcaatcctcctagtacagtagggaaa

SEQ ID NO: 119057 - DNA, 1051 bp, Homo sapiens
tagagacggggtttcaccatgttggccaggctggcctcaaactcctggcctcatgtgatgcacccaccttggcctcccaaagtgctgggattataggcatgagccaccacgcccggccccaaaacatgactgaagttttagctagatactgctgcctgttgaaagctcttaacctggggttgctctaaatggagattagtgtggagacaccagtgccaacctgaggacttatttgatccttgatgcagtgggggaggaaagagaactggaaaagaactgtcctcattcctgattctgtgttagtaatgcctgttctcatcctgcagaagcagcctggacctccacctccccagtggattttacagtcaaatttgcctgagggcattttcatccctgctcagtctcctcaggggcttgggagccaccgggctcagcatattgtgctgtgctgcacagtcctgctgcccgcttgggggtggacccagagccctgcaccccctgagctgccccctctggttgccttgtagagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcaggtacaacccagccctgtgagggcagcacaggtgggagggtagagaggtaatcatcatttgccaaggccctgccatgtgccaggaacagtgctcggtgctttcagagaccgaaactggctttcttagtcattcttcaggagaggaattacctgtttttacagttaaactgagactaggaagagttatggcccgaggtcaccatgaggtcagtggcatggtcaaggttcccattttgtaaggtctcctgaatgaggtccctgcctctcttgcacctcaccctggatcattgcaagaccttcccagctaacccacgcccctctgcagcccgccttcctcatgacctaatgtcttaaacacc

SEQ ID NO: 119058 - DNA, 1044 bp, Homo sapiens
tactaagtcaaacgcaaacagaaacaggaaaagacagcaggagcacagaggccagcatctccctttccttatgccatggagccaggtgccaggcgtgggctggtccatctccctcctcagcctctgccaaagggctgctccagtgctcccctcagtggaactcctcagccaggcgctctgaaaccaaccacagtccactgaagttgaccaccctaccgagacagaccaaggctcacaggtgaaaacccctttcaacaaaattccttccaggtaggaatcagaatatgatgcgtttcccatctgccgggttctgctccatgggacagtagggacacttcagcctgcaaagggaggagaaccgagaacgtctcaggggtggccagtaggagagccaagccaaggtggagtagagcacggggaacttactttcctccattaatgagcttattgagtgcatctcgggagataacatggccacagatgagcttgatgggagggttggaatctgacgtctgctggcggaggatggggcaagcgaacacggagtggtaccagcacttcatgcctagttcaatctcaatctgggaagggcagcgaagcgggtgagttccacttcctgtcatggctgtcctccccagtacctcttgcccacgattccccagaccaggcctcaccggtaactcgtccttgtgattccagaccccagtgcactgccgctgctcaatcacagccttgatgttcatcaacacaggcagcgccacacagccagaggcaaagctgcagacaaggaacaggggctagagtggctcagatcacagcagacaggcaaaaagggccagcgcgccatgcttcagcatggaccttgagacagggctctaaaatggtgcacggtcaaatcggtcctcaaagatccctcacattgttcataagatgtcacatatgtacttatgtatgtctgactctacagactcattctaatgcaccccaaaatttgagaacctacagggaagacttcctatagctctaggggcagatatctgctca

SEQ ID NO: 119059 - DNA, 1752 bp, Homo sapiens
agatttttctgacaattgaagaaaggattagagaggtacgagtaggtttgggaaagttcaggtagtagactactgtagtcctggagaggtgatggtggagacagagttaaaggggacagatttgaaaggactttcagatgtggagaatggggaggtattgacgacttctaggttctgacatgcccagctggagggacagagggcccaatcttgagatgtgaacagtggagggggaccagatttgtgtagaaagatcacaaatttgggtctgggtaagtttttgaggtgctgtagagacacatgacttccaccccgccccacaccaggagaactgtcaaacaggcagatggctataggggtttggagcatggaagagagagggccaggctggagatagtacatctgggagttttcagcacatagatggcacctgaccccatggcagtggctccggtcagccaggaagaaggtcctgagaggagagggcagccgaggacaaggctgtgaggaacactcacagtgaaaggcgcttaacagaaggggagccagcagagggcccagaggagcactaggagtgcggaagcattctttcagccgagggctctgtccttgtgtgtccgcctgttatccagcatgggagagcagacttttccttctgtgtcttaggctcctgaggcccttgccccccagccttgacacctggccagctaggaaccctggctgagtctctggcaagctttcattgcctcactgtcactcttgggacagagcccatgcttcttagcctggtactcaaggtcttgggggtgtcccctgccagtctctcggctgtgtctggtgccgttctgattctcacaccacatgctctcccccgccccagcccctccgtgggctgcctgccacacagtcatccatcagcgtgctgttcaagtgtcacctcctggttgaacccttttttgactctccaaagagagctgagctcatacaccttggcacccatcctgtacttcacctgtccgagcactacatcactttggtggcacctgtatgttgccaagaggtagagatcacccccaaatagtgtgctcaccaaacacaattttgtctctatccctaagacccagcccagggcagcacttaaaactgaaagaaggaaggagcaagccagagatgacagtgttttctctcatttcaggatcatggttttggcaggagacacactgcccattgaggtatactgccatctcccagtcatgtgtgaggaccgaaatttgccctatgtctatatcccctctaagacggtaaggagcacgtggccccctgaccttgctcagcactggggtgtctgggatagtctgccatagcaggagagtgtgggaaagagccaggagtgttggagctaagacaggcctggatggattctcagctccacatcttcttagttttgggactacagatatgttacttcttgcatttcagttcccatcttgtaaagtgggaatcccagcccaggcgctgtggctcacacctgtaatcctagtgctttgggaggccaagacaggaggatcagttgaggacaggagttcaggaataacctgcgcaacaaagtgagactccatctctacaaaaaaaatttttttaattagctgggtgtggtggcacatgcctgtagtcccagccacttgggaggctaaagcaggagatcacttgaacccaggagttcaaggctgcagtgagccatgatcatacacc

SEQ ID NO: 119060 - DNA, 1150 bp, Homo sapiens
tctctagtaaaaatacaaaattatctgggcgtggtggcgcatgcctgcaatcccagctactcgggaggctgaagtaggagaatcgcttgaacccgggaggcggaggttgcagtgagtcgagattgcgccactgtaccccagcctgggcaataagagcgaaactctgcctcaaaaaagaaaaaaaacgaggcagcctttccagcacccagagccccgccctctccggccccgattcccagggctccgccccttgcctcacattccctccgctccgccctaatcggttccgcccagtcccttggtccggggatggccccgccttaaggaccatgactccgcccctctccgctctccgtagttacgaagctgggcgtcaacgattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggcccgaggctcaggcggaggcgtgttccggggagcgcacctaccaggagctgctggtcaaccagaaccccatcgcgcagcccctggcttctcgccgcctcacgcggaagctctacaaatgcatcaagaaaggtgaggcggacggcggcgtggccgggatgggtgcgcgggtgggatgggtgcgcgggtggctgagcgaggcccccgaccgactcttctgtcgttgcagcggtgaagcagaagcagattcggcgcggggtgaaagaggttcagaaatttgtcaacaaaggagaaaaagggtaagaaccttccttcctctggattttgcatttctaaacgttaacggagaaatctctacttagtaggcgcgcagtaaaaaggttaactctgacctagccccatatacagaagccaatcaagcagtcggtaaagtccctttggtacaataccggtacgacaataccggtacaccacgtataccagctcaaagtgaattccaaagtgaagcgaattgtgtaagcaaagtcccttagagtaaacccaccttcattaattcagggaccctcctccccgggctccgctccttgcctcagattacct

SEQ ID NO: 119061 - DNA, 1012 bp, Homo sapiens
cattaaattaaagctggcctgaaagttttcaaagtgctactgtttccaactgatgagatcttcagttttctggattttctgggtgacgattattttcaattcctttttctggtgatatatacaagaagttacagcagatatataaagggaaggtcagaaacctgctgtccaagttcatcaccacttgttcctgatcctttttaagtataagtatttgatagccagttgttctactacatactagttttccactactatcaaaagaagccaagcgtaatctaaatgctatgctccttcgaggccgtaaactgacagacccgctgcgtggctgattcagtgtattgcgtttgaaaatgatgtatccattggtgtaaattacaagtaggtcaaagccgaagttaaaacccgtccaacaccagtagtattcaccatctttggcaagctttctaccacacctcatgctatttccctctaggtcttctttattgatttcttgaggccctacctcacggtcttgttctgcccgcagcatagcaaaccactgctgtttatacacagaagacagccattctgaaggtactataccatcttgttcaataattcttgcagaagctaggtcactgataatatattgtaaccttaaatgtctgaatactgacacaaatggttttcctggttcagtttcaagaaaggccataccttcaaaatcttttctctgtttagaaaaccagacatctgtttctgtcaaaagctgttttaaagatccattccaagaaggcacaagttgaaggaacatccacttttttagagtggtgtatacatccatctccacttgcatcacaaataagttagaggaaccaatgagctgtttcatgacatttataccgagttctttaaaaagtttaacattctggtgagtcatcaaattgtttagaagccattcaaggcactttttctttacagaatctaatccatagatctctactgatgtgtaataaccgcatacagtttt

SEQ ID NO: 119062 - DNA, 1050 bp, Homo sapiens
cggaggttggaggcggcagtgtccgctgcaacggttggggctgcgcgtgagaaggtggcggtgtaggcacctgtgctcggggaaggctggcggcggcggccgggccatggccagagaccccctcctctgggctccctgaagtcctggggagccgtgacccatgggatcgtcgagcagccgggtgctgggccagccgaggcgagcccttgcccagcaggaacagggtgccagggccaggggctcggcccggaggccggacactggagacgatgcggcgagctacggcttctgttactgcccgggcagtcacaagcgcaagcggagcagcggggcctgccgctactgtgacccggactcgcacagggaggagcatgaggaggagggggacaagcagcagccgctcctcaacacccctgcaaggaaaaaattaaggagtacatccaaatatatttatcaaacattatttttgaatggtgaaaacagtgacattaagatttgtgctctaggagaagaatggcgattacacaaaatatatttatgtcaatctggctacttttctagtatgttcagtggttcttggaaagaatccagcatgaatattattgaactggagattcctgaccagaacattgatgtagacgcactgcaggttgcgtttggttcactgtatcgagatgatgtcttgataaaacccagtcgagttgttgccattttggcagcagcttgtatgctgcagctggatggtttaatacagcagtgtggtgagacaatgaaggaaacaattaatgtgaaaactgtatgcggttattacacatcagtagagatctatggattagattctgtaaagaaaaagtgccttgaatggcttctaaacaatttgatgactcaccagaatgttaaactttttaaagaactcggtataaatgtcatgaaacagctcattggttcctctaacttatttgtgatgcaagtggagatggatgtatacaccactctaaaaaagtggatgttccttcaacttgtgccttcttggaatggatctttaaaaca

SEQ ID NO: 119063 - DNA, 3548 bp, Homo sapiens
ctcgcccaacctcggaagcccgggttctgccacttccagccacgcgtccttgggctgcgaaactttctccagcccagtttcctcttttgggacatggggaggcggaggctgccaatgctgggatggagtcctcgagagcaagagaccagcggcctcgacgagcttacaatccgattaggccctcccaccgatgtgctgtagctgcccgccgccctggacccggcgccgtcccgcccggcttcgggagccctccgtagcggccggactcgcgcgcgttctaaaatgaggacaaagcccgcccaggtctagagcgcgcgcgccgtggcggccaatgggacgctgaagctaggttgagtgacggacttgagcagccaatgagtgtgcagtttgttgcgatgtggcacccggctccggcattataaagggcgccacgagtcggcattgtcaggcggcggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggtgagcggcggccggcgggcgggagctctggcgggagccgcgccggcctgacgcgctgtcgccgctggttgcaggagccgccgcgcctcggcctagcatgtcggaagcgggcgaggagcagcccatggagacgacgggcgccaccgagaacggacatgaggccgtccccgaaggcgagtcgccggccggggctggcacgggcgccgcggcgggggctggaggcgcgaccgcggcgcccccgagcgggaatcagaacggcgccgagggcgaccagatcaacgccagcaagaacgaggaggacgcggggtaggtgcggccgcgggcggacgggggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccggaagagggaaagcgctcggacccggggcccggcggcgtcttgggccgcgccggcggctgcgtgggcggagttggcgcgagccggggcccggacctccctcctccgcctctcccgggggcggagtcacggtctgaaccctgggcgggcttggtccccggaaacatcgagttccttgaaacgagttctcaggagttggtggagacgctggccctttgctacatggttgtagaacacatgaatttccagttatgagtggttaggtcccatacccctggtgaggtggtcccttctttgcttctcacaggctggggctgcagagccttgttaagcctcgttagggtcctggttgagttcaatttggagggtagtggagatttaacatctttctaaggtgctccttgcagactctaagggtagctgtagacttcgtgagaactttgccagggccagtcctttccaaaatcacagcttgcttacaagacttgttgccgtgtgtctcaccctaccatttcagaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtaagctgggtactggatttcagcagtctcagtggaaacgatttgaattctaagaggacacctttcttaaagcatgactagtttgtgtggtctgcatgtgatttaagtgctttgggcaaaacccaaagccggaggttatgttccggtttttgaggggatgaaaatacagattaagctgggagtgagagaatgtgctggagtggttcgggaagatgacagttgacattcattaccttttatgtgcctattctgggtacggcgctaaacatctgggaggattacaagagagtccatgattggtatgataggcttttagccccattttacaggacaaaaaccaaaaccctaaggctcagaaatgtaagtagaagaggtcacagctagtagggagtggagggaggattccttcccctgtggcccatcttcagcctatgctccgagtccctgctgcttcgcttctggagatgggcctcacgctgggactgcttgggcaggaagagcatgatcaaaggcttaagtgtgaggactgttttctaggtgtcgaggtaaaccagctgtacttgaggtttgatgaaaattgggttgggaggttaagctggggtagaatttggagggggtgaaacacatgtttgtatctgtactggtgtctttatggcttagagagaagggccttgtctggctcgtgctgctgagtcagcctgacccctttctgttggaacaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggaggtgagtgtggctctgggaatagcccatcagctgcccctaaggctgccttctttctggtccttggtatccttggctggctagaccctcccaggcagggcttatttttcaccctctgtcttcaatggggtcttttctcctgtgagtcccctatatgctctggggtagggaggtattgggcctgagtttgcctatgctttttgcagattgaggccattgaattgccaatggatccaaagttgaacaaaagacgaggttttgtgtttatcacctttaaagaagaagaacccgtgaagaaggttctggagaaaaagttccatactgtcagtggaagcaaggtaaggtgttcccagctctgcttggcctcctgtgctgctggagagctggcccttagagggatgggttaggggttgggcctcatgcaggagctctccaggttggtcagactttactatttctctgaagcgtatgctgccctgattggggcagtgttccaatccttgaaagacttctcaggctgggaggactgccaataaacaacacaggatgtgagggaggtaggagaaggtggcctctgtgaatagagcaggttgagtagcctctttagctcctcacttaaagctagaggtgacagttctagattcttgagtccaggggtatgaagcctgcagtttaaggtctcagaagatcctagaacttctgcaactcactgattctcctctgtggtgaagtttttcttattccaga

SEQ ID NO: 119064 - DNA, 1155 bp, Homo sapiens
taaggcccctcatctgagaagtcttgtctgaccctctagcccagcaggaccaaggtgtggtgcctggtcccagcctgtcctctgctcccctgggctgcagttggcccagttgcctgcctccattagatacggagttgctctggggctgagatgcccatctcaagtgcattctgtcggaagggttctctgctggaaggcctttggttttagttgggattccatgagctttagcccaaaggtggcctcccatactagcatattttgtttctcagcaaatggacctgatccaccatttgatgtttgtcgcagtgaaggtgtttgggcagtcactgccctgagtttgtcctactggcctgaccactgtcctcttgacttttagtgtgagatcaaggtggcccagcccaaagaagtctatcagcagcagcagtatggctctgggggccgtggaaaccgcaaccgagggaaccgaggcagcggaggtggtggtggaggtggaggtgagtggaacgtggatgaagataggtcctgtttccctgcctacatggagccttccaagcctgtcttggggctccctctggtgctgtgcagcaggggtgggcagattgtgtgaggttggggacgaacaggaataggaacggctctgggtcagggctgtatgcttgaggctgttgcctgctgctgccccttggaatggcttgggtgcccagggcagagagagcatttgtgttacactctgggggaggggatgtgatgggtgtcttggctttgtggatgtcctgagtctggtacacctgtgagcaggtaggcagaagggtgggtagggcagagctgtgccaggcatttatccccttccatcccaggcccctctgactccaaagcctgaactgcatctttttaaaggctaagctgccaaggagagtgggagtgatcagagagtgactgagtgagtgagctgccttgtttgccccaagtaaagttagcatcctggtctctgatcctctgcttgggtctctcagatgcagggttgggcccagggcccttatacaccagaacagcagccccttggcttctgcctgagttgccacagtaaccctgccaccccaaagggcaggatttcctccatcctagctcctgcgtatgctaaatggtccacgg

SEQ ID NO: 119065 - DNA, 1575 bp, Homo sapiens
ggtcagagtcagagttggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttaataacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggatatgctgtgtgagacctcttgctcagggtcgagggaggcggggggggggtgccaggtgccctggacttggggctttctcctgcagcaggctcttccagctgcaggcccagttgtgggggtatcctttaaggactgccctgcctagggctgagccccccttcaaagaaaggaatgagaggcctatggggagtgaggatggggcagtgatgagggcttacatccccagcaggcatgtcccctcctgggacaccttggaacaccaaccttcttggctgatgaatgaaaaaatgggattctttacacactagggcagtgccagggccgtctgaattggggcacaatagtgctcctcctggctggtgaagaaaagcctgctctggcaggggatgtttattggctggattggagcccaactccaggtctggtatttagggcataagactaggtggttacaagaggcaagggtgggttggggttccacgtggatacagccccataggtttcaagggaggatatagctgttc

SEQ ID NO: 119066 - DNA, 1440 bp, Homo sapiens
atctgcagcctttgtagtcaggcactgggtacagaactgctaacaccacttatctctgtcctcagctgataggatcagctgtcccccaacaactgcccccacccgccagccccagccctctttcaatcaagtctgtggcccagagtgctgggggtacagatgaggctcctttccactggccctgcaaagaggtacctgtggtgtctcctactccaggaagcaacttgtttcaagaagaaaataccttgataccaagtaggcagcctcttcagttgctggtgtccttgtggcctcatctttgatcagatccacaccaatgaagagcccaacacccctgcaagggaaggtgacgacatctcaggaggccaggcctgaggggccagggtgctggcctcagcctctgggctcctacctgtgcctcctgagggggctgagtgcaggaggcaccttcagaaggtggtgagaatagtttcagggaataactgggctgggagagatctttggtgtggacagaggagagaggctcaggggtagctagggatcaggtcatgtcctagctttctcctccccaggagagccgttttgggcaatagcacctctcagtgtctcagttcctcttgagagcggacataaccccaccatcccaggttgttaggaggtgaagaaaatggtaccacactgggccttggcaggtgggtggtgactgctgcccccagagcctcacctgacatccccgacgatgggatgtttgattttttgctgcccgaggagctgcatcaggaagctgcctacactggtggcatgatcctggagctgctccttctccaagacattcaggacggccagccccacagcgcaggacactgggctgcccccaaactgagccagggacaaagaacatgtcagatgccctggcagagtgggccatgccccagagtgagggtgaggcagaagaactgccacacgtgttccaaggccagtggcaagagcagaggccccaaaccccttagggcgcacagtcctcagcagtagtaagtggggttcaacatgggctgtcctggctttccaggagctaatgtgactgcaactcaggtcaggtatccctgaagtacagtaggagcccctagaagatacagaatcagaggagagggtgtcctgtttgttcccacagggctagtctttaccaagagaggctttaaggccccatctcctgggcccagacccagaggactggattaggcacttcctcctccagggagagtgagcgcagcacgccaagccccacccaggaaaagctgcttcacacccctggagggctctggctcctttccctcgcccaccctgtcctcatcctgcaggtatctgagtggagacctgtgttttagaggatcacgagcaaggtgtctcctgcaaaccacgttttttgtttcgtttttaaac

SEQ ID NO: 119067 - DNA, 1164 bp, Homo sapiens
agcagttaaatatcttcccacaaaacacaaggcccagatggctttataggtgagtttttaccttcaaaggacagatcatcccaattttatgtaaaagaaaaagaagaaatatttcccaatttattctataaggttagtaggacccagttaccaaaacccaaggtataagaaaaaaatttgagccaacattttactcctgaaaacagagcaagactccgtctcaaaaaacaaaaaaaagtaaaggaaaacactgtagtatgacatgcacaaaggatgtaattggattcctgattcacatcgtgtacaaaaataaactccagatggattaaggacctatatgtcaaaacaaaatgttaaaagacttaagaggaaacataaatgaatatattttataacttggagtagggagagatatcttaaacaatatatgaaaaacaccgtctataaaacaaaatgataagagttgacaatgttaaaatttaaaactttataaatatgtaaagggagtgaagacaggttataaactggatgaacatattcacaaatacacaatagacaagggattagcataatagatatgtatgtgttggtatatacacacacacacagacacacacacatacaaacagacacaaaactcccacaaataaaattaagcactggtaactcaataaaaaaaaaatgggcaaaagacacaaaagacacaaataggcatttttttttttttttctttgagatggagtctctgtcgcccaggctggagtgcagtggcgcaatctcggctcactgcaagctccgcctcccgggttcacgccattctcctgcctcagcctcccgagtagctgggactacaggtgcccgccaccacgcccggctaattttttctatttttcagtagagatggggtttcaccgtgttagccaggatggtctcgatctcctgacctcgtgatctgcccacctcggcttcccaaagtgctgggattacaggcgtgagccaccgcacccgaccacaaatgggcatttcattgaagagcaaacaaatggtcaataaacatatgaagagatacttcacgtaatctgaaatcagggaatggcatatcaagaccatacaagctactgttttacgctccacttgactggcaaaaattaaaaggcactgaag

SEQ ID NO: 119068 - DNA, 1665 bp, Homo sapiens
aagaatgccggatgcagtggctcatgcctgtaatcccagtgctttgggaggctgaggcgggcggattacctgaggtcaggagttcaagagcagcctgaccaacatggagaaaccccatctctactaaaaatacaaaattacccaggtgtggcgcatgcctgtaatcccagctactggggaggttgaggcaggagagttgcttgaacccaggaggcagaggttgcagtgagccgagatcgcgccacagcactccagcctgggcaacaagagtgaaactcttgtctcaaaaaaacaaaaacaaaaaaggatatacactatatacactactggtggggtgttaacttgtgaactactttagaaaacaaatgtcattatcttttaaaatgaagggtaaacacataccatatgggccagcaattccaccctcaggtacagtcctaagaaaaactcttgctacatgtacaacagagacttatgaaaactattcaaagcagcactgttcataattgcaaaaaaaaaaaaaaaacaaaaaaaacatggaacgacctcaaagcacagcaatagtaatggatgactgaactgtggtacatttatacaaagattataaagcagtcaaagcaaatgaacttcagtgacaggcaatagggaggattcttagtgatatgttagtagaaaaaaaaatccccagagtatatacagcatgatagacttcatataaactcaaataacaactaaataatatgggattgagagtgatggttaccatggttattcagagtgatgggtggagaaggcaacaagagggaattggggggaacatctggagagatacatgatattatcaaggtctaagctttcattagggatgctggcttcccaggtgcttagaacattaataaaggttaactgaataactagaagagggctatgcacagacagatgttgagagtcttccatgaaccaaggattctatctaattatgtacacttgagggtcaagtaaaacaaagaaataaacaaaagtcaggatgctgctccactgggcctttgttgttccccttacacaacccacttgatttcctgctcagccttccagactgagatctggtcttgccttctctatgaagcctctactgcttgtcccacagctcttcacccacctcttgcctgggatgtcctttgtgctctcacagcaccgtgaacacactacttccactcatcctccacgctgtcatgaccatgtgtctgtgagcctgtctttccccgacagtgagctcctctgaggctctatgtgtcacatggacagagtgatggtttttggctgaatgcaccaaagtgtcacttccctcacccctaaggacattatcttgccttatctatcttgccaaatcctgacatgttttagtccccaattcaaactggctctttttgaggaacttacagtgaattctcaaccctctgtccctgcccttcctcctctgggcctcctcctctcctccctggatcagtctgccttcctccagttctttctccacactgagcaccagagatctttccaaagagtactctctccaggattaaaaccctcctgtggtcctcactcttcaagatcagtgagactcctcggctctttcctgtggggctcgtgctgccatcctctcaccta

SEQ ID NO: 119069 - DNA, 1828 bp, Homo sapiens
gctcaagttccagcacctgacacagggcgtggcacagaatgggtggcatctgctgaaaggaagacagggactcctatttttgtatatattttataagacatggtcccttgtgacagcttttggattgacactaattttaaaagatgttttatgttttcttacctgacctggctataatctccttaaggacagcgtcttggaagcgtgtgctgggcacagtgctagccctgtagcctttgctgactaaggacaggctgatcaccgggggcctatcagaacccatgttgctcccttgacttagagccatcactcaccgtgttgaagtactcaacgccggtggcttcaaatgccctcgccacaggctgggttgcggccacgcaggcaacagggtggccgttgccaatggacttgcccatggtgacgatgtcagggacgaagtcttttccctggagctggaaggcccagaagtgcttgcctacccggccaaagccaacctggatctcatctgcaacaaagacccctccggccttgcggatgtgcctgtggcagaggagatgactgacacgggggctgtggttgagagggataagatcaggacccaggaggtctcggggctttgcaccctggctctgccagcagtaaggtggggaccttgggcaatggctggccttctctgggccattctttctttaagggctttgtctcaaaattctggcagtcaggacaggctgaggttgggatttggaccagaggttggaaaacctcattagacccctgccctccctagagcagaccccgcccacctactcactctgccacttgggagaagtagccagcagggggaatgatctgccctcccacactgggcagagactcagcgaagaaggctgcaatctgtgaagagatggacattgggaacacgaccatggggttgtgcagtgaccggcttagcgtgccctgctagtgctggcttagtccaagcaagacaagtcaccatcagtgctgcacccctactttgggttccatgttacatctgaaggtttgtgactcagttttctctcaggcctccagccaactcttactacctggatgcctccaggcccctagtacttggcatgccccaaactacatgcactgatttttccaccataagccagttccttccctgtcccccatttttgatccacgcctcctccctcaacccatcagtcagcactgcccaaggattctacctcagccccctctctaaacctactccttgccctctgcctggacatgcctgcctcctgcagatttgcctgtttcttccttggactcctgcagaggtcttctaactgaatgccttttccagtccatcctccacatggccaccagggtgatgatgcctcaacccagagaactgagcatgtcactgttgtttaaaacccctcagtgaccccttctgcatatggcaatgatttcccaaccatattctgccttacaggtgggagggcagggccaatgggatgggatactggtcccccacacctgttgcaatcagagcaatctccttttttaggttttatagaagtggtcgcagagcacctgaaacacacaggcaaggctcccctggtcgggttctgctaacctttctggccccacaggctgcctttctttgtcgtacctcctgtgtctggctctgtcactccttcagtgaagccttcagagagccctcacctgtcgccaacagtcttccctctgttgtcaccgtaggtaacacacctctctctcctatgtctgcgcctccactccatctccaccatactgcccccgtcaggcctccccacag

SEQ ID NO: 119070 - DNA, 1651 bp, Homo sapiens
cattcacacggttcctcagccacccagtgggatgcccttcctctgctactccccaccccacctggagtggctgacccctactgtgtcagagagcaccccctccaaggaccccgcttggtacctcccaaggcctgctcaggctctggctggctaccacgcccatgctaggccgtgcactcagactctctgctgagcccaaactgcccctatcccagattcctggagggcagggcctcgtttggttttctctctgggttcccagcatctagcacagtggcggtgacaacggaggtgacattcactgttggctggattggacaggcgcggacacggttaccttcctgcccttctcctgtgcactgctgaccacacgtttcacctcgttggcataggccatagctgggttggggtggtcctcccggtaggggccccggtaggtgtctgggagaggtgcctgtggggagtgacagcgccatgttatccgggcttggggacaggcaccgacctgttgttgagttgggcagtgcataccacgtggacccactccttctggccatccaggttgcggaacttgtagggactgatgtcaatcagggagctcaggtggccgtgatacgcactggggaggagaagggagggtaggctcgggtccgggcagcacctactccctggcccagtctgaccatcgtctccccacccctgaagacacacaagggaggccaactttcctgacagagcccccaagttcttgggctgggaaagagcacaagctttggagtcagcaacaattcttgcaagactgctgactggctatgtgacagcagctcatcatttaatctctctcggttgttttctctgctgtgaaatgaggtgggatttcctccttctggtttataatgaatcttaaatgtgttgatattgtcagcctcggctttgtgcacatcacatactcaattcatgggagctactgctggagtagtttgaacatgtacaatgttgtgggaccacctttgagtctcttacaaagcgcactctgctccccagagctgccttcccagaatggtggcccagggtgacagagcctctgggaggtctcaggcctggtcctctgcctgccacacttgtcttcagtagcccaggccccttatcctccctgcctaaggcacccagagtcagtctcacggatcaccaagaagcctgtgggccaggcttctgggaacggtagggctgtgagttgcacttactgatctaataccaccacgtcctggtgtcccgtgtagtggcgagccagcctcagggccaggtcattggcttctgacctatgaccgaaaaggtgggcatgactgagagagtagtctaagagcttcccagagagaaatgctgagggcaggaggacccttccagcagcaagaagattctcaggacatcaactagtcagtcacttgcttgtttgtttggtatatatcaaatgcctcctatgtactagaagctgggggaaaaagagtaggtaaaacagacatggccttggcccttctggaatttacattctcgtatgtgtcatgaaagttgttttgaaaaaacccaaaccattgtttttcctctgctttcacactacaacaatcaacacagaagacttctgtgactccaaaaa

SEQ ID NO: 119071 - DNA, 1047 bp, Homo sapiens
gtcatgcccaccttttcggtcataggtcagaagccaatgacctggccctgaggctggctcgccactacacgggacaccaggacgtggtggtattagatcagtaagtgcaactcacagccctaccgttcccagaagcctggcccacaggcttcttggtgatccgtgagactgactctgggtgccttaggcagggaggataaggggcctgggctactgaagacaagtgtggcaggcagaggaccaggcctgagacctcccagaggctctgtcaccctgggccaccattctgggaaggcagctctggggagcagagtgcgctttgtaagagactcaaaggtggtcccacaacattgtacatgttcaaactactccagcagtagctcccatgaattgagtatgtgatgtgcacaaagccgaggctgacaatatcaacacatttaagattcattataaaccagaaggaggaaatcccacctcatttcacagcagagaaaacaaccgagagagattaaatgatgagctgctgtcacatagccagtcagcagtcttgcaagaattgttgctgactccaaagcttgtgctctttcccagcccaagaacttgggggctctgtcaggaaagttggcctcccttgtgtgtcttcaggggtggggagacgatggtcagactgggccagggagtaggtgctgcccggacccgagcctaccctcccttctcctccccagtgcgtatcacggccacctgagctccctgattgacatcagtccctacaagttccgcaacctggatggccagaaggagtgggtccacgtggtatgcactgcccaactcaacaacaggtcggtgcctgtccccaagcccggataacatggcgctgtcactccccacaggcacctctcccagacacctaccggggcccctaccgggaggaccaccccaacccagctatggcctatgccaacgaggtgaaacgtgtggtcagcagtgcacaggagaagggcaggaaggtaaccgtgtccgcgcctgtccaatccagccaacagtgaa

SEQ ID NO: 119072 - DNA, 1114 bp, Homo sapiens
atgtgtgtctgtgtatttatatatatatgtgtgtatatacaaatacacacacacacacgccaccacaaagccaaaaaagaagaagtgatcatttttctaagtgctacgatggatgccctgggagagcgagccagagggggcatgtttatgggctgagctgcacccccccacccccaatttatgtgttgaacccctaatccccggtagctcgcaatggcccgtatgtgaatggatatggagataagagaggtgattacattaagatgaggccgtcagggggcccctcatccaatctcaccagtgtccttataagagaaaatctggacacacaaagagacaccagggacacctgcactcagaagaccaaccagggccatctccaagccaaggagagaggccttagaagaaaccaaccctgcgaacaccttggtcttggacttccagcctccaggactgtgagaaaataaatgtcttttgtttaagccactcagtctctggtattttcttatgagagccagagcagaccaacacagagggtcaggggaagcgtctatggggaggtgactcatgtactgagtcttgagggagaggtttccaggcagatggagcagcatgctccaaggccttgtgaaggaaaagagctcagtgtgctccgggaaccaggagaagatgagggaggccagggcctaaggagggcagggtaggagaggaagtggggagacatgcaggggacatgtgcacagggctgggaaggagcctgagttttcttctcagtgccatgtgaagccactgaagagttttaatgagaaaagggacataagtcagctcctattttaggaggtggcctctggctgtgtctaatggagttgacaagaataaaagtagaaggagaagaccaaggaggaggacgccaggtgagagcaggtggtggccatggagatggagaggtggagggagttaagaggcatcatggagatggaggaggcaggattgatgcaggactggggagcgtgtggtttctgcctggagcagatataggtggtgatgccctttacaaggcaagatgagcgggggtgagtggggatagccttcttgggcaggtgagggagaacag

SEQ ID NO: 119073 - DNA, 2469 bp, Homo sapiens
tgacaacatcgtggactatgcgcagaggctgtcagagaccctgccggagcagctctgtgtgttctatttcctgaattctgggtaagtggactgtggccagcccccgggaagagggtgagacggtaacaaagacagtcactcacatgggcccagtgtagtgtagctgaccgagtgtggactcggagaggcagcccccactgcaccaggctcctgagattcccggctgtaggccctgatgctttctctgttggatccagtttccttgtctcttattgaaggatgttattacctcctttctaggatcattgctggagcttagtgaggtaatatgttcctttatttctgccttaaggatacagccaaaatccctgcctgtgggttgctcagtaaggaaggaaaacatcaagtgattcttcaaagaaatacagaattgcaaggagggctctggaggaagtgtacagggtatcatgaggcctagaaaaagtgaggggacctgacctgggggttcagggaaaccttccctgaggaagggctgttaagctcagagctgactaggagataactagaagaggaggaaggaagggtgctgccactgcatcagaagtctcgtcaaggctgggcacgatggctcatgcctgtaatcccagcacttcgggagatcgaggtgggcggatcacctgaggtcgggagtttgagaccagcccggccaacagggcgaaaccccgtctctactaaaaatacacaaaatttagctgggcgtggtggtgggtgcctgtaatcccaactactcaggaggctggggcaggagaatcgcttgaaccgggaggcggaggttgcagtgagccaaaattgcaccactgcactgcagtctgcaggacagagagaggctctatctcaaaaaaaaaaaaaaaaaaaaatagtctcatcaaaactcttgtcaaggttggtcaccacacagaactgcctgtggaaaggccctgtagcaggaaaggatatggtacccagcacacttgaggaaccgaaagaagtccacgaagggaaagcagaggctgtgagctgttgggaggcaagcagggcgcatcacctagggccttctccgccaagtggggaagctgtctttatcctaagagcattgggaaactatcggaggctttaatcaggaaacgatgtcttaaagggaacggagtgcaagagtggacactgttaggtgccagttcagtggccaggtgaaaggtcatggtagctcacactaggatcggcagtggagacaaacaggcaggcgattacagtgtatctgggagagaacattccaacaaatcgtaggtggtggcgttgaattatagtgatgattactgtggccactcacacagtacagacatctgccccccagataatttctaggaagtggaattcaccatcttcattttacaggtggggtaacagcagttcaaagaaaggaacttgagcccagacatttgccatgtcaagagctggagcctctggaaagagaagggagctggtgcttcctcagtggtggtggaggaggggcattcttatgccaccagctttattctgtgtggattccagggacttccatgttgccaaatccaaagcaatctctttgctgcattgtcttactctgtcccagcagtaattgacagttaccactctccggaagtggtctgtcatcttgcttcccgggcactgtgctctcctgttttctatcagcttctctagccactccttccctgtcttctttgctgattcctcctctgttccttggggctgatcctgggccacttttctctctgagccctctcctcaggtgatctcttccattctcttggtattacatagcatccatgtgttggtgactcacaaatttttttgagcccagacatgtcccatgtgttccaactcgaggttctaactgcccctgtgacatctgacaaacatctccagcttcatgtgttcaaaagggcaagggttgattggaccatggtactgttctccctcacctgcccaagaaggctatccccactcacccccgctcatcttgccttgtaaagggcatcaccacctatatctgctccaggcagaaaccacacgctccccagtcctgcatcaatcctgcctcctccatctccatgatgcctcttaactccctccacctctccatctccatggccaccacctgctctcacctggcgtcctcctccttggtcttctccttctacttttattcttgtcaactccattagacacagccagaggccacctcctaaaataggagctgacttatgtcccttttctcattaaaactcttcagtggcttcacatggcactgagaagaaaactcaggctccttcccagccctgtgcacatgtcccctgcatgtctccccacttcctctcctaccctgccctccttaggccctggcctccctcatcttctcctggttcccggagc

SEQ ID NO: 119074 - DNA, 1001 bp, Homo sapiens
ggatttggcaacatggaagtccctggaatccacacagaataaagctggtggcataagaatgcccctcctccaccaccactgaggaagcaccagctcccttctctttccagaggctccagctcttgacatggcaaatgtctgggctcaagttcctttctttgaactgctgttaccccacctgtaaaatgaagatggtgaattccacttcctagaaattatctggggggcagatgtctgtactgtgtgagtggccacagtaatcatcactataattcaacgccaccacctacgatttgttggaatgttctctcccagatacactgtaatcgcctgcctgtttgtctccactgccgatcctagtgtgagctaccatgacctttcacctggccactgaactggcacctaacagtgtccactcttgcactccgttccctttaagacatcgtttcctgattaaagcctccgatagtttcccaatgctcttaggataaagacagcttccccacttggcggagaaggccctaggtgatgcgccctgcttgcctcccaacagctcacagcctctgctttcccttcgtggacttctttcggttcctcaagtgtgctgggtaccatatcctttcctgctacagggcctttccacaggcagttctgtgtggtgaccaaccttgacaagagttttgatgagactatttttttttttttttttttttgagatagagcctctctctgtcctgcagactgcagtgcagtggtgcaattttggctcactgcaacctccgcctcccggttcaagcgattctcctgccccagcctcctgagtagttgggattacaggcacccaccaccacgcccagctaaattttgtgtatttttagtagagacggggtttcgccctgttggccgggctggtctcaaactcccgacctcaggtgatccgcccacctcgatctcccgaagtgctgggattacaggcatgagccatcgtgcccagccttgac

SEQ ID NO: 119075 - DNA, 3135 bp, Homo sapiens
ctggtttcacttcaccagccaagggggctggtggtaatcttgattgtcaaaggccaaggataataacagtgaatatgtactgagagctcaccatgtgccaggcacattcagagcaagctacataaattaacacacttaattctccaaacaccttaaagtgggtacctagtatcattatgtctttcacagataagcaaactgaggcactgagaattaagtaacttgcccgagatcacaagttagtaagtaggggacagggatttgagcccaagcagtctaagactagagtctctgctttttttttttttttaacctcaactttattcatcttccatgtgcctgctgagtctcagactccctttctttccatcagctctggcagcctcatcaagatgactgaattcctacttcagctcccttgcctagcacctgagatggccaatggggctgaagcactgccatgaccccagcacttggccagcactgtgctacgttgctggtcacagctgggccatctgccactttgtgagctcatcatcagtcccaagtggaactagactcacagacctagattgctgacccctgcctggtttagcacagctccagattgcagaattccacagctatattgcgaaggctgagcctcctctgcatactgacagtgcctcaactccacccaggttctccacacctctcggcaatctcaggtcaccttgggaccaggttcacagcactgccttcctctcctgccctgccagcctgaggtgtgatactgaccgtgcgccacattgctgatgcaatcgatgtattctgccccctgttcatcgtacatgtactgcccttgggcccggacaatcttaacaggatcctcgggaaaaaagagtctgcaggaagagctgtggggacaggcaaggagtggacagccatgtctgaagaccgaaagggtgaagtctactcatcgcagacccccgcccaccccttcccagtttctggtggcgggggggaaatgagagctggaagggcaaggtgctgcttccctgccttgtctctccactccacaggtggttgcaaagcaggaagcagatggggtaacaagtcgctgaaacttcggattgtttctgaaagcattttcagcctctgtggcctccttgctcatttctgcatgtgtccgcgtcagtctcccggatcctgagaaaaggtggctgccccgtcccatggggactccataaggccgcgtgtcttcgatgggatgggccagggcaccaacattaggtgcctggctctcagccctaaacagctccttgccagccacgtggccctgctgcccctcgctgggtgccagccctaagctccagtgggaggcgacctcacccaccgtcccaccgagggccccctcacaggtcaagtgtgctgcctgtgaaccgactcccccgactctcccttgtctgccctttcagccccctcccaggtcactctcgagccaggcccaggtgctgctgacgggccaccctgggtgaggtcctctcaggcgccagggtgaaggtcttctccggagtaaaggctgccaagcgaggctgacacagccgaacagcggtgagggcggggccgtctcctgaactgggcggcctggagacggcgctgtcggggaggcggccccggagaccacccgccgggactgcccaacggcgccgcccgcctcgggccctagaagctccagcggggccggggcagcggccggacgggatgggtagcagcggcttcctagccggaggcgcgtgcgtagtgcgtgcgtgcgtgcgtcgtgcgtgcgcgtgcctctccgcgcagccccgcgccccccgccgcccgccccccgcccgggtacctgatgagccgttgcctcagggccagcgtgtcggccttcgggcgctggtctgcggccatggtgggtggccgtcagtcggtgccgtgacgccacgcggagacgtcgccgcgcgggctgggcctccaaggccccgctccgggccccgcccctgcctgggtcgggatttggggctcaggttcgcactcggccccgccccgaagcgcccgcgttgcggtggttcatttcttcgcttgcccactgggcctggcagccttccggcccgtggtcgtgccttggcagtcccgcgcaggaactcgagcgctgccccgtctctggttccgggacgcgccccgggcctcgccccgcaggccccgccccgcaggcccctgcggcctcccttccgggaaagggtcccggacgaccccgcccctgctcccggcgcccaggcggggctcggagctcctgcaggccttctctgggccagactcagtctttgagtcgccttgtgcataaaatgggatgaactgtgaggcctaagtgcgagtatgtgactggtaccttacccgggcctggtacacagtaggggcctcagggtgggagaagcaggtcctaggttttcccagccccatgaaggggcagcaggaagagcagaaggagagcccagggtcccttctggggctgaccaaggagatcaccatgggcttgaccttcagggcaccatagttcctgctagaatctaggcagggtgaaccggacgagctgtatcgtcgctgagagaatcatgcagcgtttgggcaagaagagaggttgggaatcctccttgtggtacatgtcggtgaccctgaagcccagaaagggaaagggttttgttgtcagacacgcagcaaggctgcagaggctggactcctactgaggtcttcttgactcccagcccagggagtgagaagaaaaagcctcccaaggggctgggatatgagagaaaagccccctcctggggtgaggcactggggctttctgccttgaagaaccctggaacacgggcctgggactgcagcaggtgcaggggaggctcctgattgtcccttctttctgtccacatcatgattcccaggcctctgcttcactccctcattgctgatttcttcttctcttcccaatacagttgtaagatgcataaggcatttattgaactcttgacctcagatgatctgcctgcctcggcctcccagagtgctgggattacaggccgggtgagccaccgcacccggccgcttaaggcatttattaaagaa

SEQ ID NO: 119076 - DNA, 1824 bp, Homo sapiens
aggccccctgctcaggccagctgggaaccagccctgagctttgctttgcctgcacagcccacctagagagccatttttggccagagttctgggtgggagacttggggccagtgagacccagactctgagtgggaggcctgcctccctggtccaggccatgtcctatcttgtccctctctgggtgataatggaaacagagacaggaagtagcagtcagtccaggctgggcccctccatcctcgacactctgctccctggagctgggtccacatcacagcgatcacagagctcagccactactcctggccagaggacatgtgctctcatggcaggctggcctcctgaggcctcctgaatgtggtagagctagaccctcgtgggggatttccactcactgctccccgggcccagccgcaagtgctgggcgagtcttgtccgggggccaagtcttgtccaactgcagaggcagctggttgtggttgagtttggaggctgatgaggccaggagcaacagcagccgctgttccacccctgggtcttcttggatagggtgtgtcccagggactccagagttttgcgggggcaggttcttacagggcagtaccacagctgagagtctctctgctgatcaggtgactgaaggcccaacgtagcatctttctagccttgcccgagccaggtgcttctaccttcatctccttcctgggaaagcccaggcccaagggtgcccctcaggtacacatctccctggtctggcctgtccactttccggcagcttcacatgccggtggctttggggctgggtgggcatactcttgaatgttaaaaggccacaggtagcgcattccatgaaaaaagatcaatatattactgttttgtttttacaaaaattaaaaatgtccacacggatctgtacaggtgtgagctgggcctgtgggtcactggaaaaggaggaagagactgaaggtgacgaggagcccgagaagctccgcccccatccaggccaccttgcctggcctccccggtcctgcccatttcctcctatcttccctccccccactccctctcagtgggccagttgggacaatatcccagggggcactgatggctttgccctgcctggtccaggtgtcagttgagtccatgtgacccacaggatgggttatacaccatcacccaggaccacagccccacgcctcacatgcaagatgggagagtcaaaaccagggtcatgatgggaaacctggctattcagtcactgtgcgagaagccgcagacacccagaggtttgagtgacagcacccaggctctggggccctcccattcccccaccctcccctgcctctcccaagcctgccctggagacttccctgcacggtaccttatgccagcagccaggcacaggcagcccgtcggggccctggaaaggaagaaggtttcagtgatggggatggggcctggggagctcctctacaccccacatgccctcccctggtctgtagggaggtgcaggccagggagcggccatgtgagactgctgggccccactgaggcaggggcacaatgcctcctctgtccacccaggtagtggggtcatggggtcatggggaacgacggcctctcactgagcttgtcctgagtgtgttccctctgtgctttgtggggactgctgtgcagtgggcaggaacaggagggcactaggaagggatgagcattgtgccagacatgtacaggctggcctgggtcctgccgagagccgtgtggcttcctgtctgatgtgacagtgactctggcctgggtcctgccgagagccgtgtggcttcc

SEQ ID NO: 119077 - DNA, 1031 bp, Homo sapiens
ggagccagacataagcaggggccgggtttcctcaggcagcctggagggtggggaaactggagaggaacgaagactgactcatcagggacaccaaggcgcaaaacatgtcattctgttccaaagcacaggaatgagcctcagacactgggcatcccctggaatattcccatgtgtacaccagggaccaggctaggcaccaaagggaaggtggggaggggggcagaatggaaaggaagcagaagcgaggaaggccggggcagagccaagggccctggctgccccgaaggcccacacagcacacggcacacggcacacagcaggccaggccgcctaccgcagggcatggcccattgcccctcgcagggccccgccagcctggtgcccctctccggcctccgcacgtgggattctcctgtttcaaaggagacaagggcttactgatttggaggggagtcctgggccaggccccggagctgcggggctgggccaccctgcccctgctgtccccgccctttctgtgcgctgaccacttcgctcttcaagtccttttctcattgacttctcaaaactgtccgaggggagcggtatcccccactgcagggataaggacactgaggaacagaggccagaggtctgggagggggtctctaactctggcaccgctggaggttgaggccggcctgcacacatccccgtggctggagtggccacgtctgaatatctgtccagttttagtacgaaaacccagctgttctgtttttcctgtcttttctgagctccaccggaagagtgtgacatgtaaaccctccctactttctagaaaaaggaactaggcagggcacagtggctcacacctgtcgtcccagcactctgggaggctaaggtgggacaatcgcttgagcccagaccagcctggacgacattgcaagaccccagctctacaaaaattaaaaattagctgggcatggtggtgcatgcctgtagttcttggctacttgggaagctgaggcaggaggatcacttgagcctgg

SEQ ID NO: 119078 - DNA, 1029 bp, Homo sapiens
atagaaaaggaatgagtcaagaggcatgctagtgacaggaattaacacctttgggacaaacaacgcttgtgagactcacaggcaggccgctggggcctctctcacccgacgcacccttctctccctttgctccatccaagccctggaggcaaaggagggaaatcagtcaaggggaaggggttagacagacagtaggacaggcaagcttggagactgcaagggagctgggatgtggacagaggaacagatcgaggctcccccaggcctggccccagcttactccctggtgagggtgatcaggaggagctctggccatgcgcattgcgccttttccagaacaggctccctcagccccatggaaggtgattacggtcacacccattccaaagatgaggaaagcaggtgcagacggggggcggggggggggggacaggcccagccacacagcgggaggcagcagagctgggtccccatcaggcttctacggcaagccttggaccctgtcctgatagcagctgcctctttgaaacatgaactgtggtggccttaagagaaagcagaaccagaagcagagcacctggtggggctgcaggctcgggcctgggcttccacgattctcagtcccacatctggcctctgagctggggaagcagagatttgctcacgccaggagggtggtgtgacaaggagtgaggccaggtggcctccccttctgtgtctgcctccctggggcagggcatgcaggcaggccacactcgaggacttaacgtaagagcagggaacacgccatcatgtaatatacaccaagcccaagactttgtgcttagactgtggcagctgagagacagatgtgtgtggggcgggctgggatggggagaggtggggacagtgcaaggaactgacaggcacagacaaaggagaaggggacaagcagtggaaacggtggtggacctgaggaggagagagggacagactggggtcccgggcagagggagaaagtgggagaggagagcctcaagggtggagagg

SEQ ID NO: 119079 - DNA, 1033 bp, Homo sapiens
tggctctgggacctagcccccaccccgcctcttggtttcctggctgcttcaaaccaaaccaaagcaaaccgtccttaccatcgggcctggggggccaggggggccagggggccctggctccactatgagctgagcctagggagggtgagagacaggttagtcacccaccgcctgtcaccctcacctacccgcacccgagctcatcgcacactgctggatcgagagtctccttcctgccccccagagggcagagtctggtgagcaggtggcagctggtctgcggagcttatagtgagccgaggttgtgccactgcactccagcctgggagacatggtgagactctgttctcagaggggtctcgctccccttactctccctcccctactgccctgggtttgctcaggccaggtggcctttttgtcccaaggctcagggtccccacccagcctggactgggtgttgggggaagccctgacccccccatacccccttaccaggctctcctgtaggctgtcagacgccgactcccccttctcccccttgaggccgtcagcgccctgcaggacggcaatggcctgtgagtcctttgtgtccagcacctgtatcaccacccacggtgcttagtgacctcccttccttcccccatgtggctcctgagagcagtcatcagttagctgttgcaactgaaaagttttccctacatccatgtgccacgccccgggtggtgggcagtgtgggctttagaaagcacacgagcagccgcacacattgttttcctggggtgcagggagcaaccgggggctgtgaagcaaagaccccggggtcaaaccccagtgccccctctagcccagtgaccatcagggatggacactggaagtgtcccagtggtggcgtaacagctggtggctcttccagtcgggccacaaaagcaacgaaaatcatgaggacaacagtgggcatttgctgtgtgccagccaccactgtcagcccagccacgcatgcccttgagggaggggaatgatcacccccact

SEQ ID NO: 119080 - DNA, 1045 bp, Homo sapiens
aggcccctgtgtgtgagagtgaagccggtcagtgtcatgggttaggcagggcctcccttcgctacccatccagctccccacctggaatcaagtccccgtccagctgagcagagcaggggcagggtccttggggactgcttcttccccagtcaggtcaggccacactgtgcaaggctttatctggcctcccaggcttgggggaggccaggaggtgacacccagcatttgacaagacaccagtgtctgctgccatggacggccctctgccccaatccagatttcttcacgatgttcccctgctcaagatcttgctttggctccctattgcctctcaaagcaagcttaaatcccctgctggcattcaaggcctgccaagaatgacatccccaatggtggcccagcaccaccgtctctgactgtcctgtgagctctctgaccttctggctctgctgcctgccatctgctgggcctagggagttccttagtctcgcaggtaggggtggggtctccagtgtttccaggtccgaccccactctcaagctcctgtcctgatccaggctttctgcaggctacctgccaccagggcccagctggccccctgctcagcctccacactcctcccctcccttctgaaaaactgcaccctgcccagcccctgccccacccctgccccggaagctctaggtctctcccctcccacctccctatcctgtgcccttcttgttggtgtcccattgagatgtccctggcctccatcttatctaccctcccccaggcccaggcccaggacctccctgcctggggtccccctgctccctgctccaacacctgctttcattcactgtccatatcattccctagctagccttcccccaatatgtttttattttttattttttttttatttttgagatggagtctccctctgttgcccagcctggagtgcagaggtgcgatctcagttcaccacaacctctgcctcccgggttcaagtgattctcctgcctcagcctcccgagtagctgagactacaggcgcgcaccac

SEQ ID NO: 119081 - DNA, 1080 bp, Homo sapiens
ttcgaatgggattaagggtctgggttgaagttagggttgggtttgggtctggggtcagggtcaggatctgaattggggctggatcttggttggagttaagtttgggcccaggttcagtgtctggattagggttaaggatagtgtggggtctgcactagagatggggatggggatggggctggctctggaatcaggatttggggttttggtcaagtcctgcgtggcccaactccatgccctctcttaccgctgggccttgtgctcccctggggccatctttcccagtgtcgccaggagggccccgggccccaggaggtccagggggccccggaggcccagcagctccatcttgtccttggtctccctgaaagagatggggcttggcatgactctgagggggagggggtccagcctccagagagaggctccctcagatgggcagccccacgccatccccttccccagcccttgggcaggctcaaaggggagggctttgttattgggcctcttgccacttattgggagctgcatgaaggaacaggtccccataccttggtgtaagaggccctacaggaccctttacatgccaaggaatgtgccagctctccagcgcctgaagcccagatccagtgtttaggagagagatggcacacgctgcatgtgggagacagcacgtgtgtccagctgccccctcttctttctagaacggggtctgagtgtctcctgaaggaccttcctggttggtcaactcccacttcatttaagtatggaggggcactcttgggcatttatccttgttcacagctgctttattagtaacagccccaaactggaaactaatccgaaagtcctttggtaggtggaaggttaaggagctggggtacatccacatcatggaacacaactcagcaatcaacccaaaggaacagggcacgacacatgcaacacctcagatgcatctcaggagaattatgctaagtggaaaaagtccatctccaaagcttaatactgtgtggctgtatctacgtaacactcttgaaatggcaacattgaagagatggagagcccataatggttgcc

SEQ ID NO: 119082 - DNA, 1069 bp, Homo sapiens
agtgtagtagtgtcatctcagctcactgcaacctccgcctcccgggttcaagtgattctcctgactcagcctcccaagaggctgggattacaggcacacactaccatgcccagctaatttttgtatttttagtagagacggggtttcaccctgttggccaggctggtctcgaactcctgacctcagttgatctgcccacctcggcctcccacagtgctgggatcacaggcgtgagccaccacaccggccctggttgcctttttttacacatttacctgcctttggagaagtggtaaatgggagggaaaacaagtcctttttttttttttaaaaaaaggatatttgtagttaatgccagagccacggcactctcccagaccctctgccaggtggtggtggtgacataaggtacatacaattcctgccctctgagagcttgcaatcaagtagataaatcatctgccagcaggtggtagatactcatttacagcactgctgttgctgtgggaataacaaagtcacctgatgctgttgctgatgctggcccagcacagggcggagttgtttccccacatgagatcaacagaggagagcgtgacagcagagggccagggtcccccttctcagctccctctgtaaagctgggagtcttcccactgcaggaccggagcacacagcagcatgaattatgtgccctcttgctgtcctagccccagctgcaggctggttacatcagcttggacttcatgcttggggcacagagaagctgtcaaaaatgcaagcagattgggctcagatctaaggagctcccaagaccttatctgcagatggaaacagacattggatagacaaaagaggaaactgacacccacccacctccccaaataataatacttagcttttacaacaataccgcacttcccctaagattcaggcattcccaacttcttaataaatgctgtttcctttgcctggaaccctctgctaaccttgtccaattccccatccccacataggctaatgagaccttcccagttaccccaagctaagagcaatcatgcagcctgtg

SEQ ID NO: 119083 - DNA, 1064 bp, Homo sapiens
ccagcctgggccaggaagtcccgttcagctgggaatgagccacactcccattcccttctttcacctcatccggagattaaaagaggagaaaaaaatacaatacagagcccacaggggtcccggactccaggatctggttccagaaacagaaaggttactttattagctgtcacagaaatttcactgtgaccccaaagtaatttccccagagagaggcaaatctccaggagccaggaatagacgaaaagattattgctcgccccgctgggcacacagcgcctgcatccggtgctggctggaaatcgagcgagcggtgctggacgggtgccgaccccctcccttgcagcagaggcccctgggaaacacagtcttgaccggcggcagggtcggggctgggctgccctgcaagggctgagaccgagggttcagaagtggatgcctgccttcctgcagcgggcagaggctttgaaaccagccctgagctggaatcccatctccattaagctctagcactggggccctaagaaaatgataccccacagccctccaccatcccaggcctcagtttcctcagcggtgaagtggagatgttggggaggcaccggcctctagaggggcacaggtagggtcagattcttccctccctcagcagcaccagggccagagccccccactgtctccagattacccacctgggatgcaaggccaggcgcccagctggggtcccaggaagagcgccagtggaaggccccagggaaggccccaggctggggctcagctgcccctcctctcctttgatcttcacccaacctcaccattttacagatgaggtgtgaggttcagacatgtgagagtccatgcctgtcacacagccgcccaatgtccaagtcctggtccaggcattttgcccgaggccaccgtgctgcaggggcgctgtcctggtgggaccatgtgtggttgctgcatctgtcctggagaacagtgcctcggggccagtgagtacgtgaggaggaggtacccaagaaggctgcagaggccagcagaaaagcccagcctgccactga

SEQ ID NO: 119084 - DNA, 1028 bp, Homo sapiens
aaaactagaactataaaccctgaatttggtgtcttattctcccaaatgggttctgtaaagggagcactcatatagggaaggatttaatgtactgtcaattaaaagtttttgcatagtaaaatgtttctatttgttttaaaatagctttaggttggtctcagccttgtgatgtttggagcataggttgcattcttattgaatattaccttggtttcacagtctttcaggtacgtggctagtaaattccatttaataattcataacaaattgtaaacgttaaaggtatgctaaagttttgacttccatattggaaaattgccatacatcattattcttgagattaaaacttaggcaaaatggtcattctttaaaaccacagttgaatgaaatattactatgagtgagtgatcatagttaattttgcatgtgattagtgtttgtaacacatggttcatatatggttcatactgtctccttttttaaattgtagagcttcttcataaatttgcagtagtgttaatgtggccagttttcagttatagttatgttgactatcaatatggccatgaacgagtcacttattcctttttataaaagaattcagaaacaacaagggattgtattttactcttaagtattaagcatctataatgtcttaggcatttctaagtataagtacataaaggtgaagagacaacatctttctcaagtcatgcaaaagacattggaaagttatcgcagtatagtgtagcatttgctgtgatggaacaacgtagaaagtgtaggtagggagggccaggcggggtagctcacacctgtaatcccagcactttgggaggctgaggtgggtggatcatgaggtcaggagatcgagaccatcctggctaacatggtgaaaccctgtctctactaaaagtataaaaaattagctgggcgtggtggcgggcgcctgtagtcccagctactcgggaggctgaggcaggagaatggcgtgaacctgggaggcggagcttgcagtgagcgagatc

SEQ ID NO: 119085 - DNA, 2128 bp, Homo sapiens
gggaattatcacttcatataaagtattttatcaaaatgttttaagaagatgttatatggaatctgctataatatgttctgaaagattattttaaatggcatagaggaattggtaattaagactatgctttagagcataacatggcttcagctcactcttgtacatttatcatttttatcttaattttatttttaagggatggcatgcatgtagcagtgaaaatcgtaaaaaatgtaggccgttaccgtgaagcagctcgttcagaaatccaagtattagagcacttaaatagtactgatcccaatagtgtcttgtaagtataactttcacctaggagccatcatattacatgaaatattcaggtttccataaactgaattattattttgctctgttttagccgatgtgtccagatgctagaatggtttgatcatcatggtcatgtttgtattgtgtttgaactactgggacttagtacttacgatttcattaaagaaaacagctttctgccatttcaaattgaccacatcaggcagatggcgtatcagatctgccagtcaataaattgtaagtacacttgataaatctttatttttatttatttatttatttatttattttgagacggagtctcgctctgtcacccaggctggagtgcagtggcgctctcgggtcccagcaagctcagcctcccgggttcacgccattttcctgcctcagcctcccgagtagctgggactacaggcgcccaccaccatgcccagctaattttttgtatttttagtagagatgggatttcacagtgttagccaggatggtctcgatctcctgaccttgtgattgcccccctcggcctcccaaagtgctggggttataggcgtgagccactgtgcacagcaataaatctttatttttaaatattttttatgtttgtacctccttaacaattaagataaatctttaagcaccagaaaacttgtttttattatacaagctatatatccaaatgttgtcactaaaaaaacagacattttacaagtaaagatgaatcgtctcttgaccactatatcctttgccagtcctcctttccctcctagtacaaattaagtttgtaagtgaaactaataatgtgcttttgttctcttgtagttttacatcataataaattaacccatacagatctgaagcctgaaaatattttgtttgtgaagtctgactatgtagtcaaatataattctaaaatggtaagttaaagacttgttttaatttgggtggttgtctttaaaattaatttaacttgatgatctttggatgaggaatttcacttctgagccttattatatcctgttgtttaaccaaaaagaagtaatccttctttgcctttctcatgagcttactttgacaatcaagaagataattcatgtgctggccttttgagtagcgctataaaatgtatctattgagtttcatgtttactcaactgtgtctctctagaaacgtgatgaacgcacactgaaaaacacagatatcaaagttgttgactttggaagtgcaacgtatgatgatgaacatcacagtactttggtgtctacccggcactacagagctcccgaggtcattttgggtcagtagacaccaggctttctaatattataattgaagaagagatttttgttctttacagctttactggtggggtggggaagtatgatcttctcagcaggattcagaaaacgttttctattttcataaaaaatgtgtggacattgctataaatacttttcctgagtggtaaacatgtgatactgtctgggaaagatattccaggtggtggttatttttgaacaagtaaatcttaaatgatcataagagaacaggctgtgttagctaaatgcatcaaagaaatgtgattttgaagttatatgagtacctattttcatgccatcacaaaagcacatggctggtaaaaatactgaggaaactggttggcagatgtctagaatataggatggataaaggtcaagagaagaaagaggcttctctaagagctcctgtgataacccttgatgtgagaaagtctgggaaagaaaatgagttaaggtgcagagttttcaaataagaagggact

SEQ ID NO: 119086 - DNA, 1893 bp, Homo sapiens
agcgcaatagacactgttcaagtcatcagtcacgttcggtatgattggttttgttttcaatttgagtggagttttatttgtgtgtactcttaacgagctgataagtttctaattttttatatatatatatataaaatactatttggatatattataattgtatttatattacttaaatccttaaaggaaacctccaaattcttgtagctgatctgtatatttattagctagccctcatttgcccacatttcctcatattctgcagaccagataatgagtttattgattttaataataaaactatttttttatttgtaacatattcttatgaaaaaatcatgcacccatatcttttctttcatcttaagcattttttttttcttagaaaccctttatctggtacttgaaaataaatgtgaaatattgcactggtggacacctgaatgttactaacctgcatagagcatagttccatagtccagtgcatcattgtctgcaatgaattcttttgaagttgtgaaaatgggtgctgaatgggaaacatccaaaaagtctgcccccccctttttttttttaacactcagacatcttcacctgcttgaacagtgaactttgaattagtttctccccaagttttcttcagtaaaactagtttttattagattgaacattgaaattaactagcctttattttccccttttattttaatcatgtatattttaaaatattgctaaattagaataatttcaaatagtcttgacattttaaaacatttttctgaaaaactagacatctcaattcacagcatatgctgtttatagcaagagataagtaaatcatgacattgcattctttaaatttcagacttcaattaaatcagtattttaaagagacaattgtgttgtttttttctattgccactttaagtatcttatctgaaaatctgttccttgccatgtttttcttctgtaacataaactgtgccctgtgaatttctggggactgaatttgaaattgctcctgccaactgttcgtggcctggtgcttatctgaatgcctgaatatctccccgctgaatgaattgcgtattctgccctgaattcactctgatatattgattggctggacgatcttggtgctgcccacttgccgttccagaagagccaccgaaggaaaagatccaggagtatagaggatgatgaggagggtcacctgatctgtcaaagtggagacgttctaagagcaagatgtatagaatatttttcaacactttttaaactttgcagaaagaataatctttttaagaatagtttgtcagcggggggctaaagaactcttcattgcttttttattttgctttttgtgggtttgtttgttcttttatatttcttcttttctgtagaatttaaatatttctattctaaagttccaaaataatcagtggaatttgagattagagcaagaaagatagctctatctaattgtttttgtagcagctgaaactaaaataatttgagtgctgaaaccttagttatgctttgttagagatcatttgaaaatattccacacttaagcattcattgtttgaagaactagacagtttgtactcaggtacttacacctctttttccctcctcactctagatgaaatcgtggacactttgggtgaaggagcctttggcaaagttgtagagtgcattgatcatggcatgtaagtttgttttttccttttcaaacattctgatgtttttggtggggaaagattcataattcagatgaaattttatttatttatttatttgagatagggcctctgttgcccaggcttgagtgcagtggtgctatcttggctcactgcaactgccgcctcccggcttcaagtgattctcctg

SEQ ID NO: 119087 - DNA, 2129 bp, Homo sapiens
gtatttttattgatttagaagagctttttattacaatattttaaccatttgtcatatatatattgcatagtgtcttttctttatgatttgtcttttggaggtagcctgtgaattggtctccctttctacaggcttagttaatccattctgcattagaaagactgatgtggctgtaaaccctacctttatatattgtggtcagaagcctgtaacataaagtatcaagtcttaaaccagtgattctccaactttagtgtgaataagaatcaccttggaggtatgctgaccagatttacagtcagtgagtatgacctaaggcccagggttaccatttttaataagaactccatatttgatactgttgataaatagaccgtcctttgagaaataatactctttagcctagcacgcagggtttttaatgatgctattctcagcttacttatttgtctacattcccctatgtgaaaattgctcttgctgggattgtctttttcctgagtaatgcatagacaattccatctctaagccattgtggctaaaagtgccatatgaatttaagatggtaatatgccattcttctcccccggaatttcttctgtattctactttttccaaatcctggcttccctttaagatgcaactctatttccatcttttttgtaattattctctgaccattttaaacagattttttcccccatctctgactctaagcactcatgtgttgtaaccttttagaatttcctacattgttggattttgtttcatttttatgtgagtaatctcaaattgttcattatttgttggcagggactttgccttatataattttttttttatctcccacaggacctgtgtggatataaaaacgaatgcccttaccctcatccgtcttggctatttgaaaggctatagtgaaatattcactgggcattcagtggatattttaaaaaattaaatcagtctgttcatcctgtctaccctgtccatagcctgtgtaattctgtagactttgtttatataatctctcagccttggtcattggccattatctattgaagagactctcatccttttagtttgtcctcatggtgttcactccatgttttgttactctatacgttgtttatggcttagcagctctaattccatgcagtattccagctaaagattgttagtgctagttttttctaatagaaggattttggacttttatgggaaggatgcccttaagagtatggtcacgtctagcttattgtattggtgatctctccctgacagttccaagccaactgatcagatatctgacctagactacccacagtcttacccaaatatcctgagttgtttctccaataaatacaacttaaagctgatgctagggaaagagaaccgggtttctgtatctccccagcctggatttgatgctagccctattgggtagtagttgtaaagatgcttctatttctgcctaaaccagccccctgggaaaaagaatgacagcatattctggggaaaggaaaggggttggtgagggcaatctagtcaacatccgtcactccattgcttgttaggcttattttagccgatgtgtctgactgggcaggtgtcccctctctccctcagtgctccatgtgcatccctcttgaagcttcgcactctgttgaagaggacactcatcccaggtagagagggggacgggaaactgggccaattgaatctatgtccttttctttccatcagatcaaggccacttaactgggatccattgacatcctgaggcccatgacctttgaaattccttgccaagttttgtttatgtgtttcttaggaaagagagtccatggctttcagcagattttcaaagggatctctagattaaagcacgatggcactagatgatggtgttttctgttgtttcttaggtatttctcaaacaggaatgacaggaaattagaaatgcaaagggaagtagggtggtggaactattgtaatgctaaactacaggatccctttcttattttagggggatatattttagatgcctttggcacatgaggcagtcctcaaaagctatgttttctatttctcaaacaggaataacaaggctagaaatgcaaagagta

SEQ ID NO: 119088 - DNA, 1830 bp, Homo sapiens
ttgtaggttgagttctttttcagagttactccagatttactacaaatagattttaaggttaagaataactgctggataagaaaatgaacttgttggatagagaaaatgagttcataaaatcacataaacatttaaaaaaattttttttgtagagacagtttcactatgtgtagcgcaggctggtctcagactcctgggcttggcctcccaaaattctgggattacaggcatgagccaccgtacccggcctaaaatcacctttttatatctcttcagtttctctgttgaatattgtgttctatccacacagaactaatattctcaaagcttagagtcattctgagatttagagaaaagaactatggagaatttgagaaaaagaagcttcatcattgaatagctctttaccattaaaacaaagtcacctcccatatttagtatccctaagtgtttttgtcttgcacttcagttatttgtattacagtactttgccaaagctgcatgacactgatattatttctccttaaatcagctcacattttaatgttaacatttttaaaagaaaatatgtcaataacttaattggaaaatcactaataagtagaaagtaacaaaataagataaataaaaacgttactaatttttagctaaatactcttgtctgctggaaacactaggcctgaacctttttatttgccccccccggcttttttttaatttttaaaaaggcagttagcaagtgttagttgaagacaagcaccaagctgagaatttgtcctggctgtaatcagaattcaaaaaaaaaaaatgtcttaaggtatcagtattacccacaatttaatactagatctctatgcctcttagcagtcatctgacataccagtgccttgggaagcattaccacctaaaaagattttggagcctgtaagaccctgtgtgttgggttttgataacttaaataatattaatatataataatttacctatcacacatctgtaacctccacaattcccttttcatttctatcaacagatgcggcattccaaaagaactcactgtcctgattgggatagcagagaaagctggggacatgaaagctatcgtggaagtcacaagcggaagaggagatctcatagtagcacacaagagaacaggcattgtaaaccacatcaccagtttaaagaatctgattggtaaattaactcttgaactactagcattttagctctaatagttttaaatgatttgtcatttgcttatatagctttcatctgtcaaattgttttataattcagtcaacaaatattcgtttagaaaatatttgagtacttattttagataggcgctgaggctacagctgtaaataaaacaaagttcttatccttatgtatgtctgtctgcctgggagtggtaggagacagttgatcagtaagtgaatgtgaaatgtattaaataacatggtgagtcccaactgccagtaacgtgattagggagatgacacacaaaaagttaagtaatagtgatagaatgcccaatgagtacctttaacttgtatgtaggagggagatgggtatgttgtagtgctcattgtttcagaaataaggtagggttttataggggaggagttattccaacagagaaaagcagcatgtattattagtcacttataccatgtcgtacaggttatatttgtagatgaggccaagggatatgtttgggatttttagaagctggctttatttaagaactattcttttgcataggtagtagctagtaatttgggaaatggcctcaataaaaacttgcaacagcatgtgtgctgttttatt

SEQ ID NO: 119089 - DNA, 1030 bp, Homo sapiens
cggccgaggagggaagacggcagtttggcgacatttctcggccgaagggccatttgcttttgcggaggtagggttgcagatggtgtgtgctgggacaggcggctgtcggtctttaggtctccgagccaggtgtcggagaaacgaccgcgttaggggcctgggcttctggagctgagttgggagttctgcgaggcgctgctcggctggtgcacgccggcagcaccgaaagttgctcgggcgtcgcggttctgccgctgacccttctctgagggccctggccgctcgcgtcgcggctccggaggccgtgggctcgcggtcccctgctgcctggcgagcgcggctgttggttaaccctgtcgggacctcttccagccggcgggcgctaggacctgtcgggagacccttcgagagccgtctctggcattcgtgttgtcggagatcaagtcttcccctggattcctggcctgggccgtttgtagcgtttcgggggttttccagagtcaagcatttgcccctgtcttgagtgcgccaaaggcactggccgggtgcccaggagccgggaggtggggaccgggcgtccgtgcaaatccaggtggttgagggcagtagctgcttgtgagaggtggaaatttgcggaggctagtcctctgtgctatgctgaacacaacattgttgcagcgaacctgcgtttctggtggttttgcatcttattatccctggttgcctaaatagtccagataggcttatccgatccttaggaaaccgccccgcaaactgaactcgccagccactttgtcttgcctcatagctgtcctgtgcgattgtgctttttacacacccctacaggcttgtaacccattaaatgcagtcctcttggagccatccaatcctaaacttataacctgtttcgatgtttttaagccatgtacgtagcgtaaagttgtcaagaactacaggatcttaagggcagtggcgatggatctacatatgagatccattgtgtcattattttttgaaagatacctactct

SEQ ID NO: 119090 - DNA, 1004 bp, Homo sapiens
tactcagaaggctgaggtgagagaataacttgaacccaggaggttgaggctgtagtgagcagtgattgtgccactgaactccagcctaggcaacagagtaagaactttgtctcaaaacaaaaaacaaaaacgttgcacctcaaaaacatactcaaaacaatatagggagattttatagatctatagttactgtggtagttaagatagctttgtttatttcacacacatataccaagtcctaaatatgtgttagacatgattagaaaatcaaaatgagtaagacatattctttgatttataagggttaaactacaaaagtggcagtatgatgggagaggagaggaagaatacaagcaatcacaagcagaatctaggaaatttggtaaatgactaaatgtgccacttgaatgagaaggaagagtctaggatgacttggagttcttattttggtagataaggttgccataattaaaaacacctatagttgcccaattttgtggggcaatgatgagttcactttgggtacatttccatgagtctgtgggacatccaagggaagggtcctgataggcagcagagtaagtgataaaggagacacatttgcaggactgtcattgatgggttaggtggtaaaaagaggaagcagtagacgctaagtggaataaacagcaaaaagaaaaatagaaaaatcaaaagttggtgccacaaaggtaaaaagatagctttaacacagcgataggaatagttaatactgtgaaatgctatggagggcaaagataaaaacagaactatgtcggccagtcgcagtggctcacgcctgtaatcccagcactttgggaggccaaggcaggcggattacgagatcaggagatcaaaaccatcctggctaacatggtgaaaccctgtctctactaaaaatacacacacacacacacacacaaatagccaggcatggtggcacatgcctgtagttccagctactcgggaggctgaggaggcaggag

SEQ ID NO: 119091 - DNA, 1029 bp, Homo sapiens
atagccttctcctctggcttgaaaggttatgtagcccaccacctgggacctctcctgacacagccatgcctggaacattctcatagccttccctactgtgaatgtcagtgtcatctttcccaggactcatagagatggcccgagttgaggcagaactaggactcagtgaccgcctttcccagcaagcctggtggtgttccacctatatctccctcagtgaatgtgctggtgcctccttccgaaacctgactgtcaggtgtgacctgtaagatgagggtttggtctaggtgatcggacgtttccaaatctaaagttcagtgttttcttgctctgattttgtttcatgggttcaagtgcttctcttggttggcctctgtgttcaagcttcctgaggggacggtgtttcactcaccataggtaaatgataaatgtgtgcttggtaactgaaaagttgtccagaaacacttgaaatacttagaaccctaagttgtgacagggttgcttctcagtcttctcgttgtggggacagtcctggatgaacaggagtgggtttgccattccaggagtccgtgacgttcagggatgtggccgtgttcttcagccaggacgagtggttgcacctggactctgcccagagagccttgtaccgggaggtgatgctggagaactacagcatcctggtctcactgggtaaggaactttcctcctgatgcagaatctgccaggagagcaccttagcaccctcagggggcacatttggagggcttggccaggtcggctcacaggtgggctccaagagtggccattgccattccccttggttgtatggagagaccttggcttagtagagttgatgaaggggtcttttctctgcttttcctgtcttctgcccactgagctctgttccctgagccccacagggtgttcctgctgagaggagtgcacaaccagagccctgactttcttcctgggaccatctcctggttgtcctctaggagcccagtttgaagcctctcagaacaaacctcc

SEQ ID NO: 119092 - DNA, 1035 bp, Homo sapiens
ctcagggcttgccttctttgctgtgttggttcagagtgagtagtaggtcagttctaggattggtcttcatgctatttgttcaaacttcatttgcttcctcatgagcagggattccattttcaatgccaaagttgattcatcagttgcagcaaggagaagatccctgcatggtggaaagagaagtcccttcagatacccgtctaggtaagtgagaggctgggaaatgggcacaaggggttctttatagacaagtaggtcacaaagaggcagttcttgggaaactcttggaaatactgagtcctcttgagatgctcaggccagttgtattttgtttgagttgtataggttaaagtacacacaattacctaattgcagttatctaatgttaacctattttctatcatggattgatgaaaggaaatcaggttttaacagagagtagtttagagtcacctcgaactaaatcttttcacccagaatcaaagctgagcttggggcttgggcatttttcaggactttaagacatactgacttcaaatctcctgcagattttcattattctcaagagattcctacaaagagagtgcagtcttttggttgcagcttattagaagaaatgaatatgtctctctttgtgataaaataaaaagaggaaaataaaaagaaaggtaatatgaaaaaaattgttattcttccaatcaccagggacagattgttgcacaggggtgatttactccatgttttcctcttttttataatgagcatcttaaacttcgatcacatagaatcatcacagtcatgctgcagggctgttgtgattttcaaaacctgaatgtccccccactcctttttttttttttttttttgagatgagtctctgtcacccaggccggagtgcagtggtgtgatcacagctcactgcactctccacctcccaggctcaagcgatcctttcaccttagcctcctcagtagctgggaccacaggtacatgccaccacgcctagctaattttttgtatttttggtagagacgg

SEQ ID NO: 119093 - DNA, 1063 bp, Homo sapiens
ccagtgtattctcccatgccattccttaacctgtttacctcactttcctttatcccatcctgttcttcccaagattcaagtcagcatttgaaatctgattgtatcactcttctttcatatatactgttaccagtttttttgtctcaccgatacatcagtttgtttcttccagcagaggaggcattaattcttctgattcattttaggtttcaagacttggcttgaaacagaagcattgcctcatagacaggacatttttatagaagaaacatctcagggaatggtaaagaaagaatccattaaggatggtcactgggacattaactttgaagaagctgtggaatttgagagcgagatagaagaagagcaagagaagaaacctcttagacaaatgatagattcgcatgagaaaaccatcagtgaagatggaaaccatacaagtcttgaattggggaaaagcttatttacaaatacagctcttgtcacacaacagagtgttcctatagaaaggatacccaatatgtattatacatttgggaaagattttaaacagaattttgatctcatgaaatgcttccagatttacccaggaggaaaacctcacatctgtaatgaatgtgggaagagcttcaagcagaatctgcatcttattgaacatcagagaattcatacaggtgagaaaccctacaaatgtaatgagtgtgaaaaaaccttcagccacagatcatcccttctttctcatcagagaattcatactggagagaaaccttacaagtgtaatgaatgtgagaaggcatttagcaacagttcaacccttatcaaacatctgagagtgcatactggagagaaaccgtatcgatgtagggaatgtggtaaagcctttagccagtgttcaaccctcactgtacatcagagaattcatactggagagaaactctataaatgcggcgaatgtgagaaggccttcaactgtagagcaaaacttcacaggcatcaaagaatccatacaggtgagaaaccctataaatgtagtgagtgtgggaagggatacagccagtttaca

SEQ ID NO: 119094 - DNA, 1058 bp, Homo sapiens
gagaaccttcacacgtattgtaacccttatcgaacatcagcgaattcacactggacaaaaaccttatcagtgcaacgaatgtgagaaagccttcaaccagtattcatcctttaatgaacatcggaaaattcatactggggaaaaactttatacatgtgaggaatgtgggaaagcctttggttgcaaatctaacctttataggcatcagagaattcatactggagagaaaccgtatcagtgtaatcagtgtggaaaggccttcagccagtattcatttttaaccgaacatgagaggatccacactggagagaaactgtataaatgtatggaatgtgggaaagcctacagttacagatcaaacctttgtagacacaaaaaagttcacacgaaagagaaactctataagtggaaggaatatgggaaacctttcatctgcagctcctcacttacccagtatcagagattttttaaaggagataaagcctatgaggtttagttcatctctcaaataatccaagacttctcactggggaataagggaataataaatagggtacaaactcctaatagatttgtcttttttacttctcctgaaggaaatatgttagttgccactaagtcatgataaaattgatcagtgagactatgaagagcactgacttgttaaattttaaaagaaccataaattctaaggtatctaaaaacctatgagtatttaattcatagaaaaaatgtaaaaggtctttttaaaaatcatgaaaaatagttgaatatacattttgtttctctcataagaccatattccctttaaaagagtaagcttcaatatgtgaattttcttttaaaaacagtcactgagttaataatgtaaataagtgtgtggccttctttaaaatagctggctaacataggaggcacttcttttcataaagagaagctaaacataaaaaggaattttaaatttaactcttcacatggaaataataaagctctttatatgagctgtcccaccagcaacttatatatgtaaacatacatatatacacatatgcatgtgt

SEQ ID NO: 119095 - DNA, 1664 bp, Homo sapiens
aggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggc

SEQ ID NO: 119096 - DNA, 1093 bp, Homo sapiens
gtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtatgtgtgtgtgcattcatgtgagtgtgcatgtgagtatgcgagtgcattcacgcgtgagtgcatgcgtgtgcgagtgcattcgcgtgtgtgtgagtgcattcgtgtgagtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcatgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagct

SEQ ID NO: 119097 - DNA, 1030 bp, Homo sapiens
actgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctaggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatcc

SEQ ID NO: 119098 - DNA, 1196 bp, Homo sapiens
ctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacagactgaggtactgtctgagaccctgtgatagtgggaaattataaatgtatgtttgttcttcatctctggttcct

SEQ ID NO: 119099 - DNA, 1077 bp, Homo sapiens
gctcacgcctgtaatctcagcactttgggagactgaggtgagcagatcacctgaggtcaggagttcgagaccagcctggccaacatagtgaagccccgtctctactaaaaatacaaaaattagccaggcatggtgggcacctgtaatcccagctactcgggaggctgagacagcagcatcgcttgaacccgggaggcagaggttgcagtaagccgagattgcaccactgcactccagcctgggcaacaaaagtgagaatccatctcaaaaaaaaaaaacaaatagctggtcagggaatctgatgtctctggtgggaatgcggtctgcccactcccagatgcaggtgctggccactcgccgtctctcctgtgcctcttacctttctagactagcccatggccgctgcttcctcccctcccaccctccgccctgcctgccacccactcagctgagtgccctgtgctgctcccgtctggcctgtcaacttgccgtgctctggcccgttccttcccaacccccagggagctccttgagggacgcaaggcccagtgtctgtccccatgctcagagcataggccagctgtgagggcatcccgagagcactcaccagaagcagacgtggaacagagctggcgtggagctggcttctggggtttgcagccagtgttttcctctttacattggatggacagcaaggcagtgtcacaggtcccctcctagtggaccatagacctcgaaactgtggttggtctctgatctttaaaatgtatcattgtggccgggtgtggtggctcatgcctgtaatcccagccctttgggaggctgaggtgggtggatcacctgaggtcaggagttcaagaccagcctgaccaacgtggagaaaccccatctctactaaaaatataaaattagccgggcatggtggagcgcgcctgtaatcccagctactcaggaggctgaggcaggagaatcgcttgaacctgggaggcggaggttgcggtgagccgagatcgcgccattgcactccagcctgggcaataagagtgaaactctgtctcaaaaacaaacaaacaaatg

SEQ ID NO: 119100 - DNA, 1004 bp, Homo sapiens
cattgtcaatcactgaaaggatgtgctggagaccaggggcctatgactggccaaggcctcccagaaagagggtgccaggatggaaagccatctgcacaggcaaacaggagaggcggggctgcccatctgccacagtcagcacagtcaccgggcagtgagcctgctctgatatgggcttctggaaccagagaaaggggaatccagcgggcaacgactcagggcactgggagggtgggtggagcccccacgtacctttctccgggaaatggagaactccttctcacactgcctacagtgtgtcgcttcgtcatctttcagccaggcgtggccctgaagaggaaaggacattctagaatccactttctgtctaagcccctgatgagtgggtagctgcgttctggccacatccattgtccctcatagcacctgtttcctagtgaggcactgtttctccatcagatggggcctcacaggactgtcatcaaggggctctttccccgtctggccgcagccgggatttctgcatcctagctccgtgctccacctcttggcctctgcaggctgccctggggcctccaggcggtctccagcatctgctcactcaggcacactcccactttcaatcagttccctttggctgaagtaagcagagcgagcttctggtgcctgcaaccctagaccctgcctgagacactggccgaagtgctagctgaactggcaggcgcggaagaagggccaaatctgagtgagactaagacacttgttgacgctgatccttgtggagagacagaaggtgatggacagcgggcactgcgtcccacaggcctgaggaagcccttctccatgcgggccaaagccctgattcttgaccagccctggggagcacatggactccattccacaggggaggcggctgaggctttgaaaggtggcccctcagagggctttctcagggcgaagcagcacctgtgatttatttgggcttagggactggggtgttccag

SEQ ID NO: 119101 - DNA, 1656 bp, Homo sapiens
tagcagtcaatggctctgacttaactccatggaggctgccatttgggcacagtgagttgcctttagtccagcttggttgtctcacttcctgcccaccatgaataggaaaagcaagagacttcccctgtgctcccttttctcaaatgccattcgagggacacattgtgaatgtttatgttaaattttttttaaaaatgccttgtttagctttaaaaatacgaagtaattttgcaatttttgaaaaacactagttttcctttaaacttaatttttcatgttgatcctgaagaatccgttaaaatggtagcacaagagtctggcaagttggtactgcagagaaaaggggttaattgaggcttgtttggagtcgggattcccctttcccaaacatgcgtctcgccacttggacagcagccatttgtactcgtatactttttaaactttttcttggaatactatattttatttgactggtagtctgatattactcctaacttgtcaaattgatctctttgcaggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcactctgtcttgtctgtgcttcagtgtcatgtggactgagtcttggtgctctgtgcccacctggggcctagggccacatctctggcttggcagttgaggctgttgcgtagatgtcttcagtcttccctccagtgcaactgaaggtaaactcgtctttggggccctggtggaagggctgtatgtcatttggctgcacaggacctgatctgaactgcctgtaactcattaagcacttgcacaaaacaaagggggaggcgccagtgccctcactgcatgcctgcatgtctttgaggccttcatgcttggctgggaaggtgccggaggcaagggaggtgtgatgaatatgtgggtttcttct

SEQ ID NO: 119102 - DNA, 8449 bp, Homo sapiens
aggtcggccaggagcgcgccggtaagagcctgggggcaaggggtagaaagacgcccacctcatcacaacccagagctcgggactcctatacagtcccatagggaacaggcggccgccattcccctcccccacgctggcgggtaaggctagagaacggtttcaaggaagacgcatgcgcatgaaataattataaaccgctaggactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgccgccatttcctttcctctacgctggctctcggcccgggcccccacggttcggggcgccgacagctgttgctcaggacagctttgggggtccggtcgccggacgaggaggtgttggagtcgccggggtgggtgcatccgcccggtttttgctccgtgggggggcggtgcgggcccgggcgcgcctcggaggcgaaggacagcttaattggcgctctcagttctggtcctccccgctttgcagtttgtttcgacgccggaccgcgtaagagacgatgatgttgggcacggaaggtggagagggattcgtggtgaaggtccggggcttgccctggtcttgctcggccgatgaagtgcagaggtttttttctggtgagttagaactaggacgcgggagttcgagttcgaggccggggcgggcgggctggcgggcggccgggctggggcggggcggggcggggcgggccgggccgggccgggccgggtgggacccggggcgccccctggcgaggcgcgggcgactacactcaccgctgtgctgctcgcgcccggcggcccgctgttacgcaatggaaatttcgaaagccccgcccgtcctcctggcccttgggggagtgcggcaggtttggcagactttgttttctttacctatctttgaacaccagcttttcttttatgggtgtctttttttctttttcttttgagttggagtctctgtcacccaagctggagtgcagtggcgcgttctcggctcactgcaacctccgcctcctgggttcaagcgattctcctgcctcagtctcccgagtgtctgggactagaggcgcgcaccgccacgcccggctaatttttgtatttttagtagagacggggtttcactattttggccaggctggtctcgaacatctgacctcaagtgatccgcccacctcggtttcccaaaatgctgggattacaggcgtgagccaccgcgcctggcccgggtgtcttttttcgaaaggataaattggcataggtgggatttcctcctcaatcttgagaaaatggccgagtgattagacaaataatagtaatgttttgcaatatcttgaagtgtaacctcttgtttccagttttggtgttttcttaaaaaggagcattcttcggaaagttaaaatgtcacgtcttaatttcagttttcctaatcaagatttgataattgaagagtgttttcttatctagttcttaatctggctcactatacagttgaagacactgaagcccagggaagtgtttttgcagtacataggtttcctgaatattttctatcagaatgtccttgttcctattattagactgggaaaaagaaattagactgattaaaattctatttggatgaaattaacagcttttggcaagacgtttgtagtattgacttactatctgaatttagcgttggtaacggaaagcgacctgtaaaacaagaaccaagtacgctggaagccgccttgcagggggcaacactgggtttggcttcagctgtgcaacttggagcattttagcttggtaacactgatcccctttcaggtgagtattgggcttgtaatttgaatttgaatgagaaaccgtaatgtggctactggtaaggtaaaacggataaatgccccagaccaaaacagctcgcaacgaagtatgtttgccgtaaagtcacacagtccaggcttgataatcttctgagaaattgataaaagatgtgtgatgtagacatgagtagcaaggactaaagagataaattcattctgaaactgctttgaatattgtatgttgttgatgggttggaaatatatcaccttaggaatgagtttgtttttttttaattggagttttaggagttggtaatatcgtggtcagtatatataggcttcacaagttatgtaatttgtagtggggacatggaatagacatttcatctgtgtcacccagaggtggttttaggttttaaattctgtattaacggttgttttctttccagactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaaggtttgatttacattgccctagttacagtaaataaagcattaaacaatagaggtctcaccccttctgaattttaggtatttgactgcatggaaatggtcatctaagggagtttgtggcagctcttcctagcttatctaaagacccaggaagtctgaactttgttatctaattttccaaaagtgactaattctaagcacctctttcagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcaggtatgtagtcatgtttgttgctgagcagtgagttttggctagcttatggcaaggtgatttaatagacgttaaagttgagtagcttaggtatttcagtaggttgtaaattgccaatgaattaatgttttcttcctagagaccttcaaataatttaagcccatcttaaaggtggaaatgaagtacttccaaaatgttaactttgcctatatttagtattatagttcagagtagatctttcattgaggattgccctcaacagcttaactactttcctcacattggtgtccagctaagtacctcaagttaaaggtaagatccctttaccagcagatcatcagtgcgatgaattaggttgttgtaaattatggcaagtgtctgtgttgcaagagacacgtatttgggtcatgtgaccagaagcatctaatggtctaattctctttaatgcaaaagtcggtttatgaaagacttggtttaacctgtgtggtataaacttactgaaaatcagatgtagtgagagtagtttgaatgcttgtagtctcagtatctgaaataagtgttttgaaattgttcctgggcctaaagtatttgaatgtttttatgctgaagagctgataagattgcatgtttaacaatgttagataagatatcgtatattttaagtattaatatttatgatgtgatacgctggaagcaggaaatcctttcatggtttagtgtagtatgttaaaaattgatatatgtatcgagtcctaatgtcagaatttttaaaatcaagtctgttttgttttgacactaaattggtgagaattgaatgctgtcaacgttaaatatgaacataatttcatatcttctaggaaagtgctttaagtcctttttgtaagcttgggaatgtatccacggaaaggatttttcatagacggaatttccagaagtgaatcataactactgttagagcataagcatgcatgattgtgctgtgtagatcagttttgttgaaagtttagattgttgtgtttgtcaattataatttaatgtttcagtttttatatgaaatgttgtaaatgtatacctttttaaaaacttgaagttccaataacttaaagcattgaaatataaaatgaggtaaaaggtgttttgaatttagtaaaactgttatttaatgcttaaaacttaattgaattgtataattctcaacattaagttgcatagatatgtgttcttaagttgttgaattcttaatgcatcctgtgttcagcaagttttttttaatatatactgtaccatgggtgtgttaagaatagttatactttataataatggaacttcatattattgcaatgcatatttaaagagtacttgttgaaagcataccattcacctaaagttaaaaattctggtttatttaaagctataagaagaatcatttctgggcttgtgatgttaatattgcccccctactggggttatttgtccttgggttgaagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtggggatggatggttggttggatatgtcacttttcttatggtaaacaattaaatccatattctctctgcttaaaagaagaaattaatgttttgtagtcctaggtaattgatgttttgccatgatttccaaacttgtgtcagtcccacgttacacgcaaactaaattttaggtttgaaatttgtccctagttaattggtctgcttgacaattttgtgagtcttattaaccccaatcaatagagttgagagactatggctttaaaaaattaatgcaaacctggctttagctgtaataacacccacctagaataaattaatattaccataagaaaatgtgatactttctgatcttgtttttaaagttgaaatgcaacaaactttttcttgctgtatataaatattctgcatagtattaataagcatagctttcaagaaattgtcacaaaaggttttattctctttgcttgtgactatttttcattgaagcatgcgcttacctatgctgattcttactaaaagcataggctggggtatttattggcgaaaggaaatgtgtagtgtgggctggactgttggtggaggctggctttttagcccacttgctatacatgctgccaatggatttaagacttgaaatgttgaaagttgagtggaattatttccctcctaaaacatttatttacagtactcctctctacccctaaggttgggctctgcctcagaggagtgagttttttttttttttctataaagtttacattgtcttactatttattgagtgaatttctggtcattgcctatgcaaatataagaaatctggctttaaatattagtcagtttcatggctatgactagattgttttcttgtataactaaatacctgtataaaatgaactaatgttttctctcccctccctaccccttccttatgaacaatgctttaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggtacgtgaggattcgtaaggttcggcaagtcgtctgttcctttgtctaggtgttttatttgattgattgtactttgtctttcaggctatggaggctatgatgattacaatggctataatgatggctatggatttgggtcagatagatttggaagaggtaaggtaagaattgaatttctcagttgaaggatgcttacactcttgtccatctagacctcaattactgtttttcaggaatgtctgatcacagatacggggatggtggctctactttccagagcacaacaggacactgtgtacacatgcggggattaccttacagagctactgagaatgacatttataatgtaagtgtgagatgaactcacaagtcaatatttcagtatggcagtaagtcagccttattctataaatgtgagcactatgttagaaattttaggttttttttgtaacgttagaaagttggttgaattctttgaaatgccttgtgttgtagtttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcgtaagtgtgattgagcatttgtgggctcttaacaggtgattgtgtgactaacatttacaatagagaaatggaaaaataaggatatatgagaagtttcctctccagtaatagattaattcttgggggatgcgggggcagtgtgttgaaggtttgggttttaaaaattagtataacggatttgtgatatgcacatcttgaagtgtatatccttaattgacaatacagatgaatatgtaaaggctagattttggagttaaagtagatcacctaagagaagtagctagaatttctttgccaaagtatttgaagttcacagatctgcttgtttaaaaactttataaaagtgcttattctgttttgtttcaccaacaaacattttcaaactttttttttctcatttcagaacacagatatgtagaactcttcttgaattctacagcaggagcaagcggtggtgcttacggtagccaaatgctaggaggcatgggtttgtgtaaatatcactttagtgtcttttttttaagctaaccttgtatgccttttctctcatttcagaacacagatatgtagaactcttcttgaattctacagcaggagcaagcggtggtgcttatggtagccaaatgatgggaggcatgggcttgtgtaaatatcgttagtttttttaaaaaccaaaacgtttatatctgtataagtcaattataagttaagttaatctatttatttaataagtttagcataagaaacttaggcaaagcagtttcttgatatttgagttttgtatctggcttacttaaatccttgtgagttatgaagttccttaggatagataattcaaattaggtttaagtagtcttgggggaggggactacggagtgaaactacttaaattttctaagtataaagtttaaatcaatagcaaaacaggattaagataaatgtgggcataattaggtgtattgacatgcctttgatgtatcaaactgagggggaacccactaaatccagtcaagcagtttcataagatcttcacaaaatgcctctacttacggaatcatgttgattttagtcctgctgatgtgtgtaccgttagcactttggtttatcaatatttgactggctcaaatgatggatagaagggtggcctggttatagacagtaggcagaaggaggcagagggttacagtaatgtaagatcaagactggaaaatgatagctatagaattacaagcccggtaccaccaggtaccacatcacataagaaaaaaggttctaatgttttcttaacttaacagcaaaccagtccagctacgggggcccagccagccagcagctgagtgggggttacggaggcggctacggtggccagagcagcatgagtggatacggtaaagcctgtttgttactgtacttagagtaagttatggtaaagcctgttcattactgtacttagagtaagttatggtaaagcctgttactgtacttagagtaagtcgcaggcaggtgcctttagttgggaagatgcaggctcctttcggtgaaattgggttatgaaatgtatgctttcaatccaaatgtaactgtttttactagctaattttcagaaacaatcattgggagggggaagtgttctttgaattaagaactagtcattgcagctttggaatactgtcgagccagaaaatatctgcctccatgtattaaaacattaaataaagttgttcacttttttgtcttttggttagcattaagtcagttttagacagagggagaatttgaaatagtagaatggtggttgggttcaggatcgtatttattagtcagttaacctaggattggttttat

SEQ ID NO: 119103 - DNA, 3742 bp, Homo sapiens
taggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacgggtgagggctactgggggttgggttggaacgccccgaaggcaccacagcaaccgacgcgggaacgcctgttaaaccagccccgccccgagacgcgcgcgcccggcggtctcgatccagcgtggcccgcccctcacctcccgcccaaccaacagccacttcctgcctcactcccggccaatcttcacactccacgaagaatagccgtagggggcgtatgggacggtgcgtagagcgatgcccacgccggccaaccggatgtcggggcttgcgcgggagggcgggacttggcgccggctgtggctactcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagaggtgagaggggagacctgagcgcgtcctcgggcctgtgaggacctcggggggctgggagcgcctctgcggctgaggggtcgggcgtggccggcgactgaggggtcgggctggctcttgagggcccaggccctggccgacgcgcccgccgtgagcgaggaggcccgaatccgggcgtctttggttgggttgcgggcccaggccgcgccgccggggtcgggaggcgtggcaggtggcccgacagccttctttgacctctgggaaagctgacttattcctatggctttgcttctagggctttcttaggcctctttgccggctgcctgggcagccgcgaggtgggctggagtaactgggtaaaagtatagggtggaatcgggcctactaggtacccctagtagtagggaagggtggtattagaccgagagggaatgtttacaactagcgttacagtttaatatttgaaaatccaaagcggagactggaccctagttccctgaagagaaaggggaatgtaccagaaggagaacacgcagtggttgagaaacttagcagttacagcacctattctggaggcgagtaatccagttggagagggacagggcgttaaaagcaggaaagcccccgaaagctcatctaagtgcatctctttccacaccggaggcctggaggtatgaaatgactggcccaaggtcatgcgattagtgtactgatggtgctgggattatagttcagggatagaccgtgcagtggttaacgctaaggccctggctcgagtctttgattggtcattggttgctctgtgaacttcggcagttttcttaccctttgtgcccccgttcttgtcaagtaatggatataataatacccgatggatttgtgaggattaaattaagatatgtatacaataagacagggaagtccgacatttagtaactgctcgatgatcattgcggtacgttattataatctgaatgcctttggaccaatacactgccatcctagtgaactggttcagtcctgtttcgcaggacctgaggtcacagttatggtgatagaagaaaccgggcattgtgtattaccgctgggcatgacacaagtgattgctggttgagggaagttaaactgagcttaatattaaaagattgagaggacaagattaaccatagttaagtctttttacctctgatttaggaaatggaagattttgcttaattttttaataagtagatttttttaagggggaagaattttattgatctttaaaatcattctgtatctcagtcttttcccaacattgtttgagggtcatgaatagaagcaactgccatatggatcaactgttgtacatttggtataattatacttagagcagaggtaaaggactatgtgggagttctcctgtgcatcagccagggtgcacacacaagccaggtaactggatcatgagaatgctcgagtgaactgtgtgtgggggtcagtgttgcacaacagaaattttctgacttatctgcaaatggctgtcagcattccccgacaccttactatccttactccccagttcatttagcgcattatcttctcagggccacaagggataagtgttttgacagaagtcgttgctgccgttttggcaatcacactattgcatccttttagttagagttctctttgccctggaagacagcttaaggggatgaagtggcagttggtgagcatgaattgcaggctcatgaaacttgaattgtgtgcccagtgtggtaaccttttttttttttttttagacggagtctcgctctgtcactcaggctggagtgcagtggcgcgatctcggctcactgcaagctccgcctcccgggttcacgccattctcctgcctcagcctcccttgtagctgggactacaggtgcccgccaccacgcccggctaattttgtttttgtatttttagtagagacggggtttcaccgtgttagccaggatggtctcaatctcctgacctcgtgatccgcccacctcggcctcccaaaatgctgggattacaggcgtgagccactgcgcccggcccagtgtggtagcttttgtcccactttggtttccgtaacttcaaaataggaatgagaagtctcctgggttcctcacctttagggggcaattgggaggggcagataaaatggtgaacatgaaactactttaaaaagtgtaatgaattggctgggcacggtggctctcacgcctgtagttcgagcactttgggaggctgaggtgggcggattacttgaggccaggagttggtaaccagcctcgccaaaatggtgaaaccctgtctctactaaaaatacagaaaattaacctccagctactcgggaggctgaggcaggagaatcactaaacctggaaggcggaggttgcagtgagcggagatggttccattgcactccagcctgggtgacagagtgagactccatctcaggaaaaacaaaaaaaaaagtgtaatgaactgtgcaaatagaatacgccgtttataataactcctaggaaataataaaagtacctaaacagttaaaacctatacagcttttggtaaaacttttcaggaaagtcctggttgaattctttgttactccaacagatgtactttttttttttttttttttttttttttgagacggagtctccctctcaggctggagtacagtggtgtgatcttggctcactgcaacctccgcctcctgggttcaagcaattctcctgcctcagcctcccaagtagctgggactacaggtgcccaccaccacacccggcccggttttttgtattttagtagagacggggtttcaccgggttgtccaggctggttgcgaactcctgagctcaggcagtccgcccacctcggcctcccaaagtgctgggattacaggtgtgagccaccgcgctcagccttacttatttttttagagacagggtcttgctcttcatcaggctggagtgcagtggcgtggttattgctcactgcagtctcaaactcctgctgttattggttcaagtgatcttcctgcctcagtctcctgagtagctggatccacaggcggatgacgctacactcagct

SEQ ID NO: 119104 - DNA, 2882 bp, Homo sapiens
gagctcaggcagtctaccagcctcccaacgtgctaggattacaggcgtgagccaccccaccctgcccaacgactcacttagcttcaacctgtcagactcaggcttctcctaccttagccttcttagtatctgggacaacaggtgtgtgctaccatacctggctaaatttttctttttttgattttttgtagagacaggataatttttttttttttttgtatagacagggtcaggctatgtttatgttggccaggctgggaaataaggtcttaatagaggaagttgaagattcctgggggaatagcatgtagagcagctatagagggagagggtgctgattactagctaaaagacttagaaatttttgcaaacatggactcatgatagtttttgggtgatgagtcttcttgtaggatagcttgaaagaggaggaggaaactagaggccctggtaatataaggtaacattaagtatcctgatgtcagtaatggagaagagtgaaagactatgattgattgggtgactgtgtgggcagaggatgtgaggagaaaaggacatcttgtgtgtgtgtgcgcacacatttttagttgtgtatcttctacttgttttctcccccaccttgtacctgtactttctcaagcccaaaaatgaaaatttacctgctaccaaccacatcatcttgtgcatctgtgtagctcagtttttatttctttagatctgtggtcctccgtggaaagagagccactaccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtggtgcacacctgtcatcccacctacttgggaggctgaggtaggagaatcacttgaacccaggaggcggaggttgcagtgagccaagatagtgccaatgcatcccagcctggcgatagagcaagactcatctcaggaaaaaaaaaaaaaaggagcttgttttggccaggtgcagtggctcacgcctgtaatcccagcactttgggaggctgaggcaggtggatcacctgaggtcaggagttcgagaccagcctggccaacatggcgaaaccctgtctatactaaaagtacaaaaattagccgggcatggtggtgggtgcctgtaatcacagctactcaagaggctgaggtgggagaattacttgaacctgggaggcggcggttgcagtgagctgagatggtgccactgcactccagcctgggcgacagagggagaatccatcacaaaataaataaataaaatatataaattttaaaaagtagcttgttcttagtttaatattctttttgagttctaaaacgctaatttgaaaacatgtctattgatgatatttgagcaaccgtatccatattaagccttaatatgagaggaattatcttctgtgttaatttttttttttgagacgaactcttgctctgtcacgcaggctagagtgtagtggcgtgctcactgcaacctccacctcctgggttcaagcagttctcctgactcagcctcccaagtagctgagactacaggcgcccgctatcgctcccagctaatttttgtatttttagtagagaagagtttcgccatgttggccaggctggttgtgaactcctgacctagtgagccacctgcctcggcctcccaaagtgctgggattacaggcgtgagccacggcgcccggccatctctgttatttcattgtaatgttttaacgggtaccccctgtaaattagtgtatgaaagggcttttgtctgttgtaaagcactttacaaatgcaaaagtttgttggaaattgtatttgaatgccccacatctgtgtaaccaatcctctctatatgaggatgttgtgtatgtttcagttttattttgaaattttccagaaatggaatcttttaactgattttagggaaaccctttaatctctctaggctgcctttctttatctatgaaatgaaatagtaagttctttttagctctgcgatttaaaagctttaattttaaatgagagagtggttagtgatcttcatgaagtttgataggtggcaatacatttaactgattttgctctttatgtgtagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggtttgaaatggtctttgaatctattccttttacgtcttgagatgataaaattatgaagatacccgggtgcagggaaatgtagtctcaactactcaggaggcctaggacaggagtgtgagtccagccttggcaacacagggagatatcatctctaataaaatataaaagaaaaacatggtgaagataaatttggaacgttttcaaagggaaagcaaaattcgtgaaaatacttattgatctctctggcagcctttgtcttgctagaggccaattatatgggttgaatttgaaggccagctatgaaatttttgtgacagttgaaagcaaaccaggagaatagattctagataaaaaggcatgttgctgaaaatttaaatttttaattcatttatgtatttaacacaggttacttacaaagctccagttccaacaggggaagtatattttgctgattcttttgacagaggaa

SEQ ID NO: 119105 - DNA, 1323 bp, Homo sapiens
catgtaaataagatgggatagtagattcctttttggatagcatcttttatagtgaaatgtctaactttattttattttatttatttattttttgagacagaatttcgctcttttgcctgggctggagtgcaatggcgtgataccggctcattgccacctccgtctcctgggttcaagtgattctcctgcctcagcttcccaagtagctgggattataggcatgcgccaccatgctggctaatttgtgtgtgtgtgttgttatttttttagtagagatggggttttgacatgttggccaggctggtcttgaactcctgacctcaggtggtccacttgccttagcctcccaaattgttggcattacaggcatgagccaccgcacctggcctgaaatttctagctttaatatcttcagtgttaacatccatgcaggaaaatagtcttttggaatttgtggtttttacttccacttctttccctcccccactctaccctatattttgttctttgattgaggaaaaaaattttctcttgatgttaaaacatcagtggaattatctcataggtttggtactttttcatataggtttgtgagttgaagataatgtattatcattagttgtgtgacagatttaaaggttggaagtagagtggttaaataggctaagagcagaataggtcctactttaatgagtatttacataattttccctcacaagtcaactgtcattttaagactgattttgggatttgttatttacaggtggattttatccaaagccaagaaagacgataccgatgatgaaattgccaaatatgatggtgagaatcccatttggtttagatataatagcagatagaggtttgacatgttgtctccatggcatttcctaagactagtttaaaaggacatagtaggctttaagatttttccagccaggtgcggtggctcacgcctgtaatcccagcactttcggaagccaaggcgggcagatcacgaggtcaggagatcgagaccatcctggctaacacagtgaaaccccgtctctactgaaaatacaaaaaattagctgggcgtggcagcgtgcatctgtagtcccagctgctggggaggctgaggcaggagaatggtgtgaacccgggaggccaagcttgcagtgagccgagaacgcgccactgcactccagcctgggtgacagagcgagactccgtctcaaaaaaaaaaaaaaaaaaaagatttttccatggaagttttgccacctttgtgtgttgcctaattttttttttttttttttttttatttaaggttcaggggtgcatgtg

SEQ ID NO: 119106 - DNA, 2824 bp, Homo sapiens
tgaatgttggaaatttctagacagtagtataatacactacagttttaaaaagccatatctgaataatatttgccaaataaagtgtgtttatttattatttatttacttttttgagacggagtctcattcttgccacccaggcttctggaatagagtggcgtgatcttggctcaccgcaacctctgtttcttgggttcaagcgattctcctgcctcagcctaccgagtagttgggattacaggtgcccatcaccacgcccggctaatttttgtgtttttattagagatggggtttcaccatgttggccaggctggtctcgaactcctgaccttgagtgatccgcctgccctcagcctccctaagtgctgggattataggtgtgagcgaccacggctgccccagtataatatatttatgcaactaggaggtgttttttttggcatttaaaggaccttcagaggtagagttaagcagtggaacttttttgtgttgtcttgtaggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtaagtgaaatgcttgttggataaaagctttctgcaaagggtaatcttagaagacattatgtaacttttactctatgttaaaaaattatgagattatataagtggtggtagggatttttgggtgaatttaaacaccttgtaattaatagtttttcctggctaatgcattattttgaaagaaactggttacttattttcctgactctaaataacttgtagattttgcagaacaaatttaccggaaatctgcattaatagtttttgtaattaattaattacaaaactagtaattaatagtttttcctgcctaatgcattattttgaaagaaactggttactcattttcctgactctaaataacttgtagattttgcagaacaaatttactggaaatctgcattaatgttcaatttaattttatttatttttgtggcatttgataactattcaaaaacaatagaagatggaatcctttgtaagggtaaacatttgacctatgataaaacgtgactaagatgagggagagaggaaatacattaagagagtttcgatctttcaaaatgccatacagttttctgcttttctctctgatattaggtatgaggttaatttccaaaatggaatagaatgtggtggtgcctatgtgaaactgctttctaaaacaccagaactcaacctggtatgtaattcccatttctggaatgtggctggacacccactattaccttgtaagaattttgtaattgggccgggtgcagtggctcacgcctgtaatcctagctcccagcactttgggaagccaaggcaggcggatcacgaggtcaggagattgagactatctggctaacatggtgaaaccccatctctactaaaaatacaaaaaattagccaggcgtggtggcaggcgcctgtagtcccagccacttgggaggctgaggcaggagaatggcatgaacctgggaggcggaacttgcagtgagccgagattgcgccactgcactccagcctgggcgacagagcgagactccatctcaaaaaaaaaaaaaagagaattttgtaataattgtgaaaataaaggcttcctcccctgctgtttaactcttttgatgagttgggaaaattgactttgacgctaacgtgctttttatttgaagtgtaaattacaaagttgttaccaactgtttttatctgaatttctggttttgcttctgtgtaagttttagttttggcaagcttatttctttgttttatgaggaagcaataactgtctagatgtgtgcattacttttttttagacacttaaacgttattttaaatttactgatgattgctggttattcctttttactaaacaaacttgtagttagcttttcctttaactgtcactaatatatttggaattttataagaggaattatcatacacttttgaaacgttgcttttgaacactttgagtacagtgacttcaaataatccttttttgtttttgaaggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaagtaagaaaaagcattagtttgggggcttatggtattacatatatatcatccatttaatttaaagattgtatatctggccgggcactgtggctcacgcctgtaatcccagcactttgggaggccgagatgggcagatcacctgagatcaggaattcgagaacagtctggccaaaatgttgaaacttcacctctactaaaaatacaaatattagctaggcatggtggtgcacgcctgtaaccgaagctagttgggaggctgaggcaggagaattgcttgaacctgggagggagccaagatcattgtgccacagcattccagcctgggcgaaagtgagactcaatctcaaaaaaaaaaaaaaaggctgggcgcggtggctcacacctgtaatcccagcactttgggaggccgaggcgggtggatcacaaggtcaggagatcgagaccatcctggctaacatggtgaaaccccgtctctactaaaaatacaaaaatattag

SEQ ID NO: 119107 - DNA, 1187 bp, Homo sapiens
ttaaaaagtagaaagtagaatcatgagtggacatgcgttttaataaattggaggtttgtgtaatttcagtaacgtaataataccagctctattaaaaatgaagaaatggaccttttgtactgggaagtagttgtaagtccacgtatttgtcttctcactggtgtatatgtgtaagcccaataattgtgttagtttatgtagtttcttgttttttttgttttttttttttagtgtctataagtcaagtctttggtgttaaagattttaactatcatttgctgtaattcttagaaagccgagggactaatcatttatgtttcgtgcataaggaaatgggcgttagcttccccaagaccccaggagccaggcattgttcttaccccaaagcctcaggtcagacttctgctgcttcacgttagaagtcatgatcttttgtattatggtaaagggagcttggaaaattaagtacttttaattccatttaatgtttctttcagtcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactggtgagtcttggggaactgtcttcaagtgtaagggagcatttcatatattccatgtggcttgaacaacgaaatgttggttgagtaagctctgataatttcagtaatccatgatgcagtctaatctgtagggaaaatatagagtactatagctggaaaggggccatagtgtaatcatctggattgactcaccattttacaagccacagaatgccacacttgataagagtttgtctgtggtgacactgttggtttgtggcagaatctcaggtcctttaacctggctactccagggcttctgtgaactcacatttaaagccaaagttctgaaatgctaaattttaatttgaaaaataacctttttcctatttaaacaacagtcaattctctgctgtgggttgggtggtagaatacaaagccacaaggacaccaccatctgcctacacagagcttgaagtccagttgtgaggcatgatgttggcatgtggtatcgtaagggttca

SEQ ID NO: 119108 - DNA, 2262 bp, Homo sapiens
attacaggcatgagccactacacctggcttaatttttgtattttttggtagagacagggtgtcgtcatattggtcaggccggtcttgaactcctgtcctcaggtgatccacccgccttggcctcccaaagtgctgggattacaggtgtgagccaccgcacctggccttgtgtatttttttttttttactagagactgggtttcaccttgttgcccaggctggtgtggcctcaagtgatcctcctgccttggcctcccaaagtgctgagattacaggcatgagccactctgtctagctatagatatatattttcatttctcttgggtatatatacctaaaagtggaattgctgggtcatgtggtaactaactttttgagaaactgccaaactgttttccaaatgagcagtaccattttactttcccaccagcagtgtatgagggtttcagtttctctgcgttctttccagcatttgtttttatgagtcttttttattagagccaacttggtactaagtggtatcgttttgatttgccatttccctgatggctaatgatgttaagcatcttttcgtgtgcttattgtatgttcatattgtatatttttacattcgtatgtcttctttggagaaatgtctattaaaatcatttgcccatttttaaattgggttgtctttatattattgagttgtaaagagttattttactaggcccttagcagatatatgatttacaagtattttctaagaggaattattttaaattttgagattaaaaacaaatttttttagaatactctgttctgatccacaaagtggtactatactgtgaccagtgttgtcataactggctttttcttttgtatttaagggatgaagatgcccctgctaagattccagatgaagaggccacaaaacccgaaggctggttagatgatgagcctgagtacgtacctgatccagacgcagagaaacctgaggattggtaagaacttcagttaactttttttaattacctggtttttttgtttgtttttttttttgagatggagtctcactctgtctcccaggctggagttcagtggcgcagtttcggctcactgcaactttcacctcctgggttcaagtgattctcctccatcagccttgcgagtagctgggattacaggtgtgtgccaccacacccggcaaatttttgtattttttgtatttttagtagagacggactttcaccgtgttggccaggctggtctcaaagtcctgacctcaagtgatctgtctgccttggcctcccaaagtgctgggattacaggcgtgagccaccacacccagcataagttacctgtttttattgaagtcaatcttaatacttaaatatagccaagttccctaatttcagggtagaatttgacaattttaattatattttcttcttttttaaaaaataaatttttcctgaaaaactgttattactggaaatacaggagaagctggtctgggatactgtgaaaacatttcagcaggatcttggcagccctgggccagccagctgttcatagtcctgcatcacagaacctgtttataatttgttgtttgtacctccgtagggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccaggtttgtgcctcttgatggttgagttgctttcattaatctgtttgtattcagatagaagttttatctagagtaaggctgccaggttggtcattatattcaagctgttgaattaaaagcagaaagtagacttcctaagttgaaagagagcttaatgggttaggtattgcaaagataaacctagaaactggagtgaataactttctttaactttatttatttatttatttatttatttatttttgagatggagtttcgctcttctacccaggctggagggcagtggtgtgatgtcgcctcactgcaacctctgccttccggtttcaagcgattctcttgcctcagactcccgagtagctgggattacaggtgcctgccaccacgcctggctaatttttatatttttagcagagatggtgtttcaccatgttggccaggctggtctcgaactcctgacctcgcgatccgcccacctcaacctcctaaagtgctgggattacagg

SEQ ID NO: 119109 - DNA, 2978 bp, Homo sapiens
ctcctgttggtggccatttaggtggattgtcacttttgctttcagagtcactgctgctgtaataatccttgtacatgtctgggtgtatgttgtgagtatttctctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttca

SEQ ID NO: 119110 - DNA, 1081 bp, Homo sapiens
tccggaggctgaggtaggagatccacttgaacctggaggcagaggttgcagtgagccgagatcatgccattgcactccaacctgggtgacaagcaaagtcgatctcaaaaaaaatagtggccgggcgcgatggctcacgcctgtaatcccagcactttgggaggccaccgaggagatcatgaggtcaggagatcgagaccatcctggctaacacggtgaaaccccgtctctactaaaaataaaaaaagttagccgggcatggtggcaggcgcctgtagtcccagctattcagaacactgaggcaggagaatggcgtgaacccgggaggcggagtttgcagtgagccgagatcgcgccactgcactccagcctgggcgacagagcaagactctgtctccaaaaaaaaaaaaaaaaattgtagatctagagatgtgttctaatgctaatatataatcaccaaaaataataaggttttgctcagttgtttaacttctgtcttagaagagaaacagaaaagtgatgctgaagaagatggtggcactgtcagtcaagaggaggaagacagaaaacctaaagcagaggtaaaggaaaggggtcacacattttgttttaccaagctgaaggtacatttatgtaaagggaatattttaatagggtagtttacagtggcttatggcagtaaaaattctgttaaagccaattttgttgaagtgggattctttgtgatacaggtcagtgttttgtttgataattttaagctacatattaatctcagaagtatctttttagctgaaaatcattttctgaaataagcagaaggttatagggggaaaataaaatgcttgctaagaaggaaacttcgggtcattaacagtctatttgcctctcctcactgtgccctgaaaagtatttcttatacaaatcactgtgttctaaactttttgtccccgttgtccatagatgggttcattcattcatttaactgacatttgttgagtgcccattttgtgccaggcattgtcagtgagtaagacagacaaagatactctgcctttagggagcttaaattctacttggggga

SEQ ID NO: 119111 - DNA, 2858 bp, Homo sapiens
aactccctcacacgttaaaaagttgctggtgcatttaaaaaaagggaatattttcatagggtaatttacaatcttagcaacttgtgatagagtacagagcagcagccttggagtcagtctacttggatagccttccatcttcatgaatccttggtttcttatcctcagaatggggctagtgtgccataggccagtagattgtttgggattaagcaagattaagaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcat

SEQ ID NO: 119112 - DNA, 1068 bp, Homo sapiens
ctagttttagtactaacactgtttgattgctccagtccctctactcccctttgcctattagttttaataatggggcataatttgtcttggtttggttttgttgagtaactcagttttacctaaaggactgtttttggtccggcgcggcggctcacgcctgtaatcgcggtactttggcaggccgaggtgggcggatcacctgaggtcaggagtgggagaccagcctgaccgacatggagacaccccgtctctactaaaaatacaaaattagccgcgcgtggtggcgcatgcctgtaatcccagctactggagaggctgaggcaggagaatcgcttgagcctggaaggcggtggttgtggtgaaacgtcgtcctttgcatttccagttccctctaatggagctgcactcttgcatgcttttgctcacatcttctggactttttttttaagtagtgagtaatactgcacttttgaaacttgctcgggcttttacaaataggtggaaactaccagtgattcggaatgttgcaagaggaaactaccagctcactagacgattctgaccaattatggggctggatacaaggaataaggtcaaagtaaaacggctgacattaaaatagcgtggctacttagagtttatcaaagtcgaaatttaaaaaataatttaaaaaaaaggtctctgtactgccaggcgggcgacagggactggccagctgcgccgcactcgcctgccagattccccttttctcggggtagccggaagggcctgccttcagcgggtgctgtgcaggaaaccaatagccgcctcttggacgggctcctgtcagtcacgcttagctccgcccccaggattaaggcccgcccaggggcttccctccgcccttcgcttgagaattccttttaaataccgctctggcgcccgagcgcgcctcttgcgtgctcgtccccacgccctcgggcggccggttcttccttctctgattggccagggcccctgctcatcagtcgtgatgcacaaggtctcttaccgaggccccgccttcttccgagaggcccgaaaacaatt

SEQ ID NO: 119113 - DNA, 1925 bp, Homo sapiens
gtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacggtgagtagggcgcgggaaggcgcttgtcgtggcggcagccccctctcccgaaaacgcttcctctgacgcggatcgggccgctgggagacttccccaggcgtccgcgactcctggatctggctggagagagggtaacatggcagggagctgagaggttgtcatctttgggaagtggcacggtggcgttactttgggaaaacagcgccttgagggccttgcaggaggcccgacctgggaaggctggcgaacgctaaccggagggtttttcttccagacttgattccgggatgttgagatctttattcgaaatagactagcattcgagtcgcctgtgatggagggagttcctgcaccgtaggcctggcctcatttattctgcaaatgtttattgggtccttgccctttacaagatcctgtgctgtgagcaggatcagggctttcatgtggaaataagtcggcctttggttgaccaactgaaactcctctgaatggaaaatcaagaaatttttggaaaacttagtaaaatgttcaatgagttgcatataagtattccttgtttaggtagcctgaactttgtgaacttgagattcctgcaatattgttgacaattctagttttaatttatcaggcctgtttaaaatctctgatgatgttagattgttggtcaattattactccctttgggctctcagtaaatgttcctgaaatttgttggttagaggtttttcttcctgaaacagatttacaaaagagacaaggtttttcagtggttttcttggggattttagtttaaaaccaatgttaaaatctaatttgttatgtgtatttttaaattcatacctttattatctctcacctgggctattgcagtgcctgtccctagctaactaaccagtctgtaggcatttagtttctttctcccttattctcgaaatgctggaaatccttctcttgcttgaaaggatgaagttcaaagtctttagtttggcatttgggaccagtctgacctaacctatcttttaatgtccctcacaggtcctctgctctggttgaattatttttctcattctcttccacactagcctcgattgctgggttagaagaaaaaaaaccactcagatttcattgcttattgtatcaactggtcaagccttctcatcttcacttttctcatctgtaaactaggggcatgttgggcttattatcgccccgtgttctttccctgccctcccctcactctgtcgcccaggctggagtgcagaggcacagtcatgtctcactgcagcctcaaccttcctggctcaagactcctcaatcctcccgcctcagcctcctcagtcctcccgcctcagcctcctgagtaactgggatcaaccacagctgcacatcaccatgcctggctaaataaaaaaagttttttttctgttagagatggggtctcactatattgcctaggctggtcttgaactcctgggctcaagtgatcctttcttccaacttgatctctgaaagtgctgagattataggcatgagccaccgcaccgtgccgcccccaggattcttttaagaataaaaagaaatgagtgtggacatgaaaatacagtatttcgggg

SEQ ID NO: 119114 - DNA, 1054 bp, Homo sapiens
acaggtgctggccaccatgcccagctaataatttttgtatttttagtagagatggggtttcaccatgttgaccaggctggtctcgaactcctgacctcagataatccacccacctcggcctcccaaagtgctgggattacaggtgtgagccactgcacctagcctatttatttttttttgagacagcgtctcgccctgtcacccaggctggagtgtagtgacatgatttctgctcactgcaacctctgcctccccggttcaagcgattctcctgcctcagcttcctgagtagctgggattacaggcgcacactaccacgcttggcttattttggtatttttagtagagacagggtttctccttgttgggcaggctggtctcgaacccctgacctcgtgatccacccacctcggcctcccaaagtgctgggattacaggcgtgagccaccgcgcccggcctatgctatttatttttagcacatggtcacttgttactttaggtcgcatcttttcaactagactgtcagctcttggaggcagggagggctcacacttgggtagtacacatctgaggtgcatcttaagtgcctgtttgttgaattattgatagaaacttggtagtgctttactcagtaatctctcctcctatacactaacttcaaaaagcaagttgatgtaacttcatgagccacctttcatggctcatagtaacaactcttgtaaggagggacttttgttatttttttttagggagtttcgctttgtcgccaggctggagtgcaatggtgccatcttggctcactgcaacctccgcctcccaggttcaagcaattcccctgcctcagccccccaagtagctgggactacaggcttgtgccaccacgctcccctaattttttgtattttagtagagacggggtttcaccatgttggccaggatggtctcgatctcctgaccttgtgatcctcccgcactggcctcccaaagtgctgggattacaggcatgagccgccacgcttggcctgtgtaaggaaggacttttaagagtagttc

SEQ ID NO: 119115 - DNA, 1056 bp, Homo sapiens
ctcccactctctgcctctttctctctctctcagacttttattctctgaaccacctgagagtatgctgcacacctcatagctctctgctgccaaaccaccccatgtgtaccttttaagagttaagaaagctgttaattttgtagaccaaactcttgtaagaattatgaaataacaaattatttccaggaagtagatatttctgaatataaaacagatactgtactgtaatcatgtggggcattagtttttttaaaaagatgatcagtgtggctttaggatctcatttcttcctgtaatgcctgagaccttgtctagaaccctctttccttttttgtcttcagtatctcccttcccaactgagtctttcccttcagcttgaaattatgaacaaatattctccacactgacaagtcctgtgttttctcactgtcaaaatagtattccatattcttctttccctttgcccttcccacttgaacttctcatttactcattagcctatggtaatatgccttctacctcttctattactctgaagttgcctccgtaaaggacaccaaggatggacttgccaaatttattggcatcttttttttttttttggagacagggtctcactgtgttgcctaggctggagtgcagtggcaccattatggctcactacagcctcaacctcccaggctcaagtgatcctcccaccacagcctcctcagtagctgggactacaggcgtgagccaccacacccagcctcattggcatcttagtcatcattcttcgtgacttcttccttttcttagcttctcctctcttctgatttccttttcagctttctgactttttttctcagtctccttactattttcccttattaattcatgcagcaaatatttgagcacctgctgtgggccagagtacaatcagccctccgtatctgcgcattctgcatctgcggattcaaccaactgtagatagaaaatattttttggaaaaaaaagtaaaaaaataacagtacaacaattaacacaaattataatatgcagctcagcatggtggct

SEQ ID NO: 119116 - DNA, 1062 bp, Homo sapiens
aacacatggttaaaataattcaagtgagagatatgtgtgttaatgaatggagagaagtgggtgggttcaagaaatattaaggaggtagactctacaggacttgggtaccagttgtatgtagggactaaggaggagcgggagggaggctggtttctggtttatgtgacagggcggctggtagtgacagtcttatgtgggaacagaggaaaggaaacaggactggggagaggctggcctcagctttggacagatgtcatctgagtcatcactcaagtggacaggggctcagtaggtcttcggatagacagaagtaagagctctgcagaggtggggcatcagatggcacatttattcacagacacttatcaagtgctgggcactgtcgaaggcactggggtctctgcttggcattctagtgtcgggttaggccctgacactagatgagtgcctctggtgaggggatcagcaagaaagtactatggtgtgggtggtaggtgatgtggatgatggaggagataagccacctgaattagaagctgagtcatccccagaaaagttagagggaagaggtgctctgggcaaagagaagagcaggtgcagaggccccaggcagcactgagcaggcacatttgagaagctataagctgtaagccagccgcatgaccccagcatgctgcacagcagggagggctatgagggaagttggaagggacaagggctgagtggatcagcgtttggttcccagacagttgggtttatttgagtgtgatgttcagtcatgggaatttgaaggcatgggaatgtgtgaaatctctcaggtagactatgtagagtaaaagggggagaggactgtactatttgatagaagggcaggagaaggggagacttctcaaaggatactagaaacaaccaaccataaaagcagaagaggatacaagaaaagtggtaaagaaaaagggaactttaaagatggaagcaggccgggcgcagtggctcatgcctgtaatcccagcactttgggaggccgaggtgggcagatcacaaggtcaggagatcgagacc

SEQ ID NO: 119117 - DNA, 1102 bp, Homo sapiens
tcaaactcctgggccgaagcgaccctcctgcctcagcctcctaaagtgctgggattacaggtgtgagccattgcacctggcctccttccatcttttttttgagacggagactcgctctgtcacccaggctggagtgcagtggcgcgatctcggctcactgcaagctccacctcccgggttcatgccattctcctgcctcagcctcccaagtagctggactacaggcgcctgccaccacgcccggctaactttgtttttgtatttttagtagagacggggtttcactgtgttagccaggatggtctcgatctcctgaccttgtgatctgcccacctcggcctcccaaagtgctgggattacaggcatgagccactgcgcccggcctgcttccatctttaaagttccctttttctttaccacttttcttgtatcctcttctgcttttatggttggttgtttctagtatcctttgagaagtctccccttctcctgcccttctatcaaatagtacagtcctctcccccttttactctacatagtctacctgagagatttcacacattcccatgccttcaaattcccatgactgaacatcacactcaaataaacccaactgtctgggaaccaaacgctgatccactcagcccttgtcccttccaacttccctcatagccctccctgctgtgcagcatgctggggtcatgcggctggcttacagcttatagcttctcaaatgtgcctgctcagtgctgcctggggcctctgcacctgctcttctctttgcccagagcacctcttccctctaacttttctggggatgactcagcttctaattcaggtggcttatctcctccatcatccacatcacctaccacccacaccatagtactttcttgctgatcccctcaccagaggcactcatctagtgtcagggcctaacccgacactagaatgccaagcagagaccccagtgccttcgacagtgcccagcacttgataagtgtctgtgaataaatgtgccatctgatgccccacctctgcagagctcttacttctgtctatccgaagacctactgagcccctgtccacttgagtgatgact

SEQ ID NO: 119118 - DNA, 1048 bp, Homo sapiens
gggcgcgcgccgccacgcctggctaatttttgtatttttagtagagacagggtttcactatgttggccaggatggtcttgatctcctgacctcgtgattcgcccgcctcggtctcccaaagtgctgggattacaggcgtgaaccaccgcgcccggccacaaccccgttcttcacacgccatccacagctcttccctatctggccggaactagctcttccattttatctctaaccagctggccactgtctgcatatcccggccacggccagtctctgaaagttccccacacagatgcctttttctgactctgcctttgcacacacttgcctggaatgctctttttccccaaactgttaaattgctaaacttctgtgcttttaaacctagtggattcatcactgtctctctcaagccttgcccaaggcttcccagatgccagggcttccagcctgcaccctgcagcctgctggccaggcgcgccccatcgcgccccattgcgccccatcgtgccatgtgctaactttgcctcccagaggcggatcttgcgttgggtccacctcagagtccccggtgcccaccacagggtccccacagagcagaaatttggtgggtgcttgaaagttagatgaagtaggtcactggttttctctcccctggggctttgcccttcctctgtgcctttctgaaccccatcattgtttcagagaccaggcctccattccacctgtggaaggctttctgccccatggcccccggggccctcttcccagtgtgccgtgaacgtgagacttctggtgctgcggctcgagtctcagagggacccagtggtggtcgactcctgactgccagactcttctctgtcttgtagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaa

SEQ ID NO: 119119 - DNA, 1004 bp, Homo sapiens
gtctgccgtggaatgtgggcatgtccattggtggcctgtggcgggggctgggcaactatctgggttatgccagaagccatgccatagaggctgctctgaggcatgttttgggagccagggaactgagccacaccccggtcctgttggcctgagtttgtggggagagaggaaactgaagcatgtccagggcccattggcatcagattcccagcctgagggaacactcgaggacagctggagttggatggacccaaggtgttcatgccgggcacggcagcagaggaccctacaagacagagaagagtctggcagtcaggagtcgaccaccactgggtccctctgagactcgagccgcagcaccagaagtctcacgttcacggcacactgggaagagggccccgggggccatggggcagaaagccttccacaggtggaatggaggcctggtctctgaaacaatgatggggttcagaaaggcacagaggaagggcaaagccccaggggagagaaaaccagtgacctacttcatctaactttcaagcacccaccaaatttctgctctgtggggaccctgtggtgggcaccggggactctgaggtggacccaacgcaagatccgcctctgggaggcaaagttagcacatggcacgatggggcgcaatggggcgcgatggggcgcgcctggccagcaggctgcagggtgcaggctggaagccctggcatctgggaagccttgggcaaggcttgagagagacagtgatgaatccactaggtttaaaagcacagaagtttagcaatttaacagtttggggaaaaagagcattccaggcaagtgtgtgcaaaggcagagtcagaaaaaggcatctgtgtggggaactttcagagactggccgtggccgggatatgcagacagtggccagctggttagagataaaatggaagagctagttccggccagatagggaagagctgtggatggcgtgtgaagaacggggttgtggccgg

SEQ ID NO: 119120 - DNA, 1077 bp, Homo sapiens
tagctgggtgtggtggtgggcacctgtaatcccagctactggggaggctgaggcaggagaatcacttgaacctgggaggcggaggttgcagtgagccgagatcgcgccattgcactccaatgtgggggacagagcaagactccatctcaaaaaagaaaataaaaaaaaagtttttttggtcaaaagttacacatgcaaacactacgtggcacatttgtagttaagagaaatgtaaaggtgcagtataaatatagccgcagcctgaaagacgaggccaaatgactgcaggtcctgaagcccagcttgcagcaggtcagcagctacagctgcctccatggctagttatgaatttttttcagggcaaatgatgggagggttggcacataagtgggggaggaaaaatatggaaacaaatactatgaagacaacaagcaacgtttggctaccactgatgggtcacatatactgaaatgagtgacaaaaacattctgggatgtggctggaagcatggtgcctcccaagtggcatcctctgcttcactcagactcatgatcctccaacaacaaaaccacctcctgctcgcagattctttggacaaaccataagttaagcgtgagtggcaccccagaacaatatgtgccattttctaccactagaaagaagacaggagcgggtcccatcttcaaaacctgacaagcaaagacaatgaaaaacagtttaaacacgcaaaatacagggcttttcatggcattgcactttgcttaccattaactggattaaaattgtttgacaaaaaacttataactgcatacagttgaccgtagcacatactgtactgccctgctgatctcacagccatctcctgtagttactgcagtggacttgagagtggcgatgatctgcttaaagcgccatgcgtctcatcagctccaagggagcagtttgtccctccagtaaattgtagatcacagtaaaaagggatctctcggctgggcgcagtagctcatgcttgtaatcccagcacttggggtggccgaggtcaggagatcaagaccagcctagccaatatggtgaaac

SEQ ID NO: 119121 - DNA, 1096 bp, Homo sapiens
cctagatcccggacacagatgtagtgccagggagcgatggtggccgcgtcctcagactctgcccactcagcctccttcctccctgaaacctgccccacagggcctgcctgaagggtgggatgcagcccaccacgcaggggttgacgctggtgccagtgggctgtgcccagggtgtctgtgtgcaccacgcatacatacctgcatgccccttggtcagttgtcacacacccatgtctctgtgcttgtgggtgtccaagtgtcttcgtgagtccaggccctcctgtcagccaagctctcatttcctccaaggcctgaatgtcctcccgtcggagttcatcccctcagtccacagcaggaagccaaagcctaacatcagcagcttctgaggaagtcccttggcagatgtgcagggcagggacctgggtcttggccccgggagccctccccgggtctcttggttcccacctccctccctctgagcctgcccaggctgtcagggccctgcctgggctcaagccagctcaagctgacaggagggccagccaagcccccacccctgctcgggccacccagcttccatcttcctgtctagctctggaggcaccagcatcaggagggaagcgaaagctcctccctgagcctccacagagccctaaggagtctctgatgcccactcaccaggacctctgggcggcagaaaggccggcagaaccattgcacagagaagaaatcagaacttctgtggagtggatcataggcagtgcacaactcagaccctgagcttgaacaagaaagtttatttagaaattattttatatttgagacaggatcgtgctctgttgcccaggctggagtgcagtggctcaacatgcctcactgcatcctcaaactcccgggctcaagcaatcctcccacctcaagcctctcaagtagctgggaccacaggctctaattttttttttttttttccagagatggagtcttgctatgttgcaggctggtctcaaactcctgggctgaagtgatcctctgcctcagcctcccaaagtgctgggattacaggcatgagccaccatgcttggctgaaattatttta

SEQ ID NO: 119122 - DNA, 1572 bp, Homo sapiens
tcctagataggaaccagcccaccttgcagcaggactcccaggagggtgacagcagccagtagagctacctcgtccttcatggtaccgtcggtgtggtggcacgggctgtgtgtgaaggcgagctggggaacgcttagccccgtctgctgctcagaggacggcccaggagaggaagagcagcctcggtgctctccccgccccatctcagtggagggggtgcacgggggtgtgaccataccacacagagccagggagccaggccaagccagcagggaggaaaccaaagtctgggcaggggagagcagctagctggagaccgcctcaccacttcctgcttgttcgtgccccttccttgcctagtcccgcgtggcagagcccaagctgtccatctgggtcagctccagctgtgggtgtgccccctgctgcaccaccccactttctccagggccttgcagacccccacatcatgctggagccagccccaggctcccggctaactcctccacccaccttatctgttccctgtccccatccaggctgttcctggcaacccctgccaaaccctcctctgcggaagcccttcccagtgcctttggcttcagaatggagtcccagcgcccccccagccacactgggccccacaagctctttctccttcaggaaacctcatgcctgccagccttagtcgttgtaggggttccatgcacaagggccaccctgccaggaggaaacctgtccaaggccccctgggtggcgggagggtcagcccttgtgggccatccctctcccaggcctctcttgggcctcccacaacagtcacctgctgtgtctttctgccccgcagccctcttgcctcaaggtaacaaccctccaccaccttcctagacggctgccctccccacactcaggccctgtggtctggacagtgctgactcctgccccttccaggcctgtgagatggacactgagccaaggctgactcaagatggtgagatgtagttctggaaacttccttaggactttgggacaggaaactcagagtggggagggggactacggcgggccaccctgaggacagagcccacgcagggccaggtggagaggaaaggtggcacccgaggactcctgcctggagttctgggtgtctccctcgccccgcctggagcgcccccggccgcccccctcgccctgcctggagtgcccctggccgccagccttcccagttgggcctaacggtcacttcctcttttggcttgagtgggtttgcggtggcttttggtcagaagtggcaaagtccagactgacccagaagcacgggcaggagctgggggaggccacaggccgtgctgcaggggtcgggccgcatggttctgccctcgcacctggtccttccttgctgccccaagctcagctccagcctgaggctcggagcctgttgggctctctcagaatcccttcttcctcctctgggtatcgcccctgcccccggaaaccagatatgccccagctgggggctctgtgagctcctccagggcaggggccagggctcaggcccggcccctgctttagacc

SEQ ID NO: 119123 - DNA, 1044 bp, Homo sapiens
gcggccgggaggaagtgggcgagcaggccgagcgcagccagcgccaccagcagccagagggcgcgcgcgctcgcgtacagcggtgccagcctgcgggcggcggtcagcggggaggtggcgcgaggaggcccgcttcttccccgccgcaaccctggccccacggggacttcctctggccgccgccagggctcgcccaccgaatccccaaaggcgctgggctccggcccgtcgcccgcccccagcttcggtcccgctccccaggagccccgcccgcccgcgatctttccccggccccgccccgctccccgcccggccctcacctgagctgcgcggagcgcgcgtagccctggaagtagcggaggcgcgcgaacaggtagaccaggccgcacagggccgccgcccctgcgagaggtacgcacgggcctggtgagcgccctgcgcgggtcccgggggtccagcgcgtgcgcccctgccccacaccccgaccttcatgaaagaagatgccggcgacccagagcgtggcgaggaacagcgggaagtactcgctgcagttcaccctgcggtgggcgggtgggatgagcgcgccggccgggatggtcctgcgacccggacccgcctggggctcgctccccgccccgcgccctcccgccgcgcctcactgggctcggtagacgcgctcgaactcgggtgggccggtggtgagcggcggcgacacgcggaaggccctgcgcgccgagatcacctgcagggagaagtaggctgggggaggagggggagcgggagtcaggtctggacacccgaagccccagagatgggagtgggagggatcctgcaatctggcccttcacttggccgtgtcctctcctccctaaggcggaaccccgccccctccccgcccgaggagacctctcgtctcacccatccctggcctgccctgtgtccctgacattcagcgaggagggcagggctgaagcctggggcgcagagaggccctgtcccaacctgtgagtgtatgggggagggtgagtgattcaggcacaggga

SEQ ID NO: 119124 - DNA, 1051 bp, Homo sapiens
gcttcaccggcaagttatcctcacgttcttcagtttccgcatctgaagtgggcctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagctcacaggcctgcctggctgcaggttcttcttccgcagtgggaacatcgagcacccggaggacaagctcttcaacacgtctgtggaggtgctgcccttcgacgtaagttcggtgggtgtggtgtgcactgaagccgggcctcctgtgaccacctgcctcagcccttgattctgcccccagaaccctcagtcagacaaggaggccctgcaggagggccgcaccgccaccctccggtaccctcggagccccgacggctacctccagatcggtgggtagggtttgggggagagcgtgggctggggttcagggacaccctctcaccactgccctcccacaggctccttctacaagggagtggcagagggagaggtggacccagccttcggccctctggaagcactgcgcctctcgatccagacggactcccctgtgtgggtgattctgagcgaggtgaggctgggcagggccaggccaggcacggggagcagccagggagaccctggcggagctcagaggccctgctgaccctgggtccggctcttccagatcttcctgaaaaaggccgactaagctgcgggcttctgagggtaccctgtggccagccctgaagcccacatttctgggggtgtcgtcactgccgtccccggagggccagatacggccccgcccaaagggttctgcctggcgtcgggcttgggccggcctggggtccgccgctggcccggaggccctaggagctggtgctgcccccgcccgccgggccgcggaggaggcaggcggcccccacactgtgcctga

SEQ ID NO: 119125 - DNA, 3254 bp, Homo sapiens
tggctgctccctggatggcggtggcctgcatgggtccccagttcggccatgggagccggcctggtgactggagtggtgaccaaggccgggacccgctgctcagcgtcggccccctggggcggtggagccctgccggccgggggctcgagcctgggggcgtcagacgccccgctccaccccccgcgctgttggggattttggcaaggacgcgccggggcgaacgctctggctctccgcgggcactgggtggtcaggcgggcactcgggttacactgacaccttgctgcgccaggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccaggtcgagtacagatgttttcccattggcaagtggacgagaacgttcttcagaagtgttggtgttggcacagaagccctgtttcctgctgcgctggtgtgaccagtggctgctgggggtggggttagggaggtggttgtggccaggagggcgggaggtggccaaggccggcccctgggagggtgcagtgctaggacctccctctggagcgctgccagcataccaggccctctcctattcttaaaaaaaaaaaaattgtgatgttattgagctgtaactgaaataagggttcacccatttagtgtacaagtcagtggttttcactattttcataggtttgtggaccatattcagtgtgagagcttttcatcaccttataaacgccatacataccttttatcaccctcttatccacatgcccccagcaacctcctttctgtatctattcatcttgcaatcctggacatttcatgtaaatagaatcagacaatgtagtcttgcaagtggtttctttcacttagtgtaatgtgttcagtgttgtggcacatatcagaactagttttttttggaggaataatattctgttgtgtggacaggccatgttttgtttacctgttcattagttgacagacatttgggttgtttgcatctttgggtgcctcacctgtgccctcggtggatggcgtggtttggtctgcacagctgtgctttaaagccatttcagctcatatgtatctgtcacaaatggagactacatacaaatacgtgtctttcagctttgttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattccagcactttgggaggccgaggcgggcaggtcacctgaggtcaggagtttaagaacagcctggccaacatggtgaaaccttgtcgctactaaaaatacaaaaattagccgggtgtggtggtacatgcttctagtcccagctactcaggaggctgagacgagaatcacttaaacctggagagcggaggttgccatgagccgaaatcacatgactgtactccagcctaggcgacaaaaaaaaaaaaaaaaaaaaaaaaaaaaaaaaaaagacattttaagtgctgtgcctgacctgagaaagaggagtccatgttcactctagggatggggtctggtgccgtggtgcttgggttagggatggggtctggtgccgtggcgcttgggtgaagggcaaggccaaagctgtgcagacagggctccttgctgctgctctgctgcctgggccaaacagacacagggactgggaacctcctagcaggttcttggtggctctgctgccctcacctaagtggctgaattttgtgtggattccatgctggagagcagggccgggggccttgctggcagtgacagccccacagtgacgacagagggggaggactttagggggtcccaccctagcggctctctttacccttcctgtagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgaggtgagcaggccctctgtgcaggcctggggtgggctcagggtggcaggaaccttgacccgctcactgcctgccgctctgctaattcctcccccagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcaggtgaggcttgtgttggaacctgcttctgattggtgacagtagtcaggcagcctgtgtgcagggcccttgtgcaaagcgtgtgtgcaaggcaagaattcaggataccccccaccttcctggtgccctacaatcacacaagaaccctgcaaagtggggtgtattctctccatttcccaaatggggaaactg

SEQ ID NO: 119126 - DNA, 1877 bp, Homo sapiens
gttccctgtggggccagcgttgggccctacgcagcgcctgcacggcccatccacctcccagagcagagctccggcgttgaggtgtgcgtgtgtgtcgtcgcacaaagcctctgtgtgcaggtgtcaggaggcacatggccttccatcactgtggctggaagcgcctgccacatgtggtattggctctccctgtacttagggcctggccccacctgccgtgtggcccgtgtcctgcatggttaggaaaaaggtctctttcgactttctggctcagaagctgactttagatgctagctgaggttaatgttttactgaattggagaaagagaaaggtccagtatcatgggcccaccaagaatgtttccagaagccacagagatttgtagctgggatatggggagaagcctctgactcatgggtttgtatcgtctggtcccatactggctgtgtgattgcggggtcgagctgggtagaacctagcacctgcatccacacgctgagtgccaccatccagacacttagctgcttgtggggactgaacgttgagatcttcgtgagtctgtagtctccacaggccaagctcctgcttgcaggtgcatccttgggggaacttcacggcttgctctttcctcctccgcctctaggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggcaagcctgtgcccctcccgccacctgggaccacggccagcctagtgatctgtggcctgcacctccgcctcatcctcagcacctctgcagccccacttacaaacccgagggagctgctgctgctgcagtgatgtctgtgccattaaagtcacgctgggaacctgctagaactttgtagttacttggtctttgtgagtggccactgttccccctagacccctgcagccttaactgcacgtgtgcatgcgtgctccccgactgtctgccaggagccagggccatggtcaggcttggcctgttgcgcgtgtctcctgtgtgctcatggtgagttttgttccaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccaggcaagtgaaccaagaggttttgtacatattcctacctttccctttagagcatcctgccctcctctgatttcagcgacacaaacagaaggatgagatgttctccactgcagggctgtctgtaggtgtgggaggttaggagttggttttgtcctattatgtgtaccctgagcaatagcgagtaagctctgctaatgcagttctgaaaatgtttttctttaggcaaactccagagccaggaatattaattgtaggagtttctaaaacttaacatgcagaccaggaattaaggcaggtgtgacacagagagggggcagcactgggtgtgtccctactactcacactcaagtgccgcctcagggagtgctggtctgagaggggggggggtcatagccaagatccctgtaggagccaggcagaagccaccgttgaagtggatggtgtggcaggcagcagtgggggggtggggggtggggacagctgac

SEQ ID NO: 119127 - DNA, 1443 bp, Homo sapiens
accacctggctgcctggtgtcgcagtggcagagttgagcagtgtgaaaaagactgcttggccctttacagggaaagcaggtccactgtggcctgtgaggacgagagctctgggcaggctcggacactggcagaccctggtcctggctggccaaggcagcagggtatgtgtttcgggtcactcacagggctcagcaccactcctcatggcttccttactgtttcggcagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggac

SEQ ID NO: 119128 - DNA, 1049 bp, Homo sapiens
tgggaggctcaaggtcagtccctggaaggcaggggcgccccctgtacctcctaacactcttcctgcactatcaggaagcctggaagctctttgtcccagggacctctctgggacttcatcctctggggcataagttctgagaaggacccagaagcaagccactcctctgcaccgcctccgtgtctgctgtaggtgggcggtaaataaggcccccacactaggcgccaagcaggcccagggcaaggcctccacagccacatgttagagacattctgtcttcctgtgagtaggaaacaaatacaaaatgctgtcattggagcgtgtgaaagacacagtgtggctgagtgggggctggaaagaatagtggatgctttcctaggaaaaatcttcatgttccacgtcacgttttttgttaaggaaaaacacgcatgttgagtgcctgttagaactcatccctgtgctatgtttaaagcctgttgggagcatctgatcccaggtgatgggagcatgctaggccctgggctttcgcagtcgagctggtgacatgcagcacacttgcaaaaccgaccataatgccacctggtggtttcacatgggggataatgcacaccaaggaaccgactcaaaagagaaccaaaaatagtgtgtaccaagatgcccatggcagtcctggtgacagtggcagaggctgacttgagcttgaggaccttgatttcaaggacagaaactacagaagcaggtacaccttctgttgtacatggaaccagcaggccactctaggcttgtcccgcatgcttctgggagcggcatgttggtgcagagccctggcctcagaccgcatgtggcccccaggaagcagggcctccattccagggtgagttgcctgagcccagagaggtgtgcccttcactgccaccagacagccagcgagagcagctcagaactggggtgctgccgacctgcctgaggtgcccccaccagccacactgcctttggggaacagctccaggagagctggtcggctgcttctctccccaggtgcatgttcc

SEQ ID NO: 119129 - DNA, 1018 bp, Homo sapiens
aggaggcggctcctttctagtgggagatgaagcagcgctcagtgataggtgccaggaggagtaaagcaggcactgcgggcagagcatgctggctggagggccaccgctcagatgtagggttggagatgcttcccctgagggcaaaccagagccaagatccagtgaccacaattccagttggtggcacagctgggcatttcatgtccaccaggtggtcccggtcatacctctccaagctcagctgcattgcagcccccatgccctggagggagcaggcctgccctgggcccgctggaacagctggatgagctgatgtcccactagtcacgccaaatgtccagggtcatcccagcccctccaccccctccttagtccccacatcccatctcttgcagattctgtctgggatccagccccttcccttcagcctgctgcctcagcccaggcccaccatgccctttccctggggttcccctctcagtctttgacctgcctgcatcccatgactctgatcagacctggccctgccccttccctgggtcctctgtacaaaggcactgtctgagcctccagcctggccttcaagccccggcccctcctggctacactctgccctgccctgagctctgtgcagtcccaccctcctacatagcgtatttgtccggactggaatgcccccagcccccaggaacagcctgggactctgccacttgcccatggccaggccaggtgctgcctgggactctctagatccagcagggttgtcacctccctactgtgggcctaagtagcttttggtccacactgatgttaagatactcagcctgtggccggagtctgtggctggttttcctgccgcttcctacaataggcggatagggcctcctccagagcaggggtctgactggggatatgaccagggctatgggcatggggagtcagctacctcctcccacctgagtgtcaggctcagcccagggacccagagaggccatgaactctggcggggctaggtcag

SEQ ID NO: 119130 - DNA, 1038 bp, Homo sapiens
caggacagggtgcagtggccagcatcccaggcatcagggacatgtgggatcttcccacacacctgggatgacatcgaattaacatgatgagaaaattgcatcttactgctaatcccagtacagaaccactatgggcaaatttataaaactaatctgcacaccctctttgcaaaaggacacacctgagttgagtctgcctctcattggcatgagctttgtgggggcgtgaggcgcacagacccttgctgtgagaacaggaaccccagtctccacatgcccagggtcagatccgacagcaaacgaagcagatgcgtgaatcccctgccctgttctcactgactgtggaatatacgtttgaagtgaacacttgccatttttccacgtgcagcttctcctaaagtgtcttttctcctaacgcgtcaataacgcctcagacacaggtgtgcctgaaggaaacctgcagagccccggatggggacaggcttcaggagcattgtcagagagcgggcagcggcatttcgttttcgctcatttgaggctagaatggtgcagattttaaaggtcttagcagcttttgtgttttaccttttaccaagggctttgggggtttttttgttttgtttttctttatgatagtcttcgtactataaaaatattttcaatgagcagcttcaatatagcatcgttcagaaaagcaggtttccccattgggctctcagagagagggtgagtctgcaggaagctggagcccatttgctggaggttccagacacgcgtctgcatttgtatgtgtttgacccacctgaaaggtaggagagctcagttcggatcattgccgtgttgtctataccacctccttgttttcccaaaccaaaacgcagatcctgatgtagcattttctcctgatttgaggtcttaccaatgtgtatacgttaaattccactcaagacagtttctttactgaaaaggtatgaaattacgtgagaagaagtacaaatttcaggcccctagaatctgtctattaatataacatttgaa

SEQ ID NO: 119131 - DNA, 1032 bp, Homo sapiens
atacaaaaagaatgatgtttctattttactctcagtatttctgaattattttgctcagtactctttttttttttttgagacggagtctcgctctgttacccagactggagtacagtggcgccatctcagctcaccacaacctccacctcccgggttcaagaaattatctgcctcagtcttctgagtagctgggattacaggcacccgccaccacgcccagctaatttttttgtatttttagtagagatggggtttcactgtcttggccaggctggtcttgaactcctgaccttgtgatccacctgtctcggcctcccaaagtgctgggattacaggcttgagtgctcagtactctttttaagaggaatattgagaaactagcacactcagcataaaagggtctgaaaatttaattatttgatgtcttggggatgcttggtttggaagagaggggaccgggtaagatgagagctgtttccaggtgtttgaaggactcttaaagatgagaataacaaagatgagaataactactgtttattgaatgcctaccaagatcttagtcctgcactggtctcttttacccgtattgcctggtttaatactcaaaagagcctcatgttgactaaccagtgcatacagagtgatgcttactctgtatttctggagctctggcgatatctacagggaggcagatttccacttgatataagaaagaactttgtggcctggcgtggtagctaacacctataatcccagcgctttgggaggctgaggtgggcagatcacctgaggtcaggagttcaagacaagcctagccaacacggtgaagccccatctctactaaaaatatgaaaattagctgggtgtggtggcaggtacctgtaatcccagctaaggctgagacaggagaatcacttgaacctgggaggcgaaggttgcagtgagccgagatcgccccattgcactccagcctgggtgaccagagtgaaactctgtctcaaaaaaaaagaaagaaacaactttgtagtagtt

SEQ ID NO: 119132 - DNA, 1045 bp, Homo sapiens
aatagtttcagcttccctgtagcttttataaacattcaacataagttgcttagaagtttttaaaaatgatgttttaaatgacattcaatcagggtgccaaaaaactaatcactatacagagaactcttcacttagccatgatttagtatctttttgaaactccatttttctatgttagctattgtagaaagcataactggtttataaggtgtgattattttcattcttaataaattttctaagtttccattagtcctttttggaatttggtaaaataaaaggcccaaacaaccaaatcctacttagcagttcttacacggtgttgtacatatgaggttgggctcaggagattttctgcaagttatattttaataaattcccaatatttgtctcttggggcttaaaatatgtcctgaaagggggaaaagaaaacttaactaaaaattccctttctttccattttggcctaataagtttcttggtatgtaacttgtgacataattctccattattttataggcatgttttccacaaatcctgcgtggatccctggcttagtgaacattgtacctgtcctatgtgcaaacttaatatattgaaggccctgggaattgtggtacgtttcctattttatttgttaccacttttgtatattattatatgtatgtgtaatacaatataacataattggcataataggaggcatgactaagacacagaagaaaacactggctatatttgccatgtaaccatgtaagcccaacaggacctttttaccagattactaagaagtctaatccatctcagagaactcctggaagagaaggtaaataactctactaggcctttttttttctttttttaaatttaagagacaaggattcactctgtggcccaagctggagtgtagtggtgcaatcatagcttactgtaacctcgaactcctgggttcaagcagtcctcccacctcgccttctgagtagctgggactacaggcatacaccgccatgcctggctaacttttttgtttttttgagagggagtt

SEQ ID NO: 119133 - DNA, 1056 bp, Homo sapiens
agcaggtcttagaaaccgaggaactgtcacctggtcttattagacctcttaaaggtcggccatcggagtgtgtagtcgttagaagtacgttttcagaagtggagttgccgcgtggatgaacgtatgtttccatgccacttcaggagctaaagcggggggccggccgctgcagatgtctgaggctccactgcagccgagggtccatagagacagagactgctgccagccccagctagcagaagagagttcttgtctgggacctttaataatcctgcatccttttatatttgccaggttcttacatggcaccaagaggctgcagagctgtgagagcaactcaccttcaatatagaggcctcccctcccgcagcactcttctgctcactctagttcatggcatgtgtgggacataggaaaggggagggcgctgaatttcatgattgctgggtttgttcctttcatgttctatttgtttctcgttctgtatccccaagtatttctcataggaataaaggactttgttggcgctcagtatgcttgtgcttttcaggtttcactgtccacgttacctgctttccgtcccgatgcaccacccaccctgtgtgtggcgggcctgttttttatttatgtgtgtttttatcacgtgagtggggaacttcttttcaaggccctacttgccccaggtgcctctttctgaggcctcctgggtgtccatggagcaccttccataatgagagcccagagccatagtgagggtgagcgcggtcaggcgtgcgggaatggccaggtggcggggccgctctgcccgtgtgatggccctgcaggtgctcagccttggcccacatgctgtgttgcattgactgctccagacacttcccaaggtagattaaacgcccctggcccagtccttagctgagacctctgcacagcagaaaggtggtttgccgagcaccagactgttgtagcagaactttgcctagaagggaagaaaaggccacagtgagttcagtgaaagttgcactgaagagactagcaggagggttagacaatgggtga

SEQ ID NO: 119134 - DNA, 1132 bp, Homo sapiens
catgaggaaaggactcgcctgtgcctggttgccctggaaacagcatgttggtttctcctgtggctcctctcaagctggggagcatgaaactaagatacacagttctgagtatcaattggataaataggaaatcacctgccaagaagcctaaaaccaaagagtttgcctcttcctcctcccttccctttaaaagacatccacacaactccagccttataatatggagcatgtgaattaataaaataattgtgagttgttatctccatgaggctactggtcttattttacttacaaagtaatctattttgagtctaggaagatctgtttttaaaaaaaaaaaaaaaatcaaactgaagaagaattacatgtactgaaacagaaatccaagattctggaagtccagtcattctagtttacatataaaggaaaatctataaaactaaatgtaagctgtcctctagaaaattaaactgtggaacagccagtcttccttcacatgcagtcattgacggtctaaacgtgaggctaaaggaaatgcacacgccagtgcaaatcaggagaagggccagcgggacacagggaggcgtcatccacacttgcctgcttcaacactggaatgaccaggagaagccaaggctctccaaattctgtcttgctgtttcagcccaggatcctccagaaccatatggcacctaaaactacgggcctccaaaaccattcatgggtatattactagaatgaggggatcttccctcaggggaggctcggcctaaagtagtttattctgggaacttaatcccattatcttcatcccttcagtgttgacttttccagtttcattcggagttatctttttccttttgtataatttttattttttgtagagttggggtctcactatgttgcccaggccgctctgaactcctggcctcaagtatcctcccaccctagcatcctgaagtgctgggatcacaggcatgagcctgacgtctggccctctttttaaaatttagttcattgctttccagacctgactgcatcagagtcagtgggaggctttcagaagcatcccgggtggaggccgggcatatgcgctttaattataagttcccgcccgattctcgtgctgcaa

SEQ ID NO: 119135 - DNA, 1049 bp, Homo sapiens
aagcacagacttgtgcctggaaggataatttcatatgattctctgtcttcctaagttttaccaatttcttggactttacccattttattcccattgccttgataccaccgtatctagttgcctttgaaacagcttcagagggtggagacattcttagtgaactttattgtacaccaaagaaacagaaaagggggaaatcacttaagaaaatagaagcagcatcaaaacggcttgcatttcaatggcagaggagtggtgaccacggtgacagtgtagatgccttcttggcctggtagcctcagctgccacaatagtatgaaattccctggagcggatttaacctacccatctgactttgtatcccgggccagcacagttatttcctttaattattaaagccaattcatcttagtttgtacctcctagacctggcaagagttgtccactgagtttcagtccaagtgacagtgacacagcaaatagtctgttttcttggcttaggttcctggcatgttttgttttatgacaacttttgcaaaaccccttctcagtcctaggaggaaggaaatcaattaatctggtgtctgaatacctggctgactctttctcactcttaatgaagaccgagtattgaattgagccaatgacccttctccatcccaaatctgtgaccagattcacagctcccattcttggggtgggtttctagacagcagtctgctgggactcaactcaccatctttcctgtctgtacttaggtgtgtgtttaagtgaacatcctggtgagcttccaggctgtgtcaaacatagcagtgaaacctcttcagaccaataagtaatgcagggggaatgagggatggggagatcatgatggtccaagctgattctaacctggaaaaaattagaattccgacttaatttttgtaagacatatcataacaaaattaatatagattgttataatttttaaaacaaaatagattgacttagacataatttgggccaatatagttaggcaaataaaaacaaaataattttaatcatttttc

SEQ ID NO: 119136 - DNA, 1094 bp, Homo sapiens
ttcttaaggtgtccgttgttttggtccccgccttgctccgtcaggagcggcatctgccttttcccacagtgtaaggcctggatgtgtctagagtgacgtctccctgatgtgcctgggacagtcgcggtttttgccccttgtcccagtgtgagtgttcctagggccctctgatgcacaaagctttctaatttgaacaggaaagcagatgctcaccttagttttcttcacatacctgttctttacacctatttatctttactagattattactttgcctggaacccactcctacccctacacccggaaccccctcctaaccctacgcctttcccatctaaccccttcccagtcttagtccaggcctcgactcctcaagaccttccctgacgttcctcccctgcctcgccccacccctcctagtcgcctcctctgtgctgccacctggccctgggcatgcttgagtatacaccattaacgcagctgtcccagttcagtgagcttttccagggtagggatcaccatctcttcatctgtgggttgttggtgccaagcagtgctagcagtgtctgggagaatgttgcataaatccagccttggagtttctctgccctcacccttacagataatgaaaacagctcaaccctggaaggtaagtacaccttcccaggatcccagaggatgatagtatagcgagccagaagtggagctgtgacgcattccttctcttcacacttgatgatgcgataagcaatttcaaggagcggtcaaggtttcccttaataagacggcatttacacacctaatggtgatcattcgttgagcagaatccaaaagccattggagcagcaggagtggctctggagtgtgcaagaagtaggtttgatagtgctgtgatgtttcaaatgtttattcgacacaaaatgcagcaattatgacacctaacttttttactgctggagaattgaagacctatagttctatatttctgtttgacctaacagggtgttctaacactttttacttttcaaccagaatgctgaatcttgatacagccaccattttttctattttatcattctcttatatgtaggaca

SEQ ID NO: 119137 - DNA, 1575 bp, Homo sapiens
gcacctcagcctcccaaagtgctgggattacagacatgagccactgtgtcctgccaagattttactattatcttagtgttactgatttctggtttgattccattatgctcagagaaatactctatgatttcagttctcttctgtttcttgaagtttgttttatgatgtaggatgtagtttgtcttagtcagtgtttcattggtgcttagaaaaaatattctgctgttgggtggcatgttctctgggtgttaattagaccagtgggcacagcttttcttcctgaggagccgggctgggagagcctattcccactgggctctgtgagaccagggtgggaggaggattgtgattttgcccttggcgcctggctggagtagaatgaatattactgcaagtgttttctgatgttaggccatccttctcttggtactttggctagcggagttgggcttttctcggctttttctggggtcgggtggtgggctgctctggtcctgttggctgttccaggttggaggcttctgcagcacattgtcaggaatctatgggggaagtaaggaagcttggaagccaccacccgtttctcatgtcttgagggccccaggcagcccacctccttttccctcctataacatgtaatatacctgttaaaaaaaaaaaaaaaaaaaactaaaagatttgtttttaaaatatgttgacatacgaaacactgaaagtaaaatgagaaggagctgctctggagtggtgttgttgacaggcaagcctgtgttagtggactgggtgtagctcaccctgaggacgttggaacaaaggctcacggttgtcccaggagcctgctattggaagatagtgctttaattagcacccagtgtggggccggggctgatgaaggaggaaacataatcaccatctggtgcaggccacaaactgcgagcttgtttcctagcatttattttgcggctgactgcatgcaggatccttccaaagcgtctctccagatgctactgtggtggaaagtgatgttctgaccttttttcctccttccgttttccccaaggttgacaaatgcttgatgaaatttttatgtggcttaaaaagcttagcttattaaagtttaataagaaggtggcagcagctagactggttgaaacctttggctattttaaaagagaagccataatattagcaaaggaaaaccagtgagtttaaggacagactctgattttctctcacaaactgtttttgtttttgttttttgagactgggtctcactctgtcacccaggctggagtgcagtggcgcgatcttggctcactgcaacctctgcctcctcggcttaagcaattctcctgcctcagcctcacacgtagctgggactaaagatgtgtgtcaccatgcctggctaatttttgtatttttagtagagatgggatttcaccatgttggccaggctggtctcaaactccttacctcatgtgatcctcctgcctcagcctcccaaagtgctggaatgacaggcatgaacctccacacctggcccccacaaactgttatcatgaagcagttcttcctgta

SEQ ID NO: 119138 - DNA, 1050 bp, Homo sapiens
agactttctgaagatcattttaaaatagaaaaggttttacagtgtaaatctaccatgatgttgatacacttctcttgctgtataatgttatgttgctgtctgttgtcacatttggctggtttaataatctttttttaaaaatgtagttgtcagacaagttaatatggttcttaacactgcagtcgttctatgccttatgtctgtttaagtcttaagtaccacacaacaaattacatgttcctacttggtgccagcatacccagctgcatctacatttcagttgagaagtggagtttgcataccctttccattaccagacattatagtagttacctaagtagcgtgttgatacatttgatgtttccataagttttaaatgtcacttgagttatatatttattttatattgcaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccaggtgagctcagtactcaacagtgattggttcgtaacagccagagttcacagtcatctgtcgtgaccatgcatcttactaacatgttttttcttttaaaaaatgttgttaccctcactcagtcattttaatatgttggaaacgtctacatgagtatttaagggatatttaaaataacctaaaaggtactaaatttattgtgatcacctagaatattctagtcaggtagatagcttgatatcatagtattatctagataattctgttaatttggagaaatagcacaaagttgcatttttaaaccagtaactttggatgtttctgcaaatgggaacttggaggggggttagggagacttcactcttccccttcctatgtgaaattctttcc

SEQ ID NO: 119139 - DNA, 1050 bp, Homo sapiens
taaaaaaagaagccgggcctcgtggctcatgctgtaattacagcactttgggaggctaaagtggtagaatcacttgagcccaggaggttgaggctgcagtgagccatgatggcaccactgcactctaaggtgagccacagagcaagattgtttcaaggaagaaggaaagaagggagggagggaggaagggatttagactatataaaaatgacttcacttggatattagacaaaatgtaagaggtaaaactgtaaacttttagaagatagtctgtgattttgaacaagaagttcttgcctataactccaaaaacactgtttataaaaaaaattagattttatcaaaattaaaaacctttgtcattgaaaagaaaccattgaaaaacaatgaaaagataagctacaaacaaaatatttttcaatcatacatctgatataggacttgcatccagaatatataaagaactcttataaatcaacaagataaacaacctagttttacaacgggcaaaaggtttaataattagacattttattgatcattagacaaatgcaatcaaaacaacagtgcaaccaaaacaatactatttcacatcctctagaatgatcataattaaaaagtcatacagtaccaagttttgttgaggatgtggataaactagaatccttatgtattgcgagtagaaatgtgaaatggtacaaccagtttggaaaatagtttggcaatttatttaaacattgaacataaaaataccatatgacccagcagtcccactcccagatatctaagagaaatgaaaacaatgaaatgtccacacaaagacttacacacaaatgctcatagcagcattgtttattatggccagaaaagtagagacaacgcagttgttcatcaactggtgaataaacaaacaagttatatgtccataaaattgaatatagtttagcaattacagttggcccttgaacagtgagaaggttagggagggacactgacccccacacagtcaaaaagctacgtataacttttgcctccccccaaatttaactt

SEQ ID NO: 119140 - DNA, 1043 bp, Homo sapiens
tacatttattctacttagatgttattttaactacttcaactttcaaatataagccaaaaccaaacttttaaattttccttagacatttatgaagaaatttgctctaacatggttgaatttcaacaggatcacttagtaactgaaccgaggattattttggcctcctcactggcccccagtccaggctcctgttttctcactgtggggatagcggtggtggcggtgtgtggagaggctagtacatgaacaggaatgagtaagagtcagggtgtcagggttacatcagtcacctgggtttctcgtctgtgttggccttttcttcctcctccctttaccaccctgtactggatattatcagtccttttttattttttatcagtctgtaaagttaagaaattttcattgttttaatttgcattataggtaaccgtcccatggagcatctctccctataggtactgattcagcttcattgtattgtttgtggatgtattcatagctctgctggcagcgagctgcttcacgtgctttagctctgtgtggtattcagaaagcagttgacactttgataaagacttggtcagttttatttatctttaatgtgtgtatttctttttcttttcagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggtaaacaaaaatgagggttgttgattttgtttttcttcttagaaatcattgctttataggtaagcattctgcctctgctgaagccatgtaatttccaacataatcctattagtattgccatttgtttgttgggatgcatgttttttccccatagttgaatttcttcttttttgtaagtaatggtgatagcagtctgtaaagcttggacttattaaataactgg

SEQ ID NO: 119141 - DNA, 1036 bp, Homo sapiens
ccgttattctgaattttaacagaattgctattgacaaattttaaaggctcataattatatagatattttacaccataatatgtcttcacttaataaattgctcaagtgtaaacaactggtattaaattttggagtaatactacttaattatagtcatcagtcatgaaaagttgttatagaaccgttgttttcattatttatattttcttaattacaggagggaataactaggtagaatgagtatactacagtattaagttcctgtttatgaaaacctcttattttcttctgaataataaataccacttttttgaacagaagcttcctatccttgcttattttgtattgtactaccaatatgaatgttttcagagaccttttatggatgatgattagatgaattttgggaaacaggaacattcttttgcttatacaggccgttgttggatttgttttgatcatgctgttgttcatagaatctgttctcagtgggcgggattcctttagcagagttttaaagtcctcctgcagtatgtttgataacttttgctctgtggttgcaccccttgctgtgtcttttcattcttagaatattatgaatattactgaactgctgtcttctgagtggactgtgacactgtcgaaagaggtaaaaaagatgaggcttgggatctgtgagtggtggttactaagagcagaggagtgtggggtgctgctgagcgtggggtagctcacatattttggcacagaaactcccaaggggaccaaactggatcaccaagacaacataggatgaatgtcagtgaaacaaacaaagggaaagagtgttttttaagcattgaagaatgaaggaattattactgttttttagagatagagtcttgctctgtcacccaggctggagtgcagcgacatgatcatagttcactgtaatcttgaactcctgggctcaagcgatcctcccatctcagcttcctgagtagctgggactacaggtgcgtgccaccatgcctagctaatttttttgttttttatt

SEQ ID NO: 119142 - DNA, 1048 bp, Homo sapiens
ccttttctgccatgtgaggacacaaagaagtctccattgatgaagcagacagcgggctctgacaccacatctgctggtgccttgaacttggacttcccagcctacagaactatgtgaaacaaatttgtgctgtttataaattacccagtctaaggtattttgttacagcagcccgaaaggactaagagatgagttaaatagtgtccacaaaaattcatgtccccctagaacctcagaatgtgcccttatttggaaataggatctctgcagatgtaattagttgaggatcaggataaaatcatttcagtttactgtgggccctaaatccaacgactaatgtccttataagaagaggaaaagatacaggaagacacacagagaaggcggccataggaagaaggaggttacagagatggcatcattctgccacaaaccggcgggtgcaaaggatggctagcagccatcagacgctgggagaggggctggaggtggtttttcccttgagcctccagtaggaatcagccctgctcacaccagactttggggccccagaactgtgagacaatgagactatgttgttttaagccaccaagtttgtgatgtcttgcggccgccactggaaactaatacaaagagaatcccagcgttgaacacaggcatgcagggttagctttgccagcacaggagagagtcgagctatactttcttcatccttctggatgtgcctgaagtcacgtcagttgttgtggttttttccaaaagaccatcctgagcccactgttgattaaacttccagtgttttccaccgaggctgctcctaagccatcagccatttcattcagcctttcaggatacttgctgaatcctgatgcgtcacccacagtctttactctttctagcagcttgtgtcactagtgaatgcatgaacatagctttttttttttttttttttttttttgagacggagtctcgctgtcgcccaggctggagtgcagtgggacaatcttggctcactgcaggctccgcccccccggggttcacgccattc

SEQ ID NO: 119143 - DNA, 2590 bp, Homo sapiens
gttttaggtgtttctgtagaagggtattggaaactaactcatgtgtattgaggtatggatgaagattagtcctgttcccctctcagtggggaggcagcattgtaggattaaaggttctgagtcaggcctgtgctttacgtccattgtgtgacactgtaaaagtaactctgccatttagcctgtttgctcatctgtaaaatggaatgatgaaatgtacatctcttaaggttgttgacaggtttaaacggttccttaattctgaaaagaggagatttgttaacctagaggaatctctcagttggtgagatttcagacactgcaacaaaatgaacacatttgggcagtgtgtgaagactgggtgtgaagtcagtccccttgagttttagcctccctttccttgattccctaggggtcattctgtgtccgtcccacaggggcttgctccaggttttctcggggtgggggtgagggtgggggatcctacaggtggtttaagtctggctttgtaccaagggtcttcacacatacgcagtttttcagtccagcaaatattaattgaaatcctgtgtgcccagtctcagtcaaggcattggtgaaggagaggcaacagcagtgaacaaaacagatttaaaaaaatccgtctctatgaagcatagcttctgctgggatctttgtaagttagcctacctgtcagtagtttctaaacctatgggtttatatgaaatctaaatcttctgctgttgcagtaggaacttaggaatttattttagaaacagaaatggtgatataaatctgttaaaattattcgtgttaagaaaatgatttaaaattggaatacttgggtattttacattataatcttgatttaatgagtttaacaattttttagttttagaaaaaatagtgcatctttatgaccttgatgctcttataattttgaattgaggagaattcttgacatgtttattgaggacttactgcacgttgacactaagcaaagtaatgctcagattacacacaaagttatcagacaggtcctggtggaaaaacagctgtggccaatacgtgaaattcatgaaaatttgttttgagggtgtttgatagaaatgaacataaagacaaaagaactttatagttttcctagagttgaacctgatggctcattttgaagctgtggattgatttatgaaactagaaaccttcctgttcgctttgcagtgctactatcagtttggcacgtgtgaatttctgaataacatttatttgtcctatccctttaaagagcaaatagtcaatttttttcttaggcactttggtattttaaaagtatattttggcaagtgctatactttacgtagtatactttatgagatatcttataaacaagtgtactttaaaaatatgtctttgtcattaagtcgaatgcattggtgggtgtagaatcatttgcctggggctaacacattttatattttaactggtaaagaattcgtgtttagaaacggagttttgaaggaacatgtcttgtatttatgcacagatcacggttgctttcttattacttactcaaatggtgagcttagaactaggagcaaaatatttagtacctttgcggagcagcctagctagggtctgctgtggagcagacattgtaaatgtgctttatgtgtgtgcacactaactttttgtttggccccagagtgggggttgggagaggagaaagccctgtgttgatgatgtgattatgtatgcagatgtgctggtggggaagagtttagtatcggccacttcttgctttgcatagaaattttcaggattggatgttacagccttagagaataattttaccaaataataaatcttgttttgctaacttgcttagggatacaataaaactcaaaaaagtgaatcttaggttttcatgtttaaaaatgtaatcctattagacgaagcctttaatggttcctttaatgaatctgaaatcggtttttagaaattctcatgaacagtggaggagattgatgcgaaaacaggatttgggtgaaaggggtcatgtaatgtttgaattcataacagcaaaggcaggggctattggacacagatttcaaaatattcagagaaaaaggatatatgatcatgggagcagggtctctgaacattcagaaagagctggaggctctaaaaatcaaattttaacataaataggctggcaagagaaaaggggatgtatataataaattatatttatgttgaactttacagcttatgacatgtttttacataccgtgtttttccttcacatttgaatgatgatttccattagcctataaatatttgaatttttttaaaaaccacttgatctctccaccaaatccctgtcctgctaccaccccatttctctcttacagcgaacctctaaacgttatctacatttactgcctctgatttttcctcctgctgctcttctctttgtgaaggtcttctattgccgtgccagtgattttgatgaagacgtggcatatgtaacatatatttgatagcagggtcagaattgcaaagatcttaatgtgtacaatgatgggctatatag

SEQ ID NO: 119144 - DNA, 1515 bp, Homo sapiens
cccaaagaaagactcaaggaaaagttcagaaagtccagctgactgacttcttgtctatactcatagttaggattgggaaactgcaaaaggacagagccgagaaatggcctgcagtctcgctgcctggatttgcagcaatgtcgtgcctcagattttattatatttggttttcttagcacagatgcagcagtaagtagcaacgccactccttctcagtcttcatcgatcaatgacatttcatccatgtccactgagcagacgctggcctcagacacagacagcagtcttgatgcctcgacgggaccccttgaaggctgtcgatgataggttagaaatagcaaacctgtcagcattgaaggaactctcacctccgtgggcctgaaatgcttgggagttgatggaaccaaatagaaaaactccatgttctgcatgtaagaaacacaatgccttgccctactcagacctgataggattgcctgcttagatgataaaatgaggcagaatatgtctgaagaaaaaaattgcaagccacacttctagagattttgttcaagatcatttcaggtgagcagttagagtaggtgaatttgtttcaaattgtactagtgacagtttctcatcatctgtaactgttgagatgtatgtgcatgtgaccacaaatgcttgcttggacttgcccatctagcactttggaaatcagtatttaaatgccaaataatcttccaggtagtgctgcttctgaagttatctcttaatcctcttaagtaatttggtgtctgtccagaaaaagtcgatttatgtgtattaattggccatcatgatgttatcatatcttattcccttttatgctatgatttattctatcttttgtatttcagaagacatataattaaatctatttaataaataaaaatatatagcttttcttagatttgtgatgtttggggctgagaattatcacggctaaaaccaagacacttatgtggacatcttgttttctttaaactgtcttgtctgggatgattgtacattcagctttactgcacgatacaattttaagttttgcttagtgctgcttgaaatcctagctaccttatctcttttcttcttggtcttctagacttcttatgaatttaaaatgctacctagaacttcaccttctttattaggtgcgtaacactccatcttaattaaatatgatggcagataggttcctgcatccatggcctaacgttggagtggaattttacaaaatgctcactagagatcactgcagtcatttcctaagtgcttcctttgccacagactggcctgggtcctttatttaccttccctcattcactttccctcggccaataccacgttcttgattttctttcttcactggaagaaagcagataaactcctctttggtctgttttcagaggccaggctgattcagatgcctgttgctattgttgctctccattgttgggaggcattccttttcacaagaatgttctgggaaactcttca

SEQ ID NO: 119145 - DNA, 1055 bp, Homo sapiens
ttggctaaataggtaaataaaatgtgggcataattctgatttgacaatatgtatgaaccaggagtaggaaggagaatttgctagtgaattgaatgccagaaacacatttcctgagcgggtcttttggaagtataacattttggaagaactgagttcatgtaccagttccctaggttatttcatggtgatgtaagttcatttttctaagacatgcctcagtgagcacttttttaagctgctgttgatgctatttttttctcacttgcattctcttgtatagcgagtacagtttcagtgtcactttcccacatgtaatcctaattatcccaagcctaacaagcaccctgtggaataggcaaagctggtaatgtctgcattgaacaaataaggaaacagaccccaaggaagcctgactttcctgacacactgagtgtttaatgcagagttgagtctgaaacccaggtcacgcactttgaaaggaaataaaatgcattacctagggatcgcagtgatggttgggaagagtcagttccaagtaaaatagagcatcatttgaaagctgtcgctgggctcagtctaagcccagttgcttggttcccagctgtaaactgaggaggtcagataggtctctccacaggtcccttgagatcctctgttctttagagagctgtgaatgaatctaaggtagcattagtatgaaaactgatttcaatttgcttatgtaatgtttatctaatttcgtgtttaatcatttttgctataggtattcttagttataagataaactttattttgaactagagtgggaaggtgtgtagacttcattgtgttgatttaataaactgtgatcatagtttatgaagatgcagagtgtgagagttttaaaaaatagtgtaacttggaaacccaaaccttatttgaatattatttcaaaattccgctgctgatccagtggggtggcctagtcgataggtttaaatattattcaagtgatgctgccgcatgtactgtgaatacaaggtacttcagttgtattttcctcaagaaactcctta

SEQ ID NO: 119146 - DNA, 1071 bp, Homo sapiens
ccggtacttggccatggaggctggggtgggcgtgtggccctgaaaagctttgtgttcacaggcacttcttgtttctggttttttgtttgtttgtttgtttgttttaagctataaagtattggactctttggcactaaaaccccagattgctacaaaccgaaggctaaaatagaggtcagcaatcattcatattgtgtaaaatgtcacccttagctagcaatttatttttccatatttgtgtgtttagtgcactgttagaattccttttcctcacttttgttttgttcatggcacttcataattttatcatttcattttattttcagttgatatctggtcagtgggttgcatcatgggagagctggtgaaaggttgtgtgatattccaaggcactgaccgtatccttccccgcgaccttggccccgccatgctttcttaatgcctcaggcagcatgaccacctgcttacacgagcgctcacgaggacaaagtcgtaaaatccactccagactgtgttctaaggggggctttactgtatttgttaattagtgtcacaagccaagtggttcaatttcattctttatttttaacttgactacctgtgatgactttgagacttagagttcagttaaaccgattatattagctcttaattttgccaaaaatagctggacacatagaagaaattatttactctttgataagtatattctgatatttaaatgaaaatactgtattatttagtttattccgttaatttaactaggaaagatgctatctaaatttaataggctagtgtgcttgtgtgctttaattaagtactattttgttagttactggtatgcattgaaatattttcccccaaagtaagaactgaagcacattacaaaggacctaagtgaaagagattaaaatgaaaattttgtgaggaacaatatgttaaactttcttgtttgttactgtgctgacattttgtagaattttttttaaaaatctgtctagtgggttattttgtgacacactggggaagtcaaaataaatgtaaaatgaaagagataaactcatactgtag

SEQ ID NO: 119147 - DNA, 1746 bp, Homo sapiens
gctgttgagcatggctagtagaaaatgtaaattatacacatcgttcgcattatatgacattgtctgtgggacagcactgccctggactgacagacagcatgaggaccttagcaagagagagtcagagtattggggaactcaagtccaggcgtggagagcaggagggggccgtgtgtgctggactgacagcatgaggaccttagcaagagagagtcagagtattggggaactcaagtccaggcgtggagagcgggaggggggcatgtgtgctggacgtgtagatgcatggatggagggtagataggacagcctgagggcctgcgagaccacagaaagggcaaatgggggccatgaaggtttccactgggggtaaggggcaccatctgacggctttaggctgatttgttttagtttcaatttgagagtaagattttccaaagttgttcccaaatctcagagttcagttcactccctacactctcacactggcttcacgaccctcacggatgtgaagtagtttatttagcatgcttcattcattttactaatttaagccatttctttcctaggatttgaagcctagcaacattgttgtgaaatcagactgcaccctgaagatccttgactttggcctggcccggacagcgtgcactaacttcatgatgaccccttacgtggtgacacggtactaccgggcgcccgaagtcatcctgggtatgggctacaaagagaacggtgagtatagccggggctggaagaggctgggatgtttagaaattgctctagcggtggtctcgagttttttctctttcctttgaaccatatgatatatactgtggggactgttacacccagaatatagcatgatccagagataagaaataattaattgtgtttttccattggttaaaatcattctcttttaaaaattcacttttaaaattgttatttttgaactttttaatcagagttaagctgtctatagccaagtgtgcaaatcctgagtgtgcagctcagctgaggtgagcacacccacagcagcagcagctctggcctccccatggcccctcctcgcagcccacgaggctggccaatctcctgatctccagtaccatggatcagctttatttgttggtctgcatattgtttttttgaatttgatgtaaatagaataacacatgttttcatgtaaaattggtgtctttttacatcaaaacttagcttattctagcaatatcagagctctttgaaacttggcttttagcaaatttgttgaaaataacgaaatcacgcttacttatttttaaaaagactgaaagtttgcccgggtcatctgaaatgagttttgctacaggttcatcttgctgcgttgtagcttgtgttcccaccctgaggggcacagcttcatgtgcttcctgtggaggggagagaaaacttgatcccctgttcacttctcccctcggcccgccagcagggcacttagaggcctctgctgtctgtctgaggccccacagatgagggtgggcaccgtggaagtctgggcccctctagcagggcctcacctgcagtcctgcaagccagccagcctgtgccgccagtgagtgctgctgcctttctgacggggcagtctagaaaatgatcgctcaggaggtgtggtatcaacaacgcacagaggctcccgccggcaagctagtgacgtgtaccgggtttgtcctgggagggggtttgaagaaaaaagatggggga

SEQ ID NO: 119148 - DNA, 1051 bp, Homo sapiens
agatctcctgatgtaccattctatttctgttcctgaagtttccacagaccttcatataatttaaggtactcttgatatctcttaaatacattttatttatgctttagaataatttcccagattattagtcttactacattaggccttattcattttataaggggaaatggtttgtctgacttgttcccccttgggccccaaggtaagtgggaaacaatggcctcctgtcactgggggctttgtgagagctgcagcgtcggcaggccttttttatggaatagccggtgcctgcagcctgagtcagatggggcccaaaggagtgtttggtttgcccagcacgaggtatagaaacctaagaagccttcagaaaatggccctgttgccatccctgcctcctgctcaccatccccacccacctggcatcttgctgtgtcctctcctccctgtcaccttgttccctgctgcttcccacatccatggccttgccaggctctccccacatctgtgtccatgtgggagagtgatgcatgctcactgtggggaagttccaaacattgcacaggtgtataaagcaaagggggaaactccctcttgccccctgcccccctgccccacccctgcccacatcccaggaagggaggagccctaagttaactgttctgtgtggactgcaccatcctttgttccatctacagtaccatgcacagagatagacacacttttaattttgcctattaaaatggtttaatacaaaacataaattttaagtatttgaaagataaagttttgcccatgatatcccaccgaagtatatactttatataattcaaaaaatgaaatgcaagtaacccagccctctgttagcacctggagatggccagtgagagcacgctggtgcatgtcctgcctcactctgcatggcacctctctgttgactgatgttaacaccagcatatctgtacttatgtccttttgaacttacatccttcaaagacaggatcaccttgcatataactgcgtagcaacttcctaaacaggtagcttggtttgt

SEQ ID NO: 119149 - DNA, 1050 bp, Homo sapiens
tgtagagcaatttagagccacagcaaaattgagcgggaggtactgagttcctgtctgtctccagccccttacgtgcagagcctcccccgttctcagcatctcccaccagagggtacatgtgttgtgattgatgagcctgtaacagcatggtctttaggctggtacggagaatttcagccaaaaatgtaagaagtaggaaaatttgtgtttgagattctatttaccatgctataaaaggttgttgtttttttttttaatttttaacttgtaagacgttaagtttgttatttatatattctttggaaaatttttagaaagttccattataccaagttatctttttactttagccagtgcagtgattggaagtaagttacagtttcatgaaatttagtcataaaggaactttggataattttcaaataaataactgaccttttctccctcaggtatttggttatggaattaatggatgctaacttatgtcaggttattcacatggagctggatcatgaaagaatgtcctaccttctttaccagatgctttgtggtattaaacatctgcattcagctggtataattcatagagtaagtggtgatgtattaattttatttttaaaaacaatcatttggttgtcataatcctttacatacaaaataacatttaaaaaaaattgttaggcttgaaaatccaaatagatgatggaatcatatggtgttttaagagagtcattctaggaggcatctgtggagccgcctggcctgccaggctagaccagctgctgtggacacagccaggtactgcgctctcagtcagatactgcgcaagaatacattgttttaaacttttcattttaaagtaacttaaaacttagagaaaaatttcaagaataggacagagaacttccaactaccatttatctacattcacctgtttttaatatatttgccatatgtgaaatcccatttttaatgagcaaggaacttaaaggccaagtagtcagtgagacagctgcttgagaactctctttcttaaataatgacccacat

SEQ ID NO: 119150 - DNA, 1053 bp, Homo sapiens
tgctgtggacaaagggtggagctgggtcaggggatcaaaagtgctgagggttggacttgaggctgcagttttaaataaggtggctggggaaagacctccatgagttggtgacattcgaagaaagccttgaaggggataaagaagttggtctggccgggtgcggtggctcacgcctataatcccagcactttgggaggccgaggcgggcggatcacgaggtcaggagatcgagaccatcctggctaacacggtgaaaccccgtctctactaaaaatacaaaaaatcagccgggcgtggtggcgggggcctgtagtcccagctactcaggaggctgaggcaggagaatggtgtgaacccgggaggtggagcttgcagtgagccaagatcgcaccactgcactccagccagggcgacagagcaagactctgtctcaaaaaaaaaaaaaaaaagaatttggtgccgcagatactttgggggcaagtagaatggagatagaaggaacagacagcgctcaggacagcagtggatgcccgcctggtgttttccaagaccatcaagaggtggcgtggctagagatgagggagcaggggaagagaagagggtgaacaccacaagcctctaggccgttgtaaggatgtcttttgctctaaggcaagtcagagtaagagtcttagcagagcagtgagctcacctgccttctgtttgaaaagcgtaactctggcatctgggttggtaacccactataaggggtgggggcatggaacatcagttactgctgttgcagcagttctgttaagggatgacggagggtccatttggcccagaggggtaataggaagggtgagaggggaagagactggatgctgaaatggttctaaagatagagccatggtattagctgatagatgagatgtgtggtatgagagagaggaattgagaatgacacctagatttttggcctgagcacctgaaggatgagggagctctcaactgagatgatgaaggctgtgagaagagcagactgggctagggatggaatcaggagttcagttc

SEQ ID NO: 119151 - DNA, 1681 bp, Homo sapiens
catataaatggtgcaatttgcatatgaacctgtggatttacatatgtatatagacagacacataatatgaactgaattaaagtaaggtagcttcttaaccaaatgctacaacagatagccttcaactttaaaacagattgaattaggttcgagtttggcaaaagcattaatagaagagaataaatgtaaacaatgttataaactcaatggaataaagaaatagaaacagtatttaaatcagtgcttaggttctcaggtggcctttagtagctgttagccctcatgagtagcccagaggtgataatacaaatgatactatttagtaccagtttgaaacctaaaaatgtgtaatcaggctacttgattcttcatgtctattttctggaggaaaatgaacagaatttcaacaggaaacgagatgctggaaacacagcctgtagattttattcttactatagtagtaggaggagatagttctaaaagaactttatatagcagttgcttacgttagagattttgtatcttgaacatttaccatgagctgaaattttggcttcttttctttttagatactgttatttgtgaaaaaaacacagtgattcaaaatttagatttattctcctcatgaattcagccatttcctctactgtgatattccaaaatatacacattttaagacaggaaacagtgactttgtttccaacttcttgtcatgtttaaactgaagatttcatttcttgactggttttatgcactctatattaaattacctggttttgaatgtaatctaaactatgaaaccttggtgtgtgaaggattgctgaaccccatcttaactgtggctgaaatgtgcctctgcaaaggagttagtacatgctgtagtcttagacaactcactctgctcttcatatgtgcaagtaccttgaatgaaataagcagatttttccttgttacttattaaaaagatgatatattcaatgtatattctggcattgctgtattttccaaaaccgttctaatggattgtgcattatatttcctaattctagtgctgcatttgatacagttcttgggataaatgttgcagtcaagaaactaagccgtccttttcagaaccaaactcatgcaaagagagcttatcgtgaacttgtcctcttaaaatgtgtcaatcataaaaatgtaagttatgtatgtattttgtctgtgtgcttccatattgtcaataatgtggtaatcttcagggttttctggagatacattgagttcagacctaggataagctaaggataaaaatggctattaacattggttttttgttttttgtttttttgtttttttgtcgcccaggctggaatgcagtggcgcagtctcggctctctgcaagctccacctcccgggttcatgccattctcttacctcagcctcccaagtagctgggactacaggcgcctgccaccacgcccggctaattttttgtatttttagtagagatggggtttcaccatgttagtcaggatggtcttgatctcctggccccatgatccacctgccttggccttccaaagtgctgggattacaggcgtgagccaccatgcccggcctattttttattgataacattctttttttttggagacggagtctcgctctgtcgcccaggctggagtgcagtggtgggatc

SEQ ID NO: 119152 - DNA, 1124 bp, Homo sapiens
aaatagtcaataggttgtcacaggaggatacccaaataacctataaacaggaaaagtgctcaatgccgttattcatcaagatagtgcaatttaaaactgcgacgaaataccattccacactcagcagaatggttagaaactaagctgttggtgataccaagtgctggtgaggatgtggaaccacccagaggcagctctcagatgtgacccctcgtgtactggaaccacgcagaggcagctctcagatgtgacccctcgtgcactgctggcagctgtacaaatttgtagaaacgctctggcaaagagtttgacattatctactgaaatacaatggatacgttcccactcttagttgtctactcatcagaaacacatgcataggggatccggagctgcgtacaggaatggtgatgactgtgtgttctgtaatagattgaaaactaaaaacaactgaaatatctatcaacgtaatgtgatatagttatacaaaggaatcttatagcaatgatggaaggagttatagctacatacagcaacaatggatgagtcccataatattgagccacagaagtcagacacagaagatttcaaaaaacaggcaaaaataaactgggagctccagggtgcatgctttagctggtaaagcaagaaagtgattattgtacatgtcaaagcagttatcactggtggacaggagggacactaattagttgggggtgtgagaagcttttgggatacagagagaacatgactgataaatcattgagctgggaaacaaaaaaagaagcaaaggaatcagtacagtatcgggcataagcctcctcactgtcagcactcagtgtggaaatcagtggaaaagtgccttcaaagttctcacagaaaattgattttaaactcagaaaacttattatcaatcaagggtgggggcagagcaataccatctatcttccatgcaccttttctgaggaaattccttgaggatgtactccagcaagagaggcaacacaagagcgtaatgcaagaagcagtggggactgtgaaaagaaatcccaggatggtggctgcatggcaggtcttaaggaagctgcaagaagagtgtctgcaaatcatgtggaggagatgcc

SEQ ID NO: 119153 - DNA, 1712 bp, Homo sapiens
tcatgatccacccaccttggcctcccaaagtgctgggattacaggcatgagccactgcgcccggcctacaggtagctgttttaaatacgtgcttcatttatcccagctggcatgtcattcacttgcttttgaaggttggtagtaatgtgaatagtgtatattgtagaatcaccatgagctctgccataaccctcactggtggtgaatcgaaggactaggaaggctcacttgcttctcccgtctcacggggtgttagtggtaggcctgggaccaaaacaagctgtgggcctttgggaccttattgcctgtaccacggagagacttgttgaagactttgaaccactgatactttgataggtcaaggcctctgacccaccttctgtttagaatcttagtaataatgaacaaatattcactaaacacctattaaacaattttcatttaattgtatttatctctataagacaattgttacattcaagaacagtttcaatttttatagctataactgactttcagttttatggtatccttctatcttatgttctaatagggaaagtaaacactttataagtgattttcgcttccttttcacctttctcttttctctgtatccttcaccaggctatgaggcaccaagtagaattgggaaataatctagttacggcacattcccgtttcaaaaaagaaaaaaaagcttgcttttccaaaaataagctcaacagtagattagctaacactgacaagaggaattggattttctatcatatttcgtattaaaatattggcattatgtagttaattgatgatctgaaacttcctttcatcactattgtacttgaaaatcatctgtcagtgattctttggggagtgtagcatgcagaataatggtcccgcctgagatgtccacgtcctaatccctggaatttgtatatttctttacatggcaaaaggaatttagccggtgtgattacattaatggtcttgagatgggagggttatcccaggtttagttgggtgggtccttcttacaaaagggagacaggaaggtcatagtcagagatgtgatggcagagcgaagtttggagtgatgtggggccacagccaagcaatacaggaagcctccaaccagctgagagaggcagggagcagactccccccagagcctgcagaaggagccacgcagccctgcttacctcttgaggcataagatgcattttggacttctcacctccagaactgtaagatagtaagtttgtgtggctttaaagcagtaaattggtggttacttgttacaatagcaataggaaactaattcacaagcatgtgtatttctacatttttgagaaatataacagcaacagtgtatggtttatgcaactagttaatcttctatttaaattagagctttatgaagggcaggtgtgcagataaaccaacgtgcaggtagggcctgtgacctgtacaggattaaatggaagagctggagccagaagaaaatattctggttcctaattttgaattgtttttatagttgtctttgatttgtttatttgtttttgttcctttaaatatgttagtaaaatttattaggaaataagtttttaaattttaaaatattttattttatttttgagacggagtcttgctctgtcaccaggtggagtgcagtggcgtgatcttggctcaccgcaacctccgcctcgcgggtt

SEQ ID NO: 119154 - DNA, 1856 bp, Homo sapiens
actggtccgtttgcttctctttaggcattctagaagtgatcatttttgaaacaatgcctccgtctctagacagctaggtgtaaatgaaccatttacacctagcttgcccacagggggcaagctgatgagacgcacagagtgatgtagtcttttcatagccagtagtaatgcatacattcttttctccaaaggtggttattttctagtccagccccttaaagtgtggtcttgctgggcctcaaaattccttcctttcataatggtctggtaccactgaaatgtctgcatttttttgtgtcttgcttaagttcagaacttggtcagattgactttatcaacttacagccacattgtcttacataccaataagttcagaactctcttacgtgagctgcgtatgtacttccggtaagaatgcacgttcattctgtttttctttgaagggatctgaaacttgcccacccttcgggatattgcaggacgctgcatcatgagcgacagtaaatgtgacagtcagttttatagtgtgcaagtggcagactcaaccttcactgtcctaaaacgttaccagcagctgaaaccaattggctctggggcccaagggattgtttggtaagtatggtctgttttaatagcgtggattgagtttttgctgtaataaaaagtaaaactaaagtgtcaggatttagaaacattgatgattaaaaaaaaaactctgttataggtttatgagctaaattgaatcaactgcttgctctagttctgtgtagtcaggctgtagggtacaaacccatattcttagaatgctgcaggaatttaaataggtagcaagttttcttttttgtttgtttctttttcctttcattttttttttcatttctcctgtcattatgatatcagagtagtaggtatgacagtgagttgtaacagaaatttggagttttattcatttcttcatcatggccaccttttcccccctccccttttattcccgatcactcctgttcatttccaggcgccatcattgcagtgccttgccattcattggcaggatgaggccagtcagtgtcattgtcactccatggattaaccaggaagggatgctgtgtgaggggttgggctggccatctcttccttggtgtctcacttcaactgtgtgtccagcccagaacgtcagaatcgttagtctgaccctgaacgttagtctcttgcatggtaagacggtcagccgccgcagcatcacgggccagctcaaggtaaagctcttcacatgtttcctagactgcagctatcagcacttcccacactttttaccccttatttttctgggcagaacttttttttttctttttctttttctttttttttggtcaatgaaaacaggattacctttgcgcctaaagaaaccgtggtgcagttaaacatcgcgtgtttacagctggtaggcagagggggttgagggagaagaaagctcttttcgatgctctagtagggtagtttacatttccttgtagagatgttgggtttggagaatctttaacgatgatttttaactgatcctttgttgcggagacctatgatcagggaaacagttgtttttttcagccctggcggctgaaggccctgggagctaagaggaaattgcagtccagagcttctttgagaagctaaggcgggaaagggactgtttggaaggaatgcccagcttgcatctaaagtaatggtgatcttaacttcctgatgacacatgctgtatcggcacttaaatccagtgtgccagaagaagtgttaaaggtggccgggcacggtggctcacgcctgtaatcccagcactttgggaggccaagctgggcaga

SEQ ID NO: 119155 - DNA, 1023 bp, Homo sapiens
gtgcatctgtggaagactgggcagggtgctggcccgtgctggtgtgagtggtgtaggaaccccctccccacccgcccagcctcccgcctccccgcgcactcctctcttgccttgtcattgcacactcggtgtccagcagtgccagaggggacccagcccgaatcccttaccaccgcgcccctcccccagaagactgctgccccgtcccactcatctcgcccgccttgaacatgccagcccgcatttgccccaggacctttgcatttgctgtttccccgtctttggagttgtctccgtgatcttggcacaagtagctctttctgctccttcctctggtcagatgtctcgttttgggtgaggccctcctcgaccaccctctttcttcccttagtcatgctatttcattatttaaaaaatttccttcctagctctcatctggtttgaaactattctatttatttgcctgcttattttctgtctccccgactaggatgtaactttgtgaaaacaggtagctgtctgatttgtccactgctttatccccagtgcttagaaagcacacaggaagtattcagtagtatcagctcaatgaatgaatgaatgatcaaagaaatggcccagcctgcctgttgtctctgctttatctgttcatttagtgacttctgattagcgtgtgaaacttgtaagcagatggaagcttgttctattttgtgaaacattttggtgtccttgacccctttaattgctaactgttggaacaagctgtgatataaaatctcacatttttataatagtttagctgtagctttcttccacacatacaagagacatttactgaattctgcattatctaggtcatgctttctgctagaccctacggacacaaggcagatagcaacggggtccctttcccgagagagcccaggagcccagtagagaaggcaggcatgcagacacttagttccaggactgtacaacccttgctataggggaggggctatgccatggaaatgtggaggaggt

SEQ ID NO: 119156 - DNA, 1093 bp, Homo sapiens
acatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtgtgtttgcattttgttaacctcattctttttgtgtactttgaattttgaggactgtgcaggagctcggcagtgtttggaggggcagccctgtttgttagtaacattggcctcgtccacacctgagacctatgggtttctagtaggaaaaggagggctgttgtccaggatacaacaaatccaagagatttgggactcagcagaggggccactgaacctggaaggggttgggcagaacctgtagacagcatagaggggtgaaactctcaaatttgtatttttttcccaataaggctattatagtccctgg

SEQ ID NO: 119157 - DNA, 1025 bp, Homo sapiens
tctggctgatctgctccagccccatctgcccagtgtgactctgatctcacctcctgtttccagaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccaggtgagggctctccactggactgggccagctctctcctgcttttccccatgcatgcccacctcaccactgtctgccagtaccagtgatggatggtctggccagtgagtggctgtgaccacacaccctcccccgggccgcctgtggggagtgcacacacttggaaaggagctggtcagcccgcagctgtcccacacagctctttggtggggcccagggacccacactgctgtgagcagcaccagatcctagcctggagctcaggggaggtactcctggtggacatccctggggcagggtttccccaggttctgcggccaagcagctccgatgggaactacctggagttaggtcaggtctcatagggcaggggcacagctttccataagactgccctcgattcaggcacctgttgcaagccaggggtccacccacacatctgagcaactgactatgaatccaaggattcccactctcccctgaagttcagtaattttctagaacgacccatagaactcaggagatgactatatgattacagttttattataaaagatataaatcacagccaacccaaaagaagagacccctagtttgagggccccagatgtgaagcttgtgtcctcaggatgtgtcaccctcccagcacgtcactgtgtgtcgcccgggagctcccctgagctgctagctccagtgtccagagtttgtattgtggttttattaagtaggcaggatggagtgaaccattggccatgtgatcaaactcagtcgccagccccacttttgtccttggaggt

SEQ ID NO: 119158 - DNA, 1028 bp, Homo sapiens
cccgactcatgaggatttcaacagttttgattttatagtctggcttatgctgaatttaatttgagtgctttaggactcacaaacatagggagcttgtgctggtttatgcatgaagctgtttagctttattctaaaaacaatttgagtccacactgagaggcttgcaagaagtgtcctttcaaacaggatctagctgagaaacaccacttggggacattcctgcttgtcagatgttaaatctgttccatctcagcacgttctgaataaggcagcttattcagttgcagagagggcgctgggagccaagcccacctgtcaccagctgtatggctttgatcagagcaccggtttcctcctgtctctgagccctcatcctcaagaggaaaatggggacgatggtcctcacggggttgtcacgagatttaaatgaaaagatgcttgccacaaatagtaacacaccttgaatgtaagaatcaaccgaaaaggctgttgagcgagcgttttcctttctgaacacccgctggctgtgtctcgggcgccgatttccctgtaagagccggcggtgaaggaggaaggggtttggggtggggccgaggctggcggagcgcggcactgagagggcccctgggcggcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggtaggaggagccacgggcgcccgtcccagggagagcctggcggaggcaggtgcaccagaggccgccctcctccggcctgctctgcccgcgccaccgcctttctttccccttcccgcctcaccccttctctccgctcctttcctttcccctcccctcttggattcccgtatcttcattttttttatttttatttttattttatttatttattttttttgagacggagtctcactct

SEQ ID NO: 119159 - DNA, 1035 bp, Homo sapiens
gaggagaaagggggagcccgatggttttaaatccttgtcgactcttaataggaagcacgtccgatagacgacgggaggaacactaacgcagtggagataccaacgaaatatcacaatgcgaggagcccttgggataaatgccctgcctgggcccattgccatcagccgagggcctgggagcgcctgcagcggggaagtgtcccgaggggctcaccctagctaggcaggagcagggctgggggcagctgcggcctggaggaggcaggggcttcctcacttgctgttaagcctggccgcagtcacagcctctttcagagcagatttcctgaaaactgtacagctctccaacctgccataaacggacagcccggggcatgcagccctgaccctgcggagcacctgtgccaagtgtgtgagaaaaagctttggttgcaatataacaaatgctgtctacatcacaggtgtggcgatcgatgggaataatcacgaagtcaaagaaagacacattcagctggtcaagaaaagggggaaagtcaaggctctcgatgaagaactttacagtaagtggaggacctctgagtgggaggagccgctgcagcgccggccgctttctaggaccgtattccaacagcgccggagaatggagattctcctttgtcccagctcagataaacagagggagggctaagcccgtgctgtaaaaccgggcttcgcagggtatgggatggtttattttaggtggtggcggcgcatggataatttttttaagtgtgaagggttacatacagtagttattttaattattccagcaaatgatactgcttctctgtttatggtagggatatatcattttctttttaaagcaagtttatttctgtgaagaagtgagctaagctacagacaagtagtaaataaccttcagcacgggtggtttgtgggcctgcgcggactcccagggtgggagctggtggggaggtgccatcggtgtgggtgacgtgacttgggtaacgacaccaggttgcactcacagtcctg

SEQ ID NO: 119160 - DNA, 1040 bp, Homo sapiens
agaggggtcagcgtggccagggtcccagtcctttggcccttgaacttggcctttcccagacagcccttcttggcatcccagcctggaatccctttccttatctttctttggcaagccccttcaagacacagtggacaaattttccccttccagaagcttcccttgacccacaggcagaataattccctttcttctgagtgccctgtgcctggacgttccctgctatgctgctggctggctgctctgtattgtgctaaaatattcacgaccgtgtccccaccagggatcccggaggcaagggccaccctccgtgtccccagcacttacgcctaggcctggcacacacaaacgtcgagtacttctcatccgtggctcgcggggcagggccggcatgtcctccttgagccgcccatgtccctgtgctccttgcgcaagctgcaggcccacccccaggagcgaggccctgtggcgtcagcgcccatgtgcagcaggtccaggggacaggaggggtctgcctgatctcagaggggtgtgtgcgggacgagcgtgaggtcatgcttgtttacgaggctctgacacagaaccatcgtttcctccctcctgggctgcacagccgtcctcccggctcagacagcctctgacttactcaccggcttcccgcaccgtcgctctggacgcccatttcaactgcgacaagggggtcagagctgtttgtaatttgcaatcaggaacgtcagggaagcactttggcctgaggctgagagaccctcccagcagctgtcctacagccccactgcagctcagcatctctgcgggatagggacagacttgtggagagcccgcccgagggcgctcccagaaggaaatagccagagagaccgagtggggatggccagccctggtagccctatcccgcccttactgctcatgggcctctcagagaagggcccatggtgcccagggaagggggtcacaaggaatgagtgccagaggggcctcagagagagggtgggagggccgtgaacctagacgcagggcag

SEQ ID NO: 119161 - DNA, 1010 bp, Homo sapiens
ttttctcctctccttagcgctcctccatttttcatctacttctttttccgccccaggttgtccactttttttttgttttttgagacggtgtcttgctctttcacccaggccagagtgcagtggggcgatcttggctcactgcaagctccgcctcccgggttcacaccattctcctgcctcagcctcccgagtagctgggactacaggcgcccgccaccgcgcccggctcattttttgtatttttagtagagacggggtttcaccgtgttagccaggatggtctccatctcctgacctcgtgatccgcccacctccgcctcccaaagtgctgggatggcaggcgtgagccaccgcgcccggctgggttgtccacttttatctcctcttttccttgatcgtcctcccctttttttctcctcttccttttccttaagccttcgcctgtcaatcacgtcgaaacacagtatttgaccggagccagtatcttgatctgcctaaagacaagacattcaatcgtgaacagtcgaatattattccttcctcaattatacaaagaagagtaagttaacataccacttcagcctattaatggtaattcattccattacattaatggacagttttggtgctggggtcctagcctgggtaacggacagcagctgctgtgctccaagatcaaaaggtgttcagggcaaactctggtgtttgaaggtcagcagagaaatgactgggctgattcatgatgcttacatcaagaaatattagttgactgatggtcagggcacagagatgaatcagaccccacccagccctgagtaagctcacagtctaggggcaagaataacacccaacagacttaatattggaggtatattggtcgggcgcggtggctcacgcctgtaatcccagcactttgggaggccgaggggggcagatcacctgaggtccggagttggaaaacagcctgaccaacatggcgaaacttcgtccctactaaaagtacaaaaaat

SEQ ID NO: 119162 - DNA, 1036 bp, Homo sapiens
ggcgccgctcctctctccggccgcgcacggaccgccccccgtcggccgggctcggtcgcgggcaactttcgtttcgtgggcggcggtcccgctgctccgcaagctggcggctgttgggggccccttcgacgcgccgcgatcgcgccccgccccgggccgcgcccccgggccgagtccctgggaggggggcgttgattgacggcggcggcggcggcgcgcagaggggagagggtcggcgctgggctcccggatcccggccggtcccggctgccgtcgtcggaggaggcgagtccgtgtcccgggactcgtggccaagatgggtggcaacttttgagaagcgcctctgtgggtggcgcgctgtgtggagtgtggagcttcgcgctccgtggccacaattactgtcaagcgggaaaccaactgcttaccccctcccctaaaatgtttttaaaattcagtttaacgcagattttgagggagaggacggggtggattacaggttaaagaagcacttggcatgcaatgaggatgcttattttatagtattgcgaaggattcggagattgtactggtttctacaagcagttttctctggtaacccaaattgcatccctcctttttgtttttcagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgtaagctgatgtgttttagataatctgcttcaatttgagttcccatacttacctgttttccaggtggattgtctcattgttagtgctgaatcttcttgcctacttgtatctgggaatttaactttgaagaggaagagagtgaatatgaataactgaaaaataaaatggtgtgtagtagcactttgtattttttacaatatactagaatttactactctagaacagattagtaggctgtagg

SEQ ID NO: 119163 - DNA, 2081 bp, Homo sapiens
aaaaaaaaaaaaatgctgagtaaactgtaaacatatactgtatgcatagctggggtacattagagtataatggaatgtactgtattttggtacttgaataagtaattagcgaggtggggggttatttgatccaagatgaggactcatttaggctgtctccacttcgctcttctctgtccttcacctctccttcatccatttatattttcttggtaacttcagttacacgttaaggtatgtactggccatagtgttttaacactgagaattcaaagacaaataatactccgattttgccttctcatagtgtataggcttcataggtgcacagagtgctgtgggagaacacaatagagaatgattaaacttgtggagggtgtgggggcagtttacggaaaataacactgaataggaatttgccaaactggggagagggagtcatgtcaaacagaaggaagtgtgggtgcactgaggtgtcaagtgttagggtaaggctagtgataaggtgttactggaacagtgggaatgactcgagatgagcctgcaaaggtgtgtctggtctagattttgaaggaccagccttgctaagctaaaagggaagtgtatagccttatctgacagcagaagagagagccaaaatattgttagcagaggagcaaggcgatttggaggtcactttggcatccctgtggagaatagagtggaggccctacaagtgtatatttgagatagtatggagttagtgactttgaatctgttttcttctttttttctgagatgaaggctcacttggagtgcggtggcgcgatctcggcccactgcaacctccgcctcctgggttccagccattctcctgcttcagcctcccgagtagctgggattacgggctcctgccaccacgccgactaatttttttgtatttttagtagaggcagggtttcaccatgttggccaggctggctttaaactcctgacctcaagtgatctgcccaccttggcctcccaaagtgctgggattacaggcgtgagccaccatgcctggcctggatctatttttaacttggatatggtgtcttctgagtctgtggtcccttaagggactttagggctatgcccagttgctctataatacagggtcatttaaaatcaaagtgtcagtatgttttggaagaagttaaaagcagtcaaaacaatgaaagttataaaatgttactcatgaaagttcaggtgttgagaatacttgtcttctgagttaggcttaggcaggctatagaccttaagctggaaaattcaaccctatgtccacttgaaatcaaagccaccaagcttaaaaagttaccagtatcctgatggtttgctaggatatgggttgtaaacattttgtgaaattttggggggaaggcagttttctctctagtaaattattggaattggaatagtgagactagcttaaggtctaagaagttctcatacaactgttaatttatacagtcagttctgctgtaaagcaacatacaggttcctaaaaatcactgctttgcagaatcgtgcagtagaaatgacttacaaatggggttggggtacagcactctaaagctttatcagtgacacatttaaaaaaggaacctggtaaaaatgatagaacagttttacacgttgaatggttaagaaatatatagatactgtaataaatgtggcattttctttgaaaaagccctggtttgcttgtggaaagggatgtcagaaaggttgctgctggtgagttactgtgaagtggtagaagaattacttataatcagatggaaggttgtaacacgagaagcaaataggtgtggctcttaacccataataaactgacttagctggtgggtgtttgaagtgtgtttcatgtatttctacacagttcagttcggctgggtgcaagctttctcccttcatctagtgtttatgtgacagaatagcacataaataaacaggaaatatggattgtgctcaaattgttctctaatttgtgtatcaatcacagtggaacaaattcaccttttcttttctttttttttcccccctttttctttcttttg

SEQ ID NO: 119164 - DNA, 1047 bp, Homo sapiens
ggctagagtgcagtggcgctatctaggctcactgcaggctccgcctcccgggttcacgccattctccttcagcctcctgagtagctgggactacaggcacctgccatcatgcctggctaattcaaatgcacgttttcaaaacaagttttatagttgattatacttgtttaatactagttttaaatagtactataactcagtttcaaaaatacttgttgaacaatctatgtgtcaggtaacatgctacctttgtggggcttagagtcttttgtcccaagtaggtttatagtgttgtggagaaggacaaatgaaccaatagagtactcatcgggttatacagtaattaagaaagcacaaagcattttgggcatgctaaggaaggagaaagtcattctgcttggaaaacccagggagtcatctcagaggtctttaagctggattttaaaggatggatagggatttgttaggttgagtaggacagggagaaggaacagcatattgggaacaacatgggctgtggagcataagacacagggatgagagggacaggaagagtggtcagaaacagcttgtgaatagttgtagggtttttcttaaagtgttgagatttcctgtatatgatagaaatccagtgagagtttaggtggatatgggtgagcaagtggttcatgtaacatactttttcaggaggcacataatgaaaatgtagaagctggattaaaggagttagagttcatttacgtcctgtgagagctcaagtacatcagcataggggatagaaaagcacaggataccagaattagggacagactagccatgagctataaaaataggaaagagttgagtatgattcagaacttgtttagcttagagaactgttggtatgatttaacttgggaaacagaagaacagatttggacgaggaaagtagaatagtttgatttttgatcctgttaagtttgacatacctcctggatacttaggtggatatgtctaacagatatctggaccagagagcggtttggggtttgatagatttggtcattg

SEQ ID NO: 119165 - DNA, 1603 bp, Homo sapiens
ttgtgaggggtaagtgggaattagggagatccaagatgatactaaggaggtatacagagatcaagtcaaactcaacttacttgttttgtaaatgagcctgggtttcctgtttccaagggtattgagatgaacaagatatagttttaggggcccggtgtggtggctcacgcctgtaatcccaacacattgggaggcccaggcgggcagatcacctaaggtcaggagttcgagactagcctggccaacctggtgaaaccccgtctctactaaaaatacaaaaaaattagccaggcgtggtggtgggtgcctgtaatcccagctactctggaggctgagttaggagaatcacttgaactcgggaggcagaggttgcagtgaaccgtggtcacgccattgcactccagcctgggggacaagagcgagactccgttttaaaaacaaaaaaagatacagttttaggaacatgatgtacttgtatttctaggactgtcactttggacggtatatttagtacattcttgcactgctataaagaaatgtgtgagattaggtaatttatgaagaaaaggggtttaattggctcttggttccacaggctgtgcaggaaacgtggctggggaggcctcaggaaacttaaaaccatggaggaaggtgaaggggaagcaggtagtcttcacgtggccagagctggaagaagttggggtggagatgctacacacttttaaacaaccagatcttgcgataactcactttctgagacagcaccgaaggggaaaagccacccctgtaatccagtcacctcccactaggccccacctccagcactggggatacaatttgacatgacatttgggtgggaacacagacccagaccatatcagaccgtatctaggatggattagagatggggagagtggtggaggaaagactatgggtgtgagactgttggaatagctcaggtaagagctgagggaattaaggcagagtgggtgagagatttaggaagtaaaatgggctagagttggagactggatatgaagactgtgactaggtaaggaagggtcaaggatatgctcatatttttggtttggaaatctgggtgtaagcataggagaaagggcaggattgaagaccaagatgataatttgtttttttagtatgagacggagtctcgctctctcacccaggctggagtgcagtgacgcaatcttggctcactgcaacttctgctacctgggctcaagcgattcacctgcctcagcctcctgggtggctgggactacaggcgcacgccaccatgcccagctaatttttgtatttttattagagacggggtttcaccgtgttggccaggatggtctcgatctcctgaccttgtaatccacctgcctcagcctcccaaagtgctgggattacaggtgtgagctaccacgcccagcctagtaaagttttttattttatgtttttattttttcaaggcaaggtctcacggtcacccaggctagagcacaggtgccatcatggctcactgcaacctcaatctctagagctcaagcaatccttccacctcattctcccaggtagctgggactgcaggtgtgtg

SEQ ID NO: 119166 - DNA, 1070 bp, Homo sapiens
aaataaaaaatttttttgagcgacaggttctctctctgttgcccaggctggccttgaactcctgggctcaagcaatcctcccacctcagcctgctgagtaactaggattaccggcatatgccactgctcctggctccatttttaacatatcactgttttccttcttccctttccatcaaaagcatggcttggaactcatttctcttaatctgttttgaaatttgtagtttcattcagctgtcttctcttgtaatgtgtgaaaattatgaactgcaataaagacaggatctttggaaagatgagttgtattgtattttagtctacttgtgaaagctgtggatttcagaatggtctttgaagaatactcagcaaaacttcattattgttttgtttagtcttgctttgtgtaaggcattcatggttctggttttgtgagaaaacagcttgtgagcagacccactgtggaggctaggtgggaaggaggtgggtaacatttaacttaaccttgaattatagatagaatttcagtgtgaaaatggtatcactaaatgcttggagatagggaagagtggagcgtatctgaaggatggcagtttgtctgccagttgcatcaaaagatatagaaggaaatattgggacagaagtctggaaaggtggaatattttgaattctcaactgcggagtttgaattcttctcagcagtagagatcttaaaggggaagagaagggatgatatagaatcatcattttaagtgggtataggaccagaaatcattacagctaaacattcaaattttattactatttttattcttatttatttatttttgagacagagtcttgctctgttgccaggctggagcgcagtggcgcaatgtctgctcactgcagcctccacctcccaggttcaagcaattctcctgcctcagcctcccgagtagctgggattacaggcatgcaccaccatgcccggctaatttttgtattttttagtagagacagggtttctccatattggtcaggctagtcttgaactcctgacctcaggtgacccgcctgccttggcctcc

SEQ ID NO: 119167 - DNA, 1100 bp, Homo sapiens
ccctatgttgcccaggctggtttcgaaatcaaatggtcctcctgcctcggcctccaaatgtgctgggattacaggtttgagccacaccatatggctgaaacttctcgattttatagtcagaagtcagcttcaccgtaatcccagcactttgggaggccgaggcgggtggatcatgaggtcaggagttcgagatcagcctggccaacatggtgaaaccccgtctctactaaaaatacaaaaatcagccacatgtgttggggggcgcctgtaatcccatctactcgggaggctgaggcaggagaattgcttgaagctggaaggcagaggttgcggtgagccgagatagcgccactgcactccagcctaggcgaaagagcgaaactccatcttcttcaagtctgcttcacaaagagcttgttttactgaattttgcagtgtaattaggacttggctttaggaagaataatctaagtggtatttaggttagttgtaatcctaaaagcataagtaccaattagaagaggccattgtaatggctgaggaaatgagaattaaagtcctaaattagagtggtggtagcaaaaataagagagttgtagtgtgagtgcatggttttgaggtttttgtttgctttccagttgcttaagctgtaagatcatgcatttcttatttattctttattcatcgtgcctggcagagtgcttgtcacattgaaggtactcagtaaatatttgttgaataaatgattctgtaaagaaaacttccttaagaaagcatgattccactgtactgaattgcttttggattttttttctatgaaaacctgattttggttgtgaagaaaaaaatagaccagttcattagcgtaatttgctaggcattacacaagacattgggagatacaaactgtttagaggtgatatatgctgtggtaaacgtatggtgtgcatgcagagtggggagtactgaacttgtttccgtgttgaggagggcttacagaggctgtaacatgtcgtctgagttcctgtgaagagaaagtaggagtttaggatgaaggttgtctttgataaagagattagcatgtattgaaagacttatat

SEQ ID NO: 119168 - DNA, 1049 bp, Homo sapiens
gttggccaggctggtcttgaactcctgacttcaggtgatctgcccgcctcagcttcccaaagtgctgggattacaggcatgagccaccgcatcctgccctcattaagctttttgtatctgtgagtttagagttttcatcaaacatagacattttctgctgttttttcttgtgtaataccttgagatacaattcacacactgtacagctcacccatttaaagtgccagtttagtgggttttgtatattcacagagttgtgccacatttgccacaatcagaacattttcatcatcccaaaaacgaacgctgtacccatttagcagtccttcctctgacatttaggaacgaagtctagcctcagttctgtgtgaacttgggggttgctgcctccaccatcctttcaggtgtttttttccctctggctcaggtagtttctcacatgcatgtgtcgatcaataccctgttgacaacttgagccagggagtggggggccccatcagatctccagacttctctctgttctcttctcttctctctgatgttctgcctcttgatttctaatcaccttggcttccctggactttctgtctctggaactcagggaggatcactgtcctctacctgggattcccctccttgggctgcctcctgtaagtgctgtccaaggagtaagctgagacagttatagggtctaccctgtttgtttcccacccttcaggaatgactctcctgcattggttggtgtctcatcttagaaatttgctgattcatgtatattatctgatacgatggttgtcacaggtggcatggtaaatttagttcctgttactcttatcttggttggaagtctcaaggtcgcgttttcttcagccaatagaaaattaatcagttctgaaagactggtatgtttttattacatttgtttcattctctctcagattagatcctgaaccagtaaggagattatggggaacattcttagattgtagaaaccattgacaatttatcaagaagtgtcaaagtgcagatttactgttgcattgaaaggt

SEQ ID NO: 119169 - DNA, 2444 bp, Homo sapiens
ttaaaaaatctaagtgcaagtgtatatttgtcattagggtgttttgttgttagctttgtgacattgtagagttttgattctctgatgcattacgctggctttcatccttcccttcactgtttcctctgcccacccactctcccagtcacctgcctgccccgttcgtgttttgctcactcttgtttgttataaccatctgtattattgaaagtgttggcaaggcagggtcagatatagagcactgctagtgcatttctgattgacatcagcccattaacattatgttttgaatgtgtatatagaacatggtatgaatcatttttacttatatcagaaactgaaaaaacaatattttctatagtctgacatcttactagtaactataacatagttatggatgatctgataattttgatacattttaaaattttgaaacattttattacttagtttcattttacttatttcaaaaatatttccaggaaatccccttacccaggatatattgaacctttatcaggaaccagatggaacaagacggctgctgaactatttgcttgataatttgtcaggtactgcaaaaagaagtaagtggttatttgtttaaacctttttattaggaagacgtgtaagaatattgcttaattctgtattttctattcaactagttacaacagaacaaccacctccaaggtcttggattatgttacaagaaccagataggacaaggccaactggttggtagtcttttattttttaactgttatttttgctcagtctctataagcctaacagtattgtcagcatgcttagattacaggtagcattaagacaaaatgtttaaggttggtttggtttgggaggtaataaaaaagaattcttgctcacatgacctctatgtatactacattgtgctatatagaaagtgtgctataaagcagtgcttctcaaacgggcagtttatcccccagaggacatttggcaatgtctggagacaattttgatggtcgtaactggggagaagtgctgctggcgtctggtggatggaggccagggttgctgctcagcattctatagtacacggcacaggcccccacaacagacttcacctgaaatgtcagtagtgcgactctggttgagaaacccttctgtagtgtactgatgaaattcacttaaaatgaatacacccaaatttttctctatgagaagtttccaaatcctagcatgttccaaatggatttgacactaccgagttataagagagccaaacccttacttagaggaaagtggaactaatgactgctcatctccttttaacctaaattctatgtaaatagtttgggagctttcatggtgcgtgtaacaaaatttggtctgtgataccgttttcattttgcatgaattaacaatagttgtgctgtagaagaaaatgaggcatgcctattaaggatactacctatccagtttccacatcttacattaacagttggtagcatggtagaaggagtatagaaatgaggaatgttaggctcagagactgaagggctcacgagcttagacttttcacttccagaccttctgtgcctacctctgtagcaggtagtacattgtattctaacttgttcacttatctatcctgcttgcattatccgtcttttatttatcccccatatgtggcgtacagtagcttttcagtgactatagattgaatgaatacggtcaaacttaacatttaagtgaaaaccattactgaaattaattatatatttttttctgccacatgtgtgaataagtaaagttatctttcctacagccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggtaagtcagacagaagacagtcaacctagcattgataaaggaaggagcaactaggaatacattacgctgacacatttgaagttttagcttcagtagttcttaaagtactgcttttttctgttattagtgaatcctgggagtactgcctgctttgctttgcagtgctatgttgcaaaataggcaaatgtgttaagctgggatttatgcgtttgccatgaccgctaaatactcaccttcctcctccctccagcgtccctgcactatttttgaattgggtggcaaagttactgaaattctagcgtggtcaagctataacttgcattgccgaccatgttgctagaacaattaaggcaccgtgtaaaaaggactgacttggtacacgaacattttgggttctcagtgcaactctcatagtcactcatatgatcttgaacatgttactttctgcccaagggtctgaagttatgatttgt

SEQ ID NO: 119170 - DNA, 1097 bp, Homo sapiens
ttttttttttttttttttttgggtggtggggagacaggctctttctctgtcccccaggctggaatgcagtggcatgatctcagctcactgcaacctccgcctcctgggttcaagtgattctcagcctccgtagtagctgggattacaggcatgcaccaccatgcctggctaatttttgtatttttagtagagatggggtttcgccatgttggccaggcttggtctggaactcctgggctctagtgatccgcccgcctcggcctctcaaagtgctggggttacagacatgagccaccatgcccggcccggaaagatgttacattctttaatctgcagaccagtcctttgaaattatttcaagctctcaaactatacatagaagttaatatgcagactaatttttgtcttatgaaataactgtgctgtttacaacttttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaagtaagtcatcttattttttaaaaagaacgttttctcagtatttgcagggtgggggccaagggtgtggaaactaattggcaaatgagagaatgaggcactatattattactgaagcaaagaatactgtttgacctagggggtttttgtttgtttttaatcatcagaaataaccttgttttggagacatgcttaaagtactgctgtttcttcaggtgtttactagggtttaactcccaattgttaattgaaataccatgtagttaaaattccctctatgacggtacagggattcttaaacccatactttagaaaagaattgtttaaaaattacaaggtagaatattccaacataaaacttaaacagaagatgactacattttcttcagttgtaaaaatatttcaagttgttatttgtatcaataacagactgagagcaactttaaatggatgtgggaagcttgatgctgaacgtggaggattttccgtaatgtgatttaagtgc

SEQ ID NO: 119171 - DNA, 1050 bp, Homo sapiens
ttggcctgtaactagctggtggtattctcttccatagttggcagcattataaaatggcacattcagtcctaatcttgggattttataccaagtaaataattgagcgtaagccagaagtctgcatactaagatgctgatcgtggtgttatctttaattctttgtaaaaagtggaaacaacctgcattttacaaaataagtaaccagtaaatattatccaccagcccaattgcattgtgcagccattaaagaacgataattgggaagacacatgttcataaagcaaattataaactattcaatactctgtgatgacaactgtgtaaaaatagatttgggcaagtcctggcaaatgtaaaaggaaacattttggaacgtgggaatatgtatagtttaaaacttcttactattgcatgatcttttaaaattactttttgtatatatttgacaataaaaaaatttgtcttcattgtaggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaaggtgtgtcttgagactgataagcttttcaaacctgtcttttactggcaggtgttctgatacatcattatgtctttaaaactgtggctgtgtgttcaggctggaatgaagcagtcttgaattcattgacagcaatgttctttgttttttgtttgagacaaggtctcactctgttacccaggctggagtgcagtggcacagtgatggctcactgcagcttcaaccatgccggctcaaacgatcctctcacctcggcctccctagtagctgggactacaggcgcctactaccacgcctggctaattcttgtattttttgtagagatggggtctcgctatgcccaggctgatcttgaactcctggcctcaaatgattct

SEQ ID NO: 119172 - DNA, 5803 bp, Homo sapiens
cctggcctcaagcaatcctcctgccttagcctcccaaagtgctgggattatagacgggagctaccacatctggctcagctgcccttttaaactactttttgcatttctgctttcttaaaaatttcttaactcccagctttctatttctaagctgctggaaaagtaatcatttagattagactgtcagagtgtaaataagagtttagatagtatctcaggagcctttgcaccttagagcatagaaagtaaacccctgtttatcctcaggtgccccttcctttcaggttcttcaggagacattgaagagaaagcatgggtagcagccacagagtgggaatgcttagcgttttctttctctttctgttgctgatgcagtggcaggaagaagacacttgaatgtgcttcagtacatttggccaagagcatgtagaggggaggaccagaaccatcagatgggaacagtttagtagatgccatggcggggtgctgctgagagaaaagggggtcaggtagagacagtcctgccctcatggagctgaggtgtgatgagagagacaagtctcaaccacacaaatgagtagataattacaccttgagatggccattagcaagggaagtgaatctgtggtgagaggtagggtagtaagtaggtaggagcaggattcaggaaggtctttggaaagcagttgaacctgacattgaaagattaagaaggaattgacctcataacaagtagaagaaagtgttccaggcagaatggtggaggggggcagtgtgtgtgtgtgtgtgtgtgtgtgtgtgtgtgtgtgtgtgtgtgtgtgtccgtccgtccgtccgtcctggggcaggaaagaacttggtacctataggtcccctcacatcctcacccctttctcattccaaaggctagtgtggaagcagggaaagtggcacaaattaggctaggaaagagaagcagaggctgcatcctgaaaggccttttaggtcttgttaaagatccagataagaagaatgcttcattctgctagatttgacattttgcacggggaccatttggtgtatgtagtacagacctcatcctacaagctagtaagtttcacttgttctgttctgttcaccaaacatgacataaaggcatgtcttgaaagcactgaggattttagtgttgtcttatacggtgcttatctttttttctgttgtttttcagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagtagcaaacattgtgttggggttataataattcattaaatgtcttgttgcctgtattttgttgtatgtgtaaactctaaaaacgtgtgacttcctaagtcttccgatgtcaccttacaattgagaaaacaacatgagttcctttgcttttagaacgacttccatagcagacgtacatttttatgtacatgtgggaaaaaccatgcaaaatctggacagtttagataatatttc

SEQ ID NO: 119173 - DNA, 1221 bp, Homo sapiens
atgcagtccagcagcccacgtgatcctgcagacgccgcatcatgctgaactgctggtccggagaccccaaggcgagacctgcattctcggagctggtggagatcctgggggacctgctccagggcaggggcctgcaagtgagccccttccccaccctgttctactatggcctttggcccctgccctgggtccctggcccgagctgcccctccaagcccatctaggctctgcccacctctcagctgctaggctagggtggtggggtcctgggcccctatccacacctcgtccccacacccttgcatctttctgttgagtacacacccgctgcacagctccactgcctgctccaggtgctgtgtggatagtcagagcctgtccctgcgcgaggggaatcctaggctggtcccccccggcctgtgaggcagccccatctccctggcatcgtcatgatgtattccttcacctggtgccagttctgtcccccactccactgaacacacggacccttgacctgtgtgtgctgacatctctccctccccacgtggtgctcctccagggtgggggatggagccggcttgtgacccagctcaaggtggggcctggagcaagaagcagggggtggcctgttgcccaggccttagggactgggatgggtgctgcgggtctagttccatccaaagaagaaggtagggagtgctggccccagttcctgaggctgccagctcagctagggactggaggagggatgatccggctgagccccagcctgccccacctgcctcatccataaatgtacctggaagggctgttgggagaacttagcgaggctggcacagccagcattctgctaccttgaccccttatctgtcttgatggctgagatgtgctggtttctggcatgagctcgtttcctctgtggagcactcacgtgcccgcatggtctgttagggccctatctcaggggtcaggagcccaagcagtcccgagggcagagcgagggctgagggcagggcgagggcgggggcgagagctgagtgcgggggcgagggctgagggcgggggtgagggctgagggcgggggtgagggctgagggtgggggcgagggctgagggcagtggctggtggtttctggcctggctgcctctcctgttcccgccaggaggaagaggaggtctgcatggccccgcgcagctctcagagctcagaagagggcagct

SEQ ID NO: 119174 - DNA, 1183 bp, Homo sapiens
ggaggagagaacggggccctacctgctccagcgggtggctggttcaggaccagcaccacccagccccgtggagccctcccccagcctggccgccacgtcccttccccaacagcttgctccctctccatagactttgagcagccattcatcaacaagcctgacacgctcttggtcaacaggaaggacgccatgtgggtgccctgtctggtgtccatccccggcctcaatgtcacgctgcgctcggtacggccccaccccaaccccagcatccgaccctcccatcccacccctgggaaaggcggccgcctgtctggccaggagcaaggggcagctgggcaatgatggtggccttgtccctccagcaaagctcggtgctgtggccagacgggcaggaggtggtgtgggatgaccggcggggcatgctcgtgtccacgccactgctgcacgatgccctgtacctgcagtgcgagaccacctggggagaccaggacttcctttccaaccccttcctggtgcacatcacaggtaacagggctgtgccccgttcccagtaacggggctgtcactgcctcactggcctcagtgggtgtcgtcctgtgagggcgtgggagtcactgtgtgcgtgtcaacaggcaacgagctctatgacatccagctgttgcccaggaagtcgctggagctgctggtaggggagaagctggtcctgaactgcaccgtgtgggctgagtttaactcaggtgtcacctttgactgggactacccagggaagcaggtgaggtcagcagcgctgccaggctgtcctgtccccaggagtccctgtgactgtacagcacacactgggcctccgcgtggaggatgtgtgggcccaggcctgccccaggggccccggtctgagtggcaagtgttccacccaaagaaaactcagggcctgggtccagggcttccggagccaccgctggctgggctgggaggtgtgccttcggtggggtagctgtgcaggagcccgcctgctgacgcggggcttccctgggtgcgggcaggcagagcggggtaagtgggtgcccgagcgacgctcccagcagacccacacagaactctccagcatcctgaccatccacaacgtcagccagcacgacctgggctcgtatgtgtgcaaggccaacaacggcatccagcgatttcg

SEQ ID NO: 119175 - DNA, 1067 bp, Homo sapiens
caggcacacccccggccctgtctgaggcccgcaccaccctagcccacggccaggcctgggtagatccaggtggtgagtaggggaggcccgccacgtggccggcgaggtcagcaggggttcatgggaaaggacttgtcggccacaggagaggacatcctgcctgcatttccctcttcctgcggcaggagctggtggccccgatttagcagcactggggggccacctctgcgccagctgggttgtctgataacgccgctcgtcctgccggccagcaagcagagccttgaccccacggaagccggggaaactgcctggcatagctggctgccccacggcggccgtgtgctgggagcttagcatctgctcaggccccctcctcctggtctccacccccacggggcactcaggcagcccacgctccccgcaggtccagcccttctcaacctcatcaccactccctgtttccagcatcttccagaaatttgtctccattctgccccaaagggactgctgtaaatgagccttcagggccccccccaactcacccacaagataagcaccagcttcttgggctcgtggtaccggcccttcctgctggagtcccaggccatccctagccccgcgtccacccagcctccacccactgcacacaccagccccagcaccatggcctttcgcccaccctggacgtgccctttgggagactgctgggaactccgggcagacggtgctgctccaagcggaaggggccttccggggcaggtgatggcttcgttcccgctcacagtgtgcctcagactttcaggtgggtttaggggaagcccccatcatcacccaactcaacacactgtcctcgaagctactctaaattctaccaaatggagattgatttgttttaagcagcaagcgtgcaccggcacatgcacacagatgtggcgtgtccggcagtgggccacacctccgtgtgaaatggtttctcagattgcttcacagcagggcacgtacaggttttaacctcgtcacgcagaccttattatgcttattttggagattaggaaattcaggcc

SEQ ID NO: 119176 - DNA, 1078 bp, Homo sapiens
ctcctgaaattggcccccctggggataggagcccatcctcaaccatccagggctctgtgggaaacaaggtttgagtccttcttcctggctctggggacagagtcagataccatgcgccaaaggttcaagatggttccattttatttgaagcaatgtgtttctgaagaacctacacaattctatatgtacatttatcaaaactaacctttcacttaggggggtgtgtgtgtgcgtgtatgtgtgtgtgtatgtgtattgtatgtgtgtgtatgtgtgtgtctatgtgtatgtgtgtgtatgtgtgtatgtgtctatgtgtatgtgtgtgtatgtgtatgtgtgtgtatgtgtatgtgtgtatgtgtatgtgtgtatgtgtatgtgtgtatgtgtgtgtatgtgtgtatgtgtatgtgtgtatgtgtatgtgtgtgtgtgtatgtatgtgtgtgtgtatgtatatgtgtgtatgtgtatgtgtgtgtgtatgtgtgtgtgtgtgtgtgtgtcatacctttccacttgaagaccgtctttcattttctccacgaccttgtgtcttctacctcacagattctcagacattgacttgtttgagtttctcagctctggcactggcgctgctacttaaagcatgcccatctctcactgtgataagcgccaaaaagcagtgtgcccacggaaagcacttgcagaagtgaggtgctgggacacagctgccaggattgaagatactgaggaaggaacggtgccaacaatttgctgactgcttccatggcgacaccgtgtggccatgttgtgccatgtgtccacacgtctgagacctgtcatctttaagatcactcctagtaatttaaaaaaaaaatttgaagtgagacacattatcttcaaaaattgtgcacaaagtgaggccttatgagcggtttttagcatgcaattttaaattcacgtgtctatacgcctaagacctgtcatctttaagatcactcctccaaataatttttttaaaaaaatttgaagtgagacatattatcttcaaaaattgtgcacaaagtgaggccttatgagcggctttagc

SEQ ID NO: 119177 - DNA, 1028 bp, Homo sapiens
tacatctgagtcttttaaaagcagcttccacattattgcatttgaccttaatctcattgctgtgatacatcatctctacttttaggcaaggaaatgttggatctaaaggactgactgacctgggtgaagtcctggaacaaacaggcagcaggactaggattcaaacaaaggccatatgattcccaagccagtgatttccactctgaataagagaagggaaagaacaccagacacaacaaactgcagagcaaaataggtaataaaatgcatgatttagtattcagggaatcctgcgaaataatgttgtagcttgtgctcagtataggaggcattgcacttccttctgctgttcagacaggcaaaaggccatgggaagtttcaacaccagttttgaagatggcttcattttggtgggattctcagattggccgcaactggagcccatcctgtttgtctttatttttattttctactccctaactctctttggcaacaccatcatcatcgctctctcctggctagaccttcggctgcacacacctatgtacttctttctctctcatctgtccctcctggacctctgcttcaccaccagcaccgtgccccagctcctgatcaacctttgcggggtggaccgcaccatcacccgtggagggtgtgtggctcagctcttcatctacctagccctgggctccacagagtgtgtgctcctggtggtgatggcctttgaccgctatgctgctgtctgtcgtccactccactacatggccatcatgcacccccatctctgccagaccctggctatcgcctcctggggtgcgggtttcgtgaactctctgatccagacaggtctcgcaatggccatgcctctctgtggccatcgactgaatcacttcttctgtgagatgcctgtatttctgaagttggcttgtgcggacacagaaggaacagaggccaagatgtttgtggcccgagtcatagtcgtggctgttcctgcagcacttattctaggctcctatgtgcacatt

SEQ ID NO: 119178 - DNA, 1024 bp, Homo sapiens
tgactcattttcacctcagccttccctaggtggtcacagatgttccctgcacaacctcacatttaaaaaatatatacattgcccacactctgcactggtcagacagaattttgagtatttggcatgttcttggcattagactgggattaaaactttgacaaaaatcataggatcaaaggacaataaaaccaataagtcatctggaaacaccctgcatgagaaataggtgttttatattttattttaattggcacgtaataattgtacatatatatgaggtacagagacatatttagatgtatacaatacataatgctcaattcagggtaattgtgaatagcatatttatcaaattaggcattttaattgagtttttagatcagaaaatagaagtctccaaggcaagcctgatggcttgtacgcaggttgaaagatctcatgtggagaatgtcgtgaacttgcattgctcttctacaaaggtcaaaactaggaccaacaggcgaaacttacaagagaacagattgtggctcaatattaaaaaaaaaaaaagtgaataaaatgaagcagtctaaaactaggctgcctggaaatgtgatattcccatcactcgaaagcttcctgctcattcagagggtgaaagttgacttttcaggatgatgtgaaaatgttcctgcattaactgaaacatttgttaggtggttttgagcactgcatccaaccctgatagttttctaatcttaacttatctttttaaaatttaacccctattcttatccctttggcacacataaagcattcctgcatttcatgtgcatatttgatattgttaaatttctgcattacaaagaccaatggttgtgctcatctctctgggttttgtttttttgcatttttttttgagacgggggtctcactccatcatccaggctggactgcagtggcactagtgatcctccccaccaagcctcctgagtaagctgggtctacaggcatacaccaccaggcctgggtaattttttgtatt

SEQ ID NO: 119179 - DNA, 1021 bp, Homo sapiens
ctcctgcccttctctcctgtctgacccccacttagcccttctctccttgcagcctagcagtttatagttctgagatggaaagttgaagggggcaagcaagacctctcctcagcccatgcccagctgtcaggagagaggtgcagggaggaaggccttgtgctgggacaacctctctcttgccttacctcagagagggactatgccctgacccctcctttctgaaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaaagtggaagctacagaattattttctaaaataaaggctgaattgtctgaaaaatatttatgtgtgtgtgtcctggaaaaggaggtggcaggcagggaaagaaaggaaaagggagaatgaagagttaaggagagggctagacgggtgggaggaagcaaagttgaggaaagaaagcagatgagtgggagggaagagccagggacagcccaggggatgggggccaggtgggaaaggaagtccaggccacaaggtggagaggagccccggactgtgctcctgctgatcgtcctgtagagccaggaggccgcagcaggaaagctggtgagtgtctcctgcttctgcctcctgctggctgggcaggcctggtctggggaagaaccaggtcctctgatcagggtggtccctgagtggtgctttgtgcccggtgccctctgctggcccaggcagtgcttattgagtgccctttatgacgtgccggggagcctcagggtacacagctgataccagggttg

SEQ ID NO: 119180 - DNA, 1054 bp, Homo sapiens
ggtccatggggttagtggttggaggtaaggttgaaaagggatgtttcagacagtctgtctgaagggctttggatgtcatcataatgagtttgagtttgagtttgtgggcagtgcagcctctgatggtttttaaagcaagttaatgtcgtgaccaggtgtacttgtcaggaaggatgcgctgttgctgttgggaaggtttgtgagagggaagcaagattagtgacaggtggaccagctgggaaactacatcaagagtccagacttaaaacagtgtttcctacgaaggaatgagttcaggttaaagggctggagggcttgacatgggatgctagcagtcaatgagtaactttgtacttccattttcatagttttgaagttcttggtcctagatgtatttcagaattgagaattttttggattttgaaaagatgatctggtgaatttactctgtagtggaagatcagaagcagcatggcataagccaccatgtttatttctgtagcaaaatgtatgaatagccacagcaggagagagaaaagactataaatagccccatattagatcagatcagattttaccaaatgaggctggatgaggttttactgccaattgagtttagaaaacttctgtgttttagtgcttcttggatttggcagttacagttgaggaactgtggatgtttttagatcccaggcacatctgctgaatgttgagagccctagcacagcggcttggcagtgctggtggagccaatccctgtcttcatgtagcttgcagctgagggggcctgagagaagttgagcaagtggttgcgcttgttgctgttggtgaagggtaggtggaccttacatggtcccaggcgtcaaggaaggcatcttggcagagacacgaatcagagtgtgccaggtgaagaagatagggaagagcagagctggcacatgggcacatgcaaagaccccgacggtaggcttggctgttggggtaccagacgggagtgtggtagagtggagcaaagaaaatggggagaaaggagtgaaataacggccgatattta

SEQ ID NO: 119181 - DNA, 1742 bp, Homo sapiens
catcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaaatcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatcaaaacgggctgtgagtttagatggagga

SEQ ID NO: 119182 - DNA, 2114 bp, Homo sapiens
tccagggttctagcattttaacattagttccacaggggcagaaattttgtcatattcattgttgtatccctagtacttaaaaaccggtacatggcacatggtacctgtcacacagtatgttgtcagtaaatgtttgtcaagtgaatgttgttcattgttattccagtttgtttttgtttttttttaagagagtgaataggtgtccttttcattttcttggtttagtgtcacatttgaagacgagcactgaggatgaggaaccaactgaagaatatgaaaatgttggaaatgcagcatctaagtggccaaaagtggaggatcctatgcctgaatctaaggttggtgacacatgtgtttgggatagcaaggtagagaatcaacagaaaaagcctgtggaaaacaggatgaaggaggacaaaagcagcatcagggaagcaatcagcaaagccaagagtacagcaaatataaagacagaacaggaaggtgaggcatctgagaagagcttgcatctgagcccacagcatatcacacaccagactatgcctataggacagagaggcagtgagcaaggcaaacgtgtggagaacattaatggaacctcctaccctagtctacagcagaaaaccaatgctgttaagaaattacataaatgtgatgaatgtgggaaatccttcaaatataattcccgccttgttcaacataaaattatgcacactggggaaaagcgctatgaatgtgatgactgtggagggactttccggagcagctcgagccttcgggtccacaaacggatccacactggggagaagccgtacaagtgtgaggaatgtgggaaagcctacatgtcctactccagccttataaaccacaaaagcacccattctggggagaagaactgtaaatgtgatgaatgtggaaaatccttcaattatagctctgttctggaccagcataaaaggatccacactggggagaagccctatgaatgtggtgagtgtgggaaggccttcaggaacagctctgggctcagagtccacaaaaggatccacacgggggagaagccctatgaatgcgacatctgtgggaaaaccttcagtaacagctctggccttagggtccataaaaggatccacacaggtgagaaaccttacgaatgtgatgagtgtgggaaggccttcattacttgtagaacacttctcaaccataaaagcatccactttggagataaaccctataaatgtgatgagtgtgagaaatcttttaattatagctctcttctcattcagcataaagtcatccacactggagagaaaccttatgaatgtgatgaatgtgggaaggctttcaggaacagctcaggcctcatagtgcataaaaggatccacacaggagagaaaccttacaagtgtgatgtctgtggcaaagcattcagctatagctcaggcctcgcagtccataaaagcattcaccctgggaagaaagcccatgaatgtaaggagtgtgggaaatcctttagttataactcactacttcttcaacacagaactattcataccggagagagaccttatgtatgtgatgtgtgtgggaaaacgttcagaaacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcg

SEQ ID NO: 119183 - DNA, 1702 bp, Homo sapiens
agtacctggaggggaaggtgtagaagaggaaacaaatttgctttctgatactttaaaaactttttgtttggtaataacttcaaatgcacagaaaaaattcaagaatacgaacagtaaaaagattcccatcactcagatttacctgcagttaacatttgacttcattttgtcctcttgctctctctttcatacatgcaagtatttttctaaaccatttgtaggtaattatatacatcatggccctttatccctaaatacttcagcgtatatttcctaaggattgggatagtctcatagataactacagtaagttttcaaattgagtaaattggaagttgatactgcttttacctagtctaccatccattttccaactttttcagctgatgtaattgttttctataacaattttcccctccgctacagatccagtcaaggtcaggaatgtaatatagtggtcaagtctctttagccttctttaatctggaacatttgtacagctcttctttgtcttttatgaaaatgatgtatttgaaaaatacagtcccccctcttctctccaccctctgttttagtagaaaacattgttcgttttgggtttacctggtgattcagttcatgtaatgcattctcataggtgatgtgtccttctccctactaaaagcatattatgtctatctgcccctctggaggtgttaaattagaacacctggccaaggcattgtctctccactcttgtatttttcccccttgtaaataatttaagcattataaatatttaagaccatgcggatatcctgctccttgtcagaatttcctcctagacgtagaattcactgatgattctctcctgatccagtctttactctgatagttgcagagtgctgacttttccaattctggtattccttctacatttatcaaccagcactcacattctgctgtaagcaagaggcctccctttctcccctgtttgtacctgtgtagactcatgaaatcctatcttcagtggtttataatgtatcactatacttagttattacggtgcttgaacactggatgttcaagctgggtcttgcagcgtgtccctaccctttttttgagcctctctttacttgctggtatagcatgatgctcatcttgtatgtttcctgctttcagcctgcaatcagccatttctttgaggagctctggttccttttagtaaataatggtaatagtagacccagaatggggtactagatgtgctcattaccactggagtgttttgttttttgggctttcagcaaacagaactaggaaatcaggaaatatatgcaaatatatgcatacagccatacaggcttgaatatacatgcatgcacatatatgtgatttagaaatcataagttcacaccagtactgcaaattcatcccaaggttcattttcgccttcttctcttgcttatttttatgtccctttctctaggagagccctgagcccaacaaaatcaacacatttactcaggttcttaatacatctaaagttgtttcagaatcgctttgttcatacctctacagaaaacctgctaacagttgaattatttgtacctcttcccactgccccgcctccagctttccccagactgaatgtacttacgtagtcaaatacgtttctaagttgcctggattacttctgtatttcttttttgttctcttcctg

SEQ ID NO: 119184 - DNA, 1129 bp, Homo sapiens
tatttttttacattaactcaaccagttattggcagattgttacatatgacaagtcgttatcaaaatcactgatgtagagtgtttaaagaacaaataagacgtaagtagttcttcccttctgagacttgtccctatatttagtgttacactagcctaatagactaattgtgtcaatgactccaagccagtccctgccgggtttgattcagaaaatcagcctcccttttagtatcgcctttgctcacctcctcccctacgacaactagaaatctcttctccactacttggcatgagaatgttctatttcagttttttactttaaggaaaaatcacctttcattcttatttctatatttaagcaatagaaccaactcacgttaatcatatacattcctaatattcataagacaaatgcaacagtagctagaacacaaaccatattctcttctcatctgcatatcacttctctgttccttagtcccatctttcctttgtacattttgcccctcctaggtactctttgttctgggttggtaagcattttgtcactttctcttgtcttgtttcctttctttgctcatctccaaatcaaagacagtatccaaggatttaaggtgtagaatccacgcgtgaaccttgaggtggtagattgtcttgtggaatatggttggactctgcaaattgaaagtcgttccgggctagttgcagtctgttaataggaaggggttttcggccagagcaggccacggctcctctctaacgagttgtctcggctcttgaaaagtggctcctgagtctcggaggcagagacagcaagaatgtagggccggttcttaactgtttgcattcacttttctaggccttggcgataaagcatgaacaagaagctcggaagagtgcccagaggttgttggtcgtatgtagtttggaaggagtgggtggcgttctatgtctgacgcttttggctgatgtaaccaggctattagactcatgctgcgtgttgaaaactggttagaaagggcttgtccattcagcctttagaacttttaagaaattcaggagtttctgggtctttatatggaagagttgtgttttgggggtaattccttacttgtgtcatcagggacac

SEQ ID NO: 119185 - DNA, 1232 bp, Homo sapiens
gaaagcacgtgaagagttgtggcaaagggtgagaggtccactgcgtgggtgagacaccctgcagccagcagccactggaagctgctgcccctgaggcccacgcaggcagtgaggcgtggcacacttgcttatgcttacatctgggaggcacagcaaggggcaagctttgtttctcagaggtgaatggaggttacctgatgctgatttggtttcctctatctttccttccaggaattcaaaagcacgctgagcaggtgagtgacctcacagctcctggggcctctctaagttgcttcttcccttttcactgagccttgtctttattccctgtcccctgacctctcacctcctgatcccccgacttgcttgcctggggaccttccgagacaaacgcccacctgcctggccatgggtttttctgcatgaggtctggctctcccttttctacctctttctgccaagaggacctcgccatcctaattgtcacagcctgtgggagcaaaatggtgcacacaggcccttctcagagcccttgtcctgcaggtgtagcaatgtgcctggccccaagccaaccacagtctcttctgagatgaagaataaagtctggaatgtttctctcaagacctttgtcttaaaagggatgctgaagaagttcaaaggtaggggcctgggcgccaagctgggccacatagtgcggtggtggtggagggttcctggtagctcaggggtccctgggtgtgctttccagaagctgtgtgtgaaaataggagctggctgtgccatggccagattggtgtaggggctgtggtggcaaatctagtcaggcccccgcagggcatgccgcttctcatgggcacagatggggtagaggggtactgctgggggactggggttaggaagagagctgtgcaggggagctcagctcagagccacttgggtagagctagaatgcttgggtatgggccccctgccccccgctccccatgcttggccctgtgcctgcacgttcactcttggccttaggagtctctggggaatgaatgagtcagttgggatataaagagctggtgaccttgccatataatctcccgtgtcgctcatgcacgccttgctttgtttctcctcctcagaggaccttcggggagagctggagaaagaggagaaaggtagggatggtgctgtgatggcgagtatggactgtctgccacacagagatcctactccctgctcgt

SEQ ID NO: 119186 - DNA, 2497 bp, Homo sapiens
ggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggtgagagaagtacagagagaagatgggagtttagtggggggatggagaggaagtaaggggacctgggaaaaggaaacatctcttcacccaccaaagaacctcatggtattggtgagccaagtttgcttatctaagcacttactgccaccaaggtggattagaatgagaaggattctgtacacagagcagatgcagtgaagacgaccagggaaggatggcttcctcaaagcaaatagagcaaagccggtgatgccagatcaggtctctagggctttaccagaagtctcgttttctttcgggtgagtcttaagtctgtccttgacggagacacctagagatggaaagaactgggggcttcaaaggacaagaaaaggctcagaagcaggaacacagagataactgctagtgtcagtgtcagacccaaatgctctgcacttgcctcccagtgggttccccacctaccacgatatggcttggttctgtcttcaaggactttggttggctctgtgtcattcttatgcactgactagaaagcaggagcttttcagtcagaagacctggctctgcaagttgcattgtcaaatcttgattaagtctgtgagtgtctttggactttaatttgtccaggattgatagttaatattcactggacatttatatgtataccaggcactgtactaggcacttttcatggactgtctcgttaaaacccagacaacactgagtttgatatgttttccattcccattttatagattgggaaacaaagtcagagaggctttaagtaccatacagagggccacagagcttcagtaataattgacttagttatttactgtcccttcccctggtgtatactaacaacgccaccaccatttggatgtctgttgtttgacttttctgatgtgactttcttggagtctgattctagtttgacaaataccttgcccctacttctcattttgactcttctttggacataggtaaaggagatttgtttgcaaggcagccagcacaaatagcactacttagtgaaggcctggatgggtttgaagcagtgggaccaggaggaggagggggtagcctctgtgtggtctgcacagagctttttttgttttataactcatgttttcagaccttctcctgattcctgctataacttcatttaggtattattttcgttaccccaattttagagtaatgtgtctagggtttctcagctctgagtggtacagctagacatacctacattacctcatcacaagtaacaatttcttttacagagtggccttttttttttttaattttttgagacggagtctcactctattgcccaggctgaagtgcagtagcatgatctcggctcactgcagccttcacctcccgggttcaagtgattctcctgcttcagcctcctgagtatctgggattacaggcactcgccaccacagctgg

SEQ ID NO: 119187 - DNA, 3044 bp, Homo sapiens
agccccacagtttccctggggcccaacttccctcaggacccagtctcaggtctgtgaagggaaaggcaaaggaaggtcgtggaggtgacctccctacctctcgcagcctgacagaacatccggctcattttcctcacgatggcatctgtcaggaagtcatggctatggggttggcacgggtcaggggaccagacctctgggggctgcagctgtacctcttcacacctggaggaaggggaccgggcagggggtgggaccacgatattcccagagggaaaagcaaaagctgaggggaaggagaggagggtccaggagatggaaactcaggtcctggggaaggaaggagaggagagggataccgaagagaagcagggacagggaaccagatgccactgggtcacgaagggcaaagactgggaacacacctattgaaagtctccttgatgtcctgggaataagagaaacaaaaagagggagagggagaaagagataaagagagtgtcagctgcacagggacagcgttccccgatctccagtcagagactgaacctgagcaggaagggagaagcagcaccctcacggccctcaatgaacacacatccatttcaaccaccccatgcctcgccatacctaactcgcctcatcctgctgtgagcccagggatactgtcatttccacaatacgacttgctcacctttttcaggatgtcactgtcaaaaagactttcctcaactgtcatttaaacctctcctacaaccgaatcttcatgcttttcactgggtataatcgccacacataccacattcgacattaactctgtttccagctttaaaacatgtttttggtcttcaggttcaatcactgtgggttcctcccagggagaaaagaggcagctctggacaggcgtttggtaagcactgcctgacagccaacacagaatgctgggggaacagggaggggacattgctcacctggagcagccggagacccccctgctggctccgctcctgggcctctgccagcaggcggctgagctgggcggcctgttctgcaaggcgactagccgcggctcccgcacgccccagctgggcttcatgcatctctctgagacgccgttccagccctgcctgctcttcagccagaaaccgtgtcagtcgcccaaactccgaggccaccgctgccagctctgacttcatctggctctggaatggtgcaaaggggatggcagacaccacctcaacacgtacgaagataacctccagttttgcaactactacttctcaatgcaaggcaaaggagccctacactccccaggtccaagatagtcccggaaagaggctcatcccctaccagccttaccagataccacccccttgctcccagcacagtggtctcaaactcactaacctctgcctggaacactcctctccacctgactctacctaagttgactcatccttcaggtccaaccttaaatattccaagacaagccttccctcctctccagatctaaatcgggaccatccccacaaatatcactgtatctctctgtggcacatataatattgaaacgttgtgtttaaatgacgtaactgttaacatcctttcccccactgtaccatgagctcccactgacagggactaggaatgtctttgtttgccagggtcctcggaccctgacatagtaccaatcagagtaggcacctggtaaaaatttttgaaatgaataaataaaagaattcaggaatcaaaacatgaagttagggtcccgacgccattaaacacagtgaccttaagaaagtcacccaaaagccccagatcagaactcggaaaaactttttctgtgaaggtccagatagtaagtatttttatgctttgtgggctaagaggcaaaaatcaaggatattatgtagggacttaatatcctgtaacagaaaaaactcctgcccagtcccaccctatttgccagggatggcccttcctgggtggtaggcacacttttcacacagctaccatcggctgcagacgctgtgagcagcaggccagaggagggtcccaactgaccagacgcgtgagggaacagccgccacagtcagcttcactctatgccaggggcacacagctcctgttacctctatacccaggagagcccaaaagtatcaacttgggcagctggccagaagcacgatgacttcctactcccagacagatcctaccattcagtgcctagcagtcgccagcagcagagtccctaacgttcaggtggcagtgagcatgggccctgggtagtggcaaggcccaggcactggctgggaagggaggagggaagagggacagaaggggaggtcctggcttggtctatgaagctcacagtgccagcccatcccagcaggacctgctggggttatgaaaacaggcgggaggtggggatggaaaatgtatcttaaaagactccttggagaagggcgagcaataatggaaaaaaacaacaaaaaaagcgggggggtcggggtgtgctgagaaaacactagactaggaaatattaggtctctgcagtgctaacatacactaaatcctgccccagcttaaacacactggccccctctcaggacacagcaagtgtcccaggacagtgtccgcctcatgcttagggctgctctgcccagtgcctgcatggatcctggggccggcagcttctctgatggctgctatgtgggttttgctttgcccccttcaggctctggtgtcgggtagaaagcctgttctgcagccttgggccaggcacctaggccctccaatccaggcctcagtttccactccattttggaaccaggaatgaacatgcctcctgattctctaaggccccgctctcctcagcacctagggaaagcatctacccctctcccaggccttagctgtcccctcctcaggggaccaagtcactccctgtgagagtgggaagccctaccttccttgcctcgactgtactgcccatcagccccgtcgagaacattcacccaccttcagttctgtcactcgcctct

SEQ ID NO: 119188 - DNA, 1014 bp, Homo sapiens
gctgcgagaggtagggaggtcacctccacgaccttcctttgcctttcccttcacagacctgagactgggtcctgagggaagttgggccccagggaaactgtggggcttgagatggagcaggatccaggcagccactctgaggttgaggtttcaagccatgagcaggtagacctagtgcaggcaggcctggagggtggggtggggtggagtggcaggaagagccaggctgggggaagacctgtcaggtatcctaggaacaagagtgaggagcaagatgagcctgcaggaatctgaggctggcctctgggatggtgtggggagctggattcagggagaaagggggcccaatctgtggagttggctgctgacaggggaacagccgttccagccctggcgtatttgtcctccctccctcccaagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggtagaggtgggcgggcggcggggctgggcggtgggtgctgcccgtgaatcaacccatcataaggaaaaggtgggccctgggggttcctccgtgggcagcggggatgccagctcctcgcgccatcaccatcgccgccgccggctccacctgccccagcagcccctgctccagcgggaagtgtggtgcgtgggcaccaacggcaaacgctatcaggcccagagctccacagaacagacgctgctgagccccagtgagaaaccaaggcgctttggtgtgtacctggactatgaagctgggcgcctgggcttctacaacgcagagactctagcccacgtgcacaccttctcggctgccttcctgggcgagcgtgtctttcctttcttccgggtgctctccaagggcacccgcatcaagctct

SEQ ID NO: 119189 - DNA, 1542 bp, Homo sapiens
tactcccctcaatttataatggtgatgaggcatttctggcttcagtttcaactacgtgtggcaaacatctctaagtagactgaacagttagtaagttaggttaagatattaaaatggggagcagggtccacatccctgttgaaataggagcctgcctggtaacaggtgcaaagcatgcctttaactgcaactaaccagttcagttgtgtggcttctcactgcaggggcggcaaaggaagaaatcctgagttacaccctcacctgaaggaacagacctcacaagagaagcaaataaacattttatttccacagcacgccttcccttttcccaaagaacatgagttcacctcagccatcaaagcagagggcgaaagctgcaagtgacaaggcaagaggctcctagaaaaatagattatacccaaggctctcctcctggggacccaaacccgtccccaggctccccctcagagcttgccaaatggagtgaaaggcatggaaaggggctgggagaaaagccagctccactgaacaaaggggagaggagcctggcagtgagcagacctgggaggggtgtggggtgggatgagctttgctccttggttgagtgctggaaaagggaagggggaagaaataatttatgttgatgtaattaatgtaatgatgatgtaatggtgcgtggtttcaatcatggcgaccattccagatctctctcaagtgaagctaaattctggccggtctatggaggtagaaattgaggacggaaggaaagtttagaatccctcctccccaggagaatagacatttattacccagctctaccctttggcccagcctgcctccccaaatggcttccaaatccctcagctaaaatctgcatcagaaaatggaattggaatggggatgttgccttgcccaaaccctccagcctcagaactgataaagaggttgaagagcaggggtggggaaaaggaagttaaggaatgaaattacaatttcccctcatcccctactcaaattccagtcccagggctgggctaggcagactgggagagaagaccaggcagctgttctcattatcagggacccatgcagacctgttggacagacatagtaggtgagagaaggctgagctggaggccaggagggttctttaggctcctagagggagaagcaggggcctggggtcaagggggagtgggaagcaacacagtaacaagcagtgggaagagcctttgagccctcaaacttacgggccaccctccaccacccaccccccaagtgctgacagaggggcccctgcgggtggcaggataatcaagggcagagcttgatgcgggtgcccttggagagcacccggaagaaaggaaagacacgctcgcccaggaaggcagccgagaaggtgtgcacgtgggctagagtctctgcgttgtagaagcccaggcgcccagcttcatagtccaggtacacaccaaagcgccttggtttctcactggggctcagcagcgtctgttctgtggagctctgggcctgatagcgtttgcc

SEQ ID NO: 119190 - DNA, 2946 bp, Homo sapiens
gccaccacaccaggccctattattattattatattttttttggagatgaagtttcacttgttcgttgcccaggctggagtgcaatggcacaatcttggctcattgcacccttcgcttcctgggtttaagcagtgttcctgcctgagcctccccagtagctgggattacaggcacccgccgccacacctggttaatttttgtatttttggtagagacagggtttcaccattttggccaggctggtctcaaactcctgacctcaggtgatccacttacctcgccctccctgggattagaggcgtgagcttctgcgtccagccaccatctctaaatttttaaaaaattttcttgtctggaatctaaagggattctattgagcttaacggtttgggttcttggtttttgaaaggtgctgccagccatcatcctactgaggggtagggctgggaggtctagcatttcatgggataggactgtttgccctaatttcctttccatcttctgtaggatgagagccactcagagtgggtgtcttgtgtccgcttctcgcccaacagcagcaaccctatcatcgtctcctgtggctgggacaagctggtcaaggtgagcgtcaagccaaggcaggggctttaccagtcagggtgtgctcccaggtggtcatacactccaagtcctgtggaaagctttgcagatgccctcagttgactctttctcttgtcacatggtctgatgtcccttgtaagtcagcacactgcattggatatgtgttataatctaacgtgaagtggccaggacatgttactgaatgagaaatggctaccgtatccagaagtgccaagcccttttttgttgggcctgaccctagctcatcaagagctaggatgttcacctgtcaaccgcacgtctatgcaggtatggaacctggctaactgcaagctgaagaccaaccacattggccacacaggctatctgaacacggtgactgtctctccagatggatccctctgtgcttctggaggcaaggtatttggggacaaggcgtctcctactcagtggaagacagcgtcatggaaggagcacttagccagcgtctctaacgtaaaatggcaaacattagccaagatggttttaggaggataatgagataatggcaatctgagaatatgtttccaaagattactttcagcaaatgacagttaaggcatactatctggaagaaaaagatgattttctataagcctgtgggttttttttgttgtttttttgtttgtttgttttttgttttttttttgagacggagtctcactcggctgccaaggctggagtgcagtggcgcgatctcggctcactgcaaccatctcccgggttcaagcaattctcccatctcagcctcccgagtagctaggattacaggcacccgccatcactcctgggtaatttttgtatgttagtagagaggattttaccatgttggccaggctggtcttgaactcctgacctcaggtgatccgcccacctcggcttcccaaagtgctgggattacaggcatgagccaccgcacccagcctaaagttggtttcttgaagcagttgatgagattgggatcctggttttcagaaatgattggagtgatttatgtaagttgggaggggttttttgatggggttggtaaggtcttacgttaaaggaaaggtatacagagataaatattggtacttgagtcattagctttcaaagaagcctggggtaatggaggaaaggtaagaattgattctgacagaatcttgagatgggcagaattaacatctggaagaggtcacagtgtcctgatttaccttacctgtgtccaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggtgagtgtgggttacaattgactgggtacctggctgcactctgagccctggcaatgttttggttattatatatgccatctgactcccacctgggagctaagctttctcagcctccacgtaatgacattttggtctgagtaactctgttgtggtgtgcagtcctgtacattccaggatgtttagcagcatttccagcttctactagatgtcagtagcaaaccatccttccactagtggcaactgaaaatgcatgtaggcattgatacatggaccccagggagcaaaatcatccctttttaacttgagaatcttgaggggcttttaagaggagactctcttgattggtaagtcttaaggttgcttttgccctgttccccaggatttagagggaaagatcattgtagatgaactgaagcaagaagttatcagtaccagcagcaaggcagaaccaccccagtgcacctccctggcctggtctgctgatggccaggtaagtgggtctgtcctctcaggtgattctgcttccagttaattttctccctctcattctgttagtatatctagtctgtcagacacaagagcagtgtccttggcataaagtgaaatgacaagccaggttgatgaggatgccctcgtttgccatgccagtgaatgtgtttctgcatcagagggaagactgatgtggaacgcagtggctgtcagccttcaattaataccttaattaatctgaccagttttcaaatgtctggagccttatcaccagctgtttcttcctcaaggaatacataaccaccacttacaagctggctgttgaaatgagagcggtttcttacagtctacccggcgttgtggcacatgcctactggaggctgaggtgggaggatctcttgaactgcaggggcttaaggctgtagtgagccaggatcgcacccctgcactccagcctagacaatgg

SEQ ID NO: 119191 - DNA, 3400 bp, Homo sapiens
gaacaaaaacctcgtgaggggagaacaccctccggaagcacagttttaaagtttatttttaacattttaatactctactttttaaattgcccatcgttacccacgatagtgaaatgaaaattaagctcccctggggttgccccgtcaaccctccccgcaccaagtggaacaggcggagctcgagctatgccacataggggcggggaagcagcccggcggtcctcatgggaatgtgccgtacacttcacctctttcgcttctcgctctacatcatccctgagaagcctttttaaacacttgaatgtgcttgtttcagagtgtatttgtaaagtgcagtcagattttgttgtacggaagacgggactgtgatgccttgcaatttccctctgccttttgcattacatggcgccgccatcttgagcagaaatgtatcatggggctcgccattttgcatggtcgagcgggtatttccggttccggcggggggcttttctctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctactaccccgcagttcccggacatgatcctctccgcctctcgaggtacggactaaggtagatttcaggacccgagattgcagggctgggggattccgcgtgtcgtgtagggaattccgcgtgtggtgtggcaggccggtggcgcgcgagttggcggggactgacagacttctctgccccattgtgaattggggcgtgcggacccgagcctaggcctcaacccgggcgaaccacattgcagatgagaacctacgtgtacatcagctcgcagctgctaggagggttggagagttggaaacttttaaaatatcttttgccttctccttcgtagtgtggccgggggcctacgggccgggcggggcggtgatgaccccaacatgccatctgagtgtcggtgctgaaatccagaggctgtttctgagctgccgcccggcccaaggctcgtggggaggcaggtggactccagaggacctcgtggctcaagtgtcggcctactttttctgcccctggttctccccgtccctatccctgtgttcctgactgcgtttagacgcttcttgtgcttccgctttgctgctacactgttaagaattgtctgacttttgaatcatgtctggctgttaatcgtaaaatttgttgagtgggacaggtttcagtaaaagcatccaatcctgtagcgcctgaagtggcttttccagcattcattactacatttctgtcggccctcagaggtaggcataggaggccccagctactctacagccacaaactgctgtgcatttggttgcagagaagacacaaagtggctgttgagttcgtctgagtttcaggaaagggtgtctgtatttctggcacctaaattaagttctcaggatacaggctgggcgcggtggctcacgcctataatcccagcactttggaaggcagaggcgagtggatcacttgagatcaggagttagagactagcctggccaatggtgaaaccgcatctctagttaaaaaattagccagacgtgctggcaggtgccagctggccaagtaatcccagctacttgggaggctgaggcgggagaattgcttgaacacgggaggtggagtttggagtgagccgagatcatgccactgcactccagcctgggcgacagagcgagactccatctcaagaaaaaaaaaagttatcagggtacagtttacctctacgtgcgtttttagtctggaatagagccactcagtcctggtctgtaactgctcttgtctgttgtttccatccctccttaagcgtccttagttgttgttaacccactcatgaccttgacacttagtgaattatccagtgtgttaaacgggctgcgggttcctcactgatttttcttctgttttacctcctttagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgcaagtagctgctcacttagctctggggccttgggaagaatctgggcagaagtgaggtggatgcaattggctggtttcccaggggagatccagtccatttgggaactggaaagcagagcacacctacagaagatgtttggcctccctcactttaaataagttactcagcattgctgaggagtgtggctgaacatttttgccaggtgcaaaagttctgagtgggcagcagtttgaacatgttttaccttgaaagctcaggtaattggcaggtggaattagagggtcctggtgatgacagatggcattgtcagccaatccccaagtgggagtgaggacatgtcctgcaattctgaagggattctctgtcacttggctcttctctttcatatactcagtcacttgactctgtgatcagagccaaatccagggttgtatgagtgatgcaatgagacagagacaaagcccaggaaatgagtctgaccgttgaatgagagtgtttgctaagtctgagaatgacaaactcctccctctcaggggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggtaaagtgagccatctccaaggatctcttccaccctcttaaactttgctttttttttttttttttggcgacagtctcactcttgcccaagctggagtgcagtggcgcagtctcggctcactgcaacctctgcctcccgggctcaagggattctggtgcctcagtctcccgagtagctggtactacaggtgcgcagccaccacgcctagctaattttttgtgttttagtagagacagggtttcaccatgttgcccagggtggtctcaaactcctgggctcaggcgatttgcctgcctcgccctcccaaagtgttgggattacaggcgtgagcccccacctgcctatctttgcctttttttttttttttctcggagacagtttcgcttgttccccaggctgaagtacaatggcgtgatctcggctgaccacaacctccgcctcctgggttcaagcagttctcctgcctcagcctcccaagtagctgggatt

SEQ ID NO: 119192 - DNA, 1077 bp, Homo sapiens
acgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaggtcgcgtgcgatgcattcttccctagccaaggggcagtcaccacgcgccct

SEQ ID NO: 119193 - DNA, 1029 bp, Homo sapiens
aagttgtaatttacttgacatttttccctaagtgtctttatttcaacattttcatatttctactgttaacacccaaaatacttacattctggttaaccctgtattggtaaacacattgtcagaaaccatctgtcaggtcctgctaattctgtttgctggggacttaccatgtgcgaggcacaccatgaagtgcctcgttgaatcctcacaacagccttatgatacatgtgggctagcttaccgccacgtccatttagcagaggaaggaatcagggcttagagagaggttggtgacttccgtaagactgcaaggcagtaagtagcaggactcatgttcacactctggctctgtatgtccttgacttcactactgctcagctcttccttccagcggaatatgctttctgacatccatccacctgggtcacagctcagagaaagttcatcaattccagaggctaataaacagtagcaacacggaaaccggtagtgcttttatggctcagagtggaaggtaaaggcctaaaaaccccatacccaagtgagggagttcaaggactactattccaacaagtcaggggggacttcttggaagaaagggggatttcaagagctacttgagttacagaaccctggtttagtgggtaagaggagatgaatatgaaataagttagatgaaagccgagagagaaaccaggacctggagcaagttaacgaggcagctgagaaaacaaattagggaggttcaaggtacttcagtgctccagtggcatttcatttccagcacacccatgttctttgtgggtcacagcatggcttcatgtgagttagctgagctggcctcacttgaatgggaaagagctattagaaatcacttggttttttactaagactttctttatcagtgtaccatgaaagagcatattctagaaatgatttgggcattgcaaaacaagcatcattgccttaggctgagcacactgactcattctcctgtctcttgtcatctttgcatgtagatttttttaa

SEQ ID NO: 119194 - DNA, 1087 bp, Homo sapiens
ttcttttgctgagttaaggatccataggtagaacttttcagctgccttctccacacagcaagcccaggcagagccgggcactggctcccctggtgttttcttgcgttgctaggccgccccatctgtcgggctgtaaaacaagtgtctccgtcctgcaggttactggaagagctcctgaacaagttcaagagtagcatgcacttgcagctcacctgtttccaagcagcttcttcaaccatgatgaaaacataaatatctgccacataaaagaagtccaggaaaataacacgtaataagactgttcactctctaagtaccctaaaggtatttggtgtattaaacattgggtttgccatttttctcttttttcttcctctgacttcgaaaattgttggtatacatttcaaccaaaatgacctcatttgaaatgcccaggaagtatttgttttgccattcttactagatcagatcctgtatgactttaaaatacattttaaaatatattttgcatctcagcagaaggttgagtgctgcaggaagagctgcttctgcagggagttttctggaatggcgtggcacatattgaagcatttctcagtgtcccgttcacggaagcgcaggcagctcccacgacacacggagagactgactgatacgagatttggaaagctatgtagacatctttggagctcttactgtcctaaactgtacagctgtgcttaaaaccctcatttcatataaatggccttaagttttctaattcaagcgggtttttggaaaaatttatggtctccattaaaatacatattacaactggggtagattatttgtggtccaggtgtctgtgatttaactttgcgttttgctatctgatttttatttttcacagggctaagcatgagctttcattctcactcactcttaatttgtcgtgcgtcactacacatgcacgtgttgcagtccctgaggccctgtgtgttatctgtgatggagtgtgaatgtgtaacgggcactgtgttacactctgaggtgttggcggggcggtcgcagacttcagggtcccctaacggaaaggccaggctccgcg

SEQ ID NO: 119195 - DNA, 1041 bp, Homo sapiens
atcctccatgtagtaggatctcaatgaatttatgttagttgaatgaatgagaacttttagccattcccttagaatgaacaatttcagcccaatcggtaataaaaaaaaaaaaaagtacttgctcctgtatttaattcagcgattagctttttggagagagaccatcaatgatttatttttatattaaagtttttgttaccaaaaattataataccagcacaggcactgcactgggaggttatgatggcagctcgcagagctccgcctcactccggccctttccgatgcatccagttgaatgctgcctctttgaacctcactggcctgatgtgtggtttgactagcggtaccacttcctgtccacacaggaccacacatttttcccttctctttttccaacattaccagttatttgtatgaagcagttatttcgtttttttgtgtgaggggaaagaaggcaattatttcctttttttcattcaaaaagataaaatctagaaatacaaaagttctttcttgtccaaggttacgtctttgagctccttatattatccatgtgaaacctgtgctcgacccaaaataggaagcttgattttttttttccaaattttctgcccacaaaaatatggttcttttggttcaaagggtcctgtgcctttattcttcccattcatagctttgtcttcagaattgcattgagcagtttacacttcacctcttttacggggtgtcttattagtaatgcttaggcgggtgggttcttgccaggaagtgtttatgatgtcggggtccgagtgggagttgagttcacagcaggctgtcactgagcatgtgacaccgcctggcttcactctaagtataattttctgctttttagtcagcactctgcccccactcttttcttttacattgaggaatttcaaaagttaaaaactgccttcgcatttccagtcatccttgcaccgtagcacatcgttagagccccaaatcctgacacttgttcttgcaggagtgttgacaggaccccggttctcactgagg

SEQ ID NO: 119196 - DNA, 1038 bp, Homo sapiens
tgtgtgtagtcactgctgtgtgtgtgtgtgtatgtagtcactgctgtgtgtgtgtgtgtgggatcactgctctgtgtgtgtgtgtgtgtggtcactgctgtgtgtgtgtgtgtagtccctgctatatccccagcccctggaaaagtgtcctgcatgtaataataatggacactcaggaagtatttttaatagtgtgccagtttgcctgttccaaaatcaagtgaccttcctatatgattaaaagaggaaactgacaaatataccaagaaagaaggctgctctactattttgatgcatgaaaacaagatcttcgttgctggagaatatgctgggttacaccggctggcttacaggaaacagcctacaagttcttgctcagtagagatgagccttgttttctccatggggaatttccacacggggctactagattaattgctaagtggtagtagtctaggttgatactgtgtgggtggggacactttttgtcaaatatcatgacacattctaatttcatattcagacagtggaggagatacatgttgtaaatgcttagaaactgtttctcattccctcgcttgaacaacatggaaagttgtgggggtttattgaaggggaacctttttaaaaacagtacttattactgcagcataataatgtagcctttaactccaaggagcaaatccgtttgccttgtatttttcttggcacactgtccacactgatgatccctccctaatactgtgtgcaccatacatttggcattgtatggcccactgttgttggagcacaaactgaaacttaggtttccctgcacacttacgtgttcactccatcctgatatacctggacatcttcctaatatccagcacgtgcggagcattcagcaaatacctaatgacattatttcagtatattgctggaaaaataaagcatattttggaaagcaaatagattaagcctcagcaatattctatactactgtacttactttattcaaactatatttttcaaatggatcctgatgctcaaaaggac

SEQ ID NO: 119197 - DNA, 1010 bp, Homo sapiens
gctgatcaataagagatcctactgatgaaagcaatgaaaaaaaaaatcctgggatggaaaacagaaagcaggagagggcgaaggtacccattcatgtgctacataggaagggtgtcctttcctcaaatagtcattgaaaaaatccactttagggcaaaagacatttatcaatttgggaatgagggcactaaaacctgacgaaggggaacttaaaactctttagttagtccaacaagagctgattttgctgcagaatggttaggactttctctctgttctactaatagtgatacagtttctggttatctttttcttttttttaattaggcagtaatttcgataatgtgtgttcagagtgtaattgaatagataattcacttgaaaaaaatacaccaaagttttttcagtagtgtttcagtttgacaataaaaaaaagtacattgtgggatatttatagtatttttgaatctatttttaccagtagactgggagtgataactgatttggggcataggggttaaaaacaggaaatgtggtttatacagtaggtagtatctccagagtttccagggttgatttcttatagtattgtctgaagagtgttatgcgtcaaaacaacattaggccgagtaccttgaaatccgcctgtgtttaaaggagccgtctttccaattacaacaggaaatgcttcatggaaaagtttgcattcttggtataggttaagatggcatagcagttgtttattgtaattacaacacgttcttcctctccagcacttttcagacactttttatacagtcagagtaaatcttgtgtcacttctagtaaatttccttcaattttcgtattaaaattttattttattttcatgaaaagttttgtcaaatagctgttaagaatgttttaaaatagactatcatagctgaggaggagcatatattagggatactgttaattacagtaatcagagaatccaagttaagaggataaaaaggcatgaagaaatagga

SEQ ID NO: 119198 - DNA, 1036 bp, Homo sapiens
gaaactgaagtccagacgaaacactgtctacagccgtcaaggagcatttggttgacaaactgggacttctgcctctgcctcctaacacttttcaaaagtatatcatttttcagcaagctaatcaatgtgcttaaactctacattgtatcaagagtctaaaaatagtacaattagcataaaaagctcagtttgtggctagatttttaagtgtgtggagcaagagacatcaacaaagcagtttgtgtctatgggagcaaattaaaggcaatgttattaaaatccttatattgcagaggatatttacttgagacttagattctttttgtatcaatttacttcagttttctcataatatcacatactaataatcaaaatgtttgagtgacaaccagagtaaattcataaatgtaatatatctgaaaacccatttttcttttttgaaattgctgtcatttctggttgcaaatggtgtgacagcctatgattacagtaatagggactttaaggattatacatagaatgcatgtgacttttagcaagtttgtgtattgaaggaatttaataagaggttttatggaatcacaaaagctaccttcatggactttaaatatgatggatatgaaagaaactaatattcttgtactctacggtcgggttgtattaatgaaaagaaaaattggtgtgtgtgcttggactttcgtttcttctcattttcctccttggtttgtgctggggcttcctttttcatattctgctaaggaaaacaggttcggcagatcatttagcctcactggggctgtgctgctcgtggacacgtgggccgtgtgcagccgcactgcacgtaaaccgtgggtgaccacgccgtgctcttggtacggcacgtggtctggctcttccccacggggactggagcacactgaagataacacacatgcagtgacccagttccattccagcctgtgacccaagagaatgagtgtttatgcccgccaaaagacaccaccagctgcattcataacggctctgctggaaatac

SEQ ID NO: 119199 - DNA, 2079 bp, Homo sapiens
ccaagtcatttaaaaacttttggttatggaaattttgagacatatctccaaaccgaacagtctgacaaatccagttgacctgttggccgacttaagcagcgatcatctcacagccagtcttgtctgatctgtgcccctgggctccccactgcctctgagatctgttattttgaagtaaatcccagatattcgatcatttcatccatacacagataagataaggactgattttttttaaagaaacgtaatcataataccattatgagatctggagaaagttaacagtaattccttaattttatcagctatttagtcaatgttcaaattctcgtagaagctttttagacagtttgttcgtatcaggattcagtcaaggtccacacattacttttggttgatatgtctcttaattaagaaaaataaacctctcttgagtcacttttggtgctcagtgaagtggttgtttgcctgttacccacccatctttaaatgaataaatcgggttttttgttctgtagattttctcatattctatatttttcagatagcttcctcatggtgtcatttaacctgttcctttgtcccttatgtttcctataaatttgtggttaataatgaagctatcagtttgaggtttgattttatattgtttacttccatcaggagataccttatgtttggttgtctctgcttttgatgataagattgaaaattgaattcaagtgttatcagcttggtataccctttaaaagttcaccataaacttttcatctaatggttttagcaccattggtaattgttttcataatctatttcttattagaaattgaaaataataattgttagctggaacactaagtttttttcattaagctctgaagtacagttcatacaggaggggcaggatagatgcctgattagttagcagttttcagaatgagttggtttgctagtatttctcaaaggtcattactaaggtatttttttattttttgattacctttatgaagtcatgatgtaaacataatttgatgagcttcaattcattgtagttgatttttttttaatttagttgtgccctctttgtgggagtctcttcaggtgggccctgggtcctgacagtacagcctcgccatagggtgccatgttccacactcatgctggtttccttgcttcgtagaatcagccgttgggaggaattgatggaatatgaaatatgaacatcttccttcttctcttttatttctttccacactgtgtctctgtccaccctgtctacccccaactggctttttctaaccccatagctctcgttcagtctcaccccaaagtcagttctacagctgggcgggctgtggcagcatcagtcatggtcccttctcatattccagcagcaccaccacttccattcaggtcattgccagctggacctgctcccaccaggcaggtgagaaaggctgcctgcgttccctctaccgtggtctctccgtcagtgaggcgctggggaaggtgtgtgtgtttcttctgtcatattctatatctgtactaggaactctgagaatttaggcttctgaggtgctatggaaagcattagggattttttgtcacttgacctggttttgtttatctaattatggagggactctctccaaaactcatttacatgcttcacagctgtgtgccctgtggtacacagatagtgacagatacttgcgtagatgctaccgtcttggcatcctcttcccccagcccagctattatttcctcctggtcttggctacatttggtgtgaatgttagccctgaatttgttgctgttcttaaacagtttagtcagaagacttcgtggggcattggaaaacctgcctttcttttgatcccttggcttcaggcctgccctgcagagccagggaagcctctggtgtctgcacatatgatgacagctcagccagctgtgccacacagctctgttgggccggggctaggggtgcagtgatggagctagacgagctagctctgtgcgtgggaacattgaaagctgacaacgagcgctgcagtttggatcatcttcatgtacgcg

SEQ ID NO: 119200 - DNA, 1049 bp, Homo sapiens
ttgctctgttacctagattggagtacggtagttgaatcataccacgctgcagcctcgatctcctgggctaaagtcattctctcaccatagcccccaagtagctgggaccacagatgcgcaccaccatgcctggctaatcatttttattattatttccaaagatcctacttttggcattggtggttttctttaatatttacctttttaagatattgatttctgttctttatcttttccttctattttctttgggtttaattttctctttttctagatacttggggcagaaaattagagcagtgatttaagtttttctccttttaaacttttcttttaaaacattttcagctataaatttctagccactggttctctcttgcagattttgatatgttatctcttcattgtgtgttattagtatttcccttttggatgcctccttcctttgaagaaatcttacttcacacttgtatttcacatgtccagggagtctctaatcatctatttcggtttgtgtttatagatactagagaaagagagagataaagaagggcgagagggaactcagagttattgcctgtcactgttttcctcagtagttcatcttcttcgttctgatgtgtttgattttaggttagagccctttctcattacatgggtgaaatactccttgaacccttgcatatccaaaaatatctttctcggactctgttaagagaatgacacgctggctaaatacaggattcttgggttctgttctttcattcctgtagattttaatccagtgatttcagctcccagtactgcatgtgagaaatctgacgtcagaccagttctttcttctttgtaagtaaattattgttttgatctagaagcttgaaagtcagtctgtctctgtctctctctctctctctctctctgtctctctctcatttagagtaaatgtattagaaactagaaactttaacagtagttgcctagatatgtgggctgtcttaccagtctagcctggcactctgcaagcctactcaagttgcaaacttgggtct

SEQ ID NO: 119201 - DNA, 1044 bp, Homo sapiens
tcttggattcattcatgggaattgtacgtaaaggttttagaaagataaataacttctcattgggataagaaaggttttctaatgaatcattctttaatcagaaacatagattatgtcttaagcatttcttttaatcaagttataaccatatttaatgttctcttgatgtacaagtgctaaagcatttcttatttttaaattatttctaatatgttttattttgtttttttaatttttaagactgctgagaagtcaggccagattgaaagatcaaagaatgtaaggcaaagacaaaatgattttaaggtgagtaagggtgataagtatgtagaccttttcacagggtagggtttttcctttctcactttgtattcaagacatccattactgcccaggcagcatcttttagttaatgtaacccgattaatcacatttgaacacggttatgcttgttcctggttttctagaaaatgattcaggaagtaatgcactccctggtgaagcttacccgcggagccctgcttcccctcagcatccgggatggggaagccaagcagtacggaggctgggaggtgaagtgcgagctctccggacagtggctcgctcacgccatccagactgtaaggtgagtatggacacattctcagagaaaggcgtacttctgttttttttaactttttggaaagaattaatacattcagtgaagaagaaattcttctttttcttctttttgtccttttgcctccactgtttcctgttcatcatctgacagctaagctcctcactgttcctggtttttgtgttggactagaatgttcttgagtttacgcatcttctccgttgtttcactcagtattactctgacagtacagtcccagttgtggtctgtttctgttttcagcctaatgctgtagctcgtaagctccgtgaggaatgattatacagtgaaagagatgctagggattgctttgcgatcccactctgctcacttctgtttggatgtgtttgttcgcagacttactcatgaatcgttgactgcccttg

SEQ ID NO: 119202 - DNA, 1165 bp, Homo sapiens
aacccaccttggtggtgtgttcagaatcaattggtggggacaaatgtgggggaaaccatggaggtcctccaggcaggaaacagtggtggtttggataaggtttcgtcagtggagttggagagcagttggtaggtttggttgtattttggacgtggtgttcaggtgagggagaggaaagcaagaattctgacgttgctcgcagtgggctcctgagcaggagtgccgtatgccaagccagaaagacctaagaaagagcatgcttggaggaagcttcagatttccattgataatgtggtagattgagattcctgggagttattcaatattcacatatgggtcacagaggagatatttgggctggagatagactttggaaggcattagatagaaatgatatttgaagccacgggaacaaactagacggtatagacagcaaagaaaaaaagtacccaagcctaagacctaacaaactgcaacatgtagaaaagagctatttgtcacctcagtgagcagggcattcatttgctcgatgcccataccccataccaccaaccacgttctgattctggtcttcacactgggcagacagaaagcagctgaacagacactcagagccgctggtgttagccgagcgggcgtgcgttaggtgggggtccctctgcgcatgcctccttcctcactgcagcaccagggcagtaggttctccttcaggcggcctgtctcagccacctgggctcacctgctgctgtctcagtgtggctgtgttcacctgggccactgcaacatcctgctggctggtcatactcgcacactggcccctcattccttcttcttaatgtaggcctcacagcactcacctgcttaaaacacttcagttccttctcatttgtcttaaaaataaaggaaaaatcaacctatgagttaaaccctggggtacaaagaattttaagtgtcattgaccagtgaactcaggagctagctttttgaatgattattgagatggattgcaggtttagtttttatacatacctttaattctttcaagacaaaaacatatttctacaaagaaaaaaatgataaaagctgcgtagtttaatataaaatttaaaaatgaatggaaactacagtttgaaggatgttggtctgtgtatgtgctgcccgtttt

SEQ ID NO: 119203 - DNA, 1052 bp, Homo sapiens
ccctgtggtattcagagaaaatgttatgagcaaagatggtgacagattttcagagacagcagtcctacatacaaagctacctttttccgagaaagctccttttgtagatgaagcatttggcagcagagtttgccgtacagttgataattctatgagtcctgcattagatccttgtctggactcgtttttgtagtaataatatacactggtgctagcagatggtgcccttcggagtataacacgaggccaggacaggagctcacccttgcacctcacacacctggtcctttacccccaaacgctccacatgcctcttgcatcctctaactctgtagcccaaatgtgatcatttaggtttttctaagggtggaaaaagatgggaaaaacaagagcaaaactaaggttaatattttaaaaactcatcttgaaaccttctaaatactgatggaagagtttatggtgtttgtccagcctgaacaggttaaccattttgcttctcttcccctatgttcaaagcagccttgtgttctgaattgttatacatgttaaacttttactaccttattaagaagtgtcacccgtctcttaaaattcctgtgaaataggtccaaaattagactgcgtcttcagaggtttcctgccaggaaaagcctttggttaaccccctactgacattcacaaacaggatttttaaaggtggtcttcaaaggtgtttttttctttgttctgaatgtgagttaaaatatatgctggctatgtctgataacttaagggagaaggcatcaggctactcatagagaaagtgttaccttctttcagagatgcacttaattagaacttctaaaaggacatcattagaattagggttcagtaggcaacatttagaacatggccacactgttaagtaagcagtaagttctcgagaatagccgcagagcagaagaaaagacatttatacctggctcaggttctctttgaaaacttagagatggtatgttccatctgagtggtttatttcgagtcttcacagtggtggagctattatagaaaga

SEQ ID NO: 119204 - DNA, 1003 bp, Homo sapiens
acttgcctttttctaaaaaagaatttaaggcagctggctatttaagaaggtgtctaaatctgagatattttgtaaaaattataggcccagggaaaatggctatgtgcaaagttttgagttctgtccacgtcccttgtctgtcctttttctgatgtcctaggtcccagctacttatcctgctgatttagaagaaagtgatcagatgaattaatccttactatgatgttagtggcttaaaaataagtcatttaaaataaatcttttcacaactatagtttacatttgataggaatgcccatgggcatctccttaggtttaaatataatgtacaatctcatcaggaagtagagttaagaatcattggaagaatgaaaaaacctcacaccagatctttaaaaattctgtgaatttaaggctgtgatgtgaagctagttttgcccttccggcttaagtgagtcccgtgggtggaacgttctgagcctgtatgtgaatatcttttcacaaacctgagtgatccctaaaagaaagcattttctagaaagaagtgttctcttggtagtagcatttgaggacttggatttcattctaaatttaggaatttaacagcacttaattttttcctctgattattattacttaattgccctgagatcttcccttgtttttatctttgagaaccaagtcaccaatgttgttaaaatgaagatattctgaatttaactcaaacacttattgaagctgtttctatattagcatagtcagacattttaagatcttggaaggatattttctactcaaggatgttatttgccctggagaagttatcaaactatgatatctgtataaaaaacatgtttacttcagtaattttaaaaaggtggcttataggaacagttgacatagtaagtatatgatggtatcagagaaggagatccttgttccggtttgggaaattctagggtctgtttcatgtgttaggcttaccatagtgtggtaatgtgat

SEQ ID NO: 119205 - DNA, 1084 bp, Homo sapiens
aggcattcataataaataaaaggtttagatctacgcaacaatttgaaagctttttgatttcatctggcttcgtatgatattaatctgtgtgctacttagcatcggttttagcatatttagtgttctccactgaaggaattattttttctttcttgcatgttagaagtgtcaaactttggtttctttatttcatttcagttttgagcagctcaaaatggcagtcaccaacctaaagagacaggctaacaagaagagtgagggcagcctggcctatgtgaaaggcggtctcagtacattcttcgaagcacaggatgccctctcaggtaaggcgatcctcagagccatctgctggcagcttccgccatggaaacccggcactgcctgcagggtgtttacagggtgtgacactcggtctgtttttatcaaagtagagatctcaaatgtgctataaatatttgttgcagagtaggctggcatctctttgaagacttggtactttaaaaatttatctctgaggcttttgttaacccatcttacatgtgtgaaatgggagactactttaactctctgtgatgtccacactccagggctgatacgaaattaaatcccaatgcacaaccaccaatatcttacatatgtgactaattctataaatgcaacccattgtgtgttcactttggaaaggctgatgataggataccagtctcttcagcccttatcgcacaggcgcccacgtatgcacgcaggtagctgtcactgtgccatctgtgtatgggagggacgttgtatggagtacagatgtcatagctttagacattttaatgcaagatgttggtagagttttttttttataaaactgcttttaattaatgaaagtttaattattgctatttagtaaaaagtaatctatatcaataaaagttaactcaattctttttaatagctaagatacttaaaactaaatacccatatagcttaagtatccataactctaaccatgcattgaggccacatcttcttcaattcaggaaggtaaattttaaaaattatttttattcctaaagtatagacattcttttattat

SEQ ID NO: 119206 - DNA, 1024 bp, Homo sapiens
tgctttgtgattagatgtggttttattagtactttgatgatttcttagtatgtcttaaaacaactttcatctaggttttaacaaaaatcattttaacaaagtgatttaatattttagaatttcactgtattcaaattttgatttttatacattgaatggggattgatgtcatattttgataggtttaataaaactgtcaactcagccagatgtcttaatcctctttaaaccttatattcttttattgatgtaatttctgtatttcaactagtttcctatcttttctatataaaatcaaagtttaagtgatagaaaaatcagccatgatgtgggaaatatattttgtacatatatacaaacatgttctgggtaatgtatgattaatatgtattgttgtaatggttagtattcatatgtgttatactggatacttagtgataccttttccatttttgtcataataaccattgaaatatattttaaacgttttttcccctcagaagtaaattttcgcagaaggacttagaaatgctattccatggaatgagtgctgattttacaagtgagaatttctcagcagcctggtatcttatagagaatcactcaaacaccaggttagtggatatgggactgtcaactgtgaagggtttcactcagatgctaaagatggaattacacggtaactcgagttttaggtctggctctgcatacagttacatggttttaggtctgcgagctctttgactttgcgtttacccgtgaacatctcagggtgtctgtttccctgtttgtgcaatgggatgattctttagaggtctctcatttcctactgtcattttatgttcaatatatttcattattgatgcaggttattaaaaatttatggagccttagctggggacttaaactgacatgtatgaatgtgatctctccctactcaaataacataaaaattttaagttctggggtaaaacatggaacacactgccttctctgaccatagggcaaaggaagatgagttggt

SEQ ID NO: 119207 - DNA, 1084 bp, Homo sapiens
cagacattttccaagagtttacatgatttcagaatattctcttgaataaacagatattataggtcatattatttcatcttactgactttctgaattttttgtgcagatttaatcagctacatttaacaatgtttaattgtagtgtttattatttgtaaaatatgtttgttattgcaaaactttgtctaagcagcttaatttgtcttctctgttgagtaatgtacaatgaaaccataagctgagaggtgtaatttttgcctttttataaatttttttagtgcttataattaaactactagtcattttttaaaaatttagctgttatgtcctcaaatctcttaaagattatccaacaggcattttgtattaggtctttaagaagtcagacaataggccagacgtagaaggtgcctggggtaggcttcatcttattaagcatatgctcctcatttctgtaggcattttggatcagtctgctgtgtgggttgatgaaatgaattattatgatatgcgcactgacaggaacaaaggaattccgcccttgtccttacgtcctgctaacccgcttggcattgagattgaaaagtgagtaccatcttgctttcagtcttctttatttttcagttcctgaaaagttttatatacttacaggaaagggactcaaactccagaaacatcccaggaaacacagttgaagacacctcagttgtttggagatgggtgttatttatgaagccttgttagctatgctgcaagtaaactttgcagttagttaaaacttgtggctaaaactacttttacctcttcagttttttgattttgcattttgtgaaaaagaaaagtctttagtatgttgtctagagatggttaagtttaaataggtagatggcacctgaagtcaaaatagcatacataatctgtttttttgatttttctagaagtattttagaatagccaggtctaatctggtctttaattttgtctataatgtctactcattcttgcttaatccagacttatttaactttaatcatcagaattctgccaggtaaatgatatctttcaagatgccttataactgaat

SEQ ID NO: 119208 - DNA, 1082 bp, Homo sapiens
tcctgattctaacacatcaactgcaaaataacttttagaccatatgaaaaaattgacctggggctgggtgcaatgtcatttgtagaggtacaaactaagtcatttatggatgaaatgatacaatgctttaaagagctccctcaacaaacaacatgaaagtatgttgaaggggagaggcagctaaaacaagacacagaatgttgaagctgggtgatgggaacttggaggttccttatgctagtctctcttatgtatgtttaagatttccataataaataaaaaaaaaaatagtcatccggagtatagcatagagcaagggtctggttttgaatcccacctctttcacttaatagctgtgatttttgacaagctattgaatctctgataatcctacccttgttaataaaccatttggcattttagaatacttccttctaggaactttttctgtacatctgtctgttcatacctatctgcctatttatttattcgtatgtctttctatttcgctaatttgttgtaagtattctcttggtttcgcatgtttttcataatgtttcactggctgcatagtttccttgactgaacctttacattttactggatgttttggtggatgtttccgttttttccccgtcttgctgtaatacatttttgcagttatgggaatcttcatgcctaatagcaatccccatggtttgaattattttagtcattgttcacttttcaagaatacattttgagtcaaactgtggaagcatgtctaaggctttgacacgtggccgaattatttttcagagtattggaacagttgtgctgctgccagcgatccgtgggagctgtgtacagattcagccgacaactatgagccttcgagatcatcttaaatatcttgtgttgttaataggccagcggtggaacctcttttagttgatgtttctctgaggttgggttttgtctttatgttcgttggttggttgcatctcctctcttgtgaactgtaagcttataccttctcaatttttttttgaagctcttggtgttttctggattgatttttgtgagctgtttatataataaag

SEQ ID NO: 119209 - DNA, 1046 bp, Homo sapiens
ttccatcactgcgagggtaaagctttctcctaccctcctggtaccttttcactcctcgccctggtgtacctttgcctcaactgatctggaatcagacttcaggaatttagtcatgttgggcactttttaaaaaatgataccatcctgtatttctttttgtgttcagttttttggggttctgtgtttatggtgctaatgatgttaaactaatgctcagaggaattctgaagcacagttattcacaaagttgtacaaccatcaccattatctaagtccagaacagtttcatcacacccggagaaaaccctgaatccattatcaatcctttcccactttctgcatccatggatttacttattctgaactttcatataagtggaatcatatatgtggccttttatgtcaattatgacataatatatgcataatattgttagtcattactgtatgacttttacctaggaagtgaaaattctttggagagagagagagaggaaaaaatactgataaatgatggttatagttaagtaatcatgtgtggaaatgaacttgtattttagaaactcggggccgggcgcggtggctcacacctgtaatcccagcactttgagaggccaaggcgggcagatcacgaggtcaggagatctagaccatcctggctaacacagagaaaccctgtctctactaaaaatacaaaaaaattagccgggcgtggtagtggttgcctgtagtcccagctattcgggaggctgaggcaggagaatggcatgaacccggaaggcagagcttgcagtgaccccagatcctgccactgcactccagcatgggtgacagagcgagactccgtctcaaaaaaaaaaaaaaaaaagaaactgggaaatatttaataggaactgcggaatggtcaaggcttgtgttggatagaagtgccctatgtgtgactggctgttagtcaccagcacttttctgcagtgctgtgtcatgcaggttcctgttcccagcccttctggagtttcaccaatgccggtgctaattggttgtttaaa

SEQ ID NO: 119210 - DNA, 1034 bp, Homo sapiens
aatcttccagaattttcctcatcagtacccgcttcttatctctgcagaatgtacttttcagcattttcacgcttttcgaacctttcatcctttcacatcatttacacacactcttagcaagcggtcttgccacctacatcataaatgaaagagatgtaagtggagaatcgcaggggcttcctgccaaaaactgttcctcctccccagtcacagtggaagaggttgtatttatgctaagaccaatctcctacctgggctgtggatcccatctaccccgcctttgtgaggacttcactcaggtgttcatgtcttactaaagccttccttctgttggcctttatacatgcttagagacagacaagaataaagtaaaacagaaaaaactagaatcctcccttgatttcacattgcccttttaaaattcctctctttttcactttcctgccacatttcttaaaatagttgtttgtagccaacttctcacccatcccagtgctgtctggtttcagctacgatcactctcctgaaggccaaagtcattcttgagcttctggtcacaaaatcttgttcctgtcatttcttcagggtaatgcctgggacatagcaagtgtataataaacatttatttgactgaataaatccaaggatgtttccttttcacagccctagtttttctgtttttctggggtataggagtccaatactgtcatcttttgaggatctgggtgactagtcattgtatcgcaaatcatcttgacggactaggtaaagatacaaataaatattatttgaggataagttcagtggctcagtgcctgtaatcccagcactttgagaggccgaggtggaaggatagcttgagcccaggagtttgagaccagcctgggcaacataatgaggccccttttctacaaaaattagaaaaaagttagccgagtgtggtggtacatgtctgtggtcccagttactcaggaggctgaagtgggaggatcacttgagcctggatcacctgaggctgcagtgagctatgattg

SEQ ID NO: 119211 - DNA, 1021 bp, Homo sapiens
gcgccggctccaggtccgcacaccagcagcctggaagcctggtgatgcgtaaccctgtatcccaagattgttaagaaaacactttagtaattccgagaaatagttcttgaaagaactcgtctttgaatggaagtaagttatttttaatctgccaaaggtcaacatactaataagtctgagaaattttaagtctgatgcctttatgaatctgtgagtaaacttacaaggaacacttaaaaaatattttttctaagttagccacactttaattaaatctttttgtgtgcactatgcaatattgaaaagttacttctgagcttatgtggatctgtcttctaatgcataataatgttttgtttatgaatgttagtatgtactggcccatgctttgtgtaactgactcctttaatgacaaatcaactgaaagccagaatcttctcaaagatgatttttttgtgctaaaagttggcgattcccagagtagtaatagaaagagggtgatgtgtgcttagtacttacatgttcacttgtttgtctaagtagaaacttaataaattaaagcagagaagcagagttcccccagtgtgacttggaccaactcttggaagttttagaaagtgatctttttttcttgtcaagtatttaatttcctgtattgaatgccattttgaactacagttgacccttgaacaacactggggttaggggtgcccacgcagtcaaaaatttccatgtaacttttgactttcccaggactttactaatagcctactgttgaccagaagccttactgatacataaacagttgacttacatgtattttgtatgttatacgtattatatactgtattcttaaagtaagctgagagaggaaaatgttaaaatcacaacaaatgtatttactcttctttaaatgaaagtggagaatcatgaaggttattatccccatagtctgcatgagtagattgtggaggaggaagaagaggagggattttctcaggaatggcagagatggaagaga

SEQ ID NO: 119212 - DNA, 1338 bp, Homo sapiens
ggatgggcacatcagggtgcaaatgagatgagaggcctggaaagattccggctctgctcactggtgcgcgtccacacgggcagcctggaccgggctcactgctgctgtttgctcctccagagactggaacagatgcagagtgctgtcttccttctcttccctttgtctcttgacctctttccttcctcccttcttccttccacaagtgtctatgtatcaggggctgggatagagtgggtgctgggatagagtgggtgctgggatagagtgggtgctgggatagagcaggtgctgggatagagcgggtgctgggatagagcgggtgctgggatagagtgggtgctgggatagagtgggtgctgggatacagtgggtgctgggatagagcgggtgctgggatagagtgggtgctgggatagagtgggtgctgggatagagcgggtgctgggatacagtgggtgctgggatagagcgggtgctgggatgaagtgggtgctgggatagagcgggtgctgggatgaagtgggtgctgggatagagcgggtgctgggatgaagtgggtgctgggatacagtgggtgctgggatagagcgggtgctgggatacagtgggtgctgggatacagtgggtgctgggatagagcgggtgctgggatagagcgggtgctgggatacagtgggtgctgggatacagtgggtgctgggatagagcgggtgctgggatagagcgggtgctgggatagagtgggtgctgggatacagtgggtgctgggatagagcgggtgctgggatgaagtgggtgctgggatagagcgggtgctgggatagagtgggtgctgggatgaagtgggtgctgggatagagtgggtgctgggatagagtgggtgctgggatgaagtgggtgctgggatacagtgggtgctgggatagagcgggtgctgggatagagtgggtgctgggatacagtggatgccaacggacagggctgttgttttccagctcccacagcctggcgaggggagagggggcagagaataaacacacggctaattaattaccaaatggctcgatcttctcttgaaaaagttcggtgggctgtgggatggtgtagctgacagatccctaacctggtggaggtggctgtaacctgattggagttaaagggacaggagccatccggggaagccttaatttcccagttgccgagatctgcggaaacagtgcagcggctgtgaaaccagccaagtgcagactagccgggactttacatcactcctgcctttctggcagcccagcctggctgaccctcactccccttggagaccctgggcagggcctt

SEQ ID NO: 119213 - DNA, 1118 bp, Homo sapiens
accacaaaatagcaggctcgggaggagagagggcgagcgctcacacctgcccacgaaggcggccgtcggcgctttgatgtgctgagcgggatgacagaagcccgagctccttcctgaagtgctcgcagggcttaatggagaactccagggcagcccctgcgccggcaggggcacatggaccatggccaccaggcccaggagcggagggcgcggcccttggggtgtgctgggggagggagggtcgtgctgggtgtgtgcgcgtagacatgtgctgatctgtgtgccggggagactgccttggccacccccgcgcctcgccgggcccccaggcctcagtgggcggcgcgctcccaactaggccccgcggggtcccggtgcatccggccggctcctccgaagcctccaccgctggcgctccagggagatggcaacagggccgggtgggtatcctatagggacgggagcaagacagcgaggaaggaagggcagagggtccctgtcgggcgtcaggcccgagctattgtctcccccgggcgttcccagactcggtcgggggttctgcgaggctcccagggaaggccggccgcgggaggccgctgggtaggggcacagaggccggcttgctttgctgggcagttttcaccccctccaagacagtaatgtatccagattccgaagttttgggagcttgtgcctgcgcccagtgttatgaggtggggcgagagcagccttgaggaagggtcaggagtctctttcctgtgtgcttttttttcttcctagagtacggtttctccaaggctgctaagcctcagagtccgggttcaagttgagtggatctgccgggagaggagaagaaggggagcagggagggcagctggcaggctgggagaggagcaggcaggcggggaagggaaggggccagtgcaccgaggggtgtgtgtgtgtgtgtgtgtgtgtgtgtgtgtgtgtgtgtgtgattgacagccggtccaagggaatacaaaaataagaggggaaggccgcctgtattggttacttgttgaaattcccataaaattgaacaagactctgttctcagtgggttaagtcaggctaaaatcctctccggtgtggtcctg

SEQ ID NO: 119214 - DNA, 1040 bp, Homo sapiens
tctttctcagttctttctctgctcccctgtttgggcactgaaggaagtttgcaaagcgtgtctggccgaacgttctcattgcttgacggacttcatcccaatagaaggacctcttccaagctgatggcttattcaaagcaaaactctagttttcccaatgagatttttacggtcgggtgtaaggctgatcttatcaaaaggctctgtcagcacacagtctctggatttacataggggcctctcgagaaagccacatggcgtcaagacaaggctggactgtagcctctcttttggtaaccagattgacatataatacccttcccagtcttgtttttcaacttaaattatatattccccaagtccctggctgaataaataaactgaatcaggggtggggtgtccaactttgaataacaccactctggtctgtgaaactctagatgcctttgtctgggacctagacccattgttcttgcttggcaataatggtttgattctcacattaaatgcattagtttgataaagggccaagaagtgcacactcatgaatctgaaatgacccctttccttaccaaggccctggcatggacagctatctgcaggagatgaaaggggcccagcttctatttttgtggtctccccaaggagcaaactttttatgtctactttgatgtagacataaaaaggcatttctataccagcaatcctttagcatgagcatttagcatgaacattttgtatctgcccaggaatttccaaactttgatgccattacagtctgagagagcatgactgacgcaagtgagccgggagcacaggcaggagcacagagcccagctgcctcccgcaccccctccacccaccccatctacagctcattgcattagcagccgcctctcgcccctctacccacgccatctagagcccactgcgtcagcccagaggatatgtcatttggcagcaaagcctcatcacagatagaaccagctcctcaggcaccctcattcctggagaggcacttgacggggcagagcctgaag

SEQ ID NO: 119215 - DNA, 1029 bp, Homo sapiens
aagcaagggaagtattgaccagctgaccactcttactgaaattaatgtttgaggaggcctccccacaaaaatggccatgcccttttgagagggcaccacacctttctggctcagaccacgtgaaacaggtgttgtctgggcccagggtggggcagcccagaagcctggcttggcagtcttggctccagcaccccttccccacgtgccatctgtaaattgttcagccctgtgaatttgtgttcttccatttatgcactgcagatgatggtacttgcctgcctcttggcatatgaattcagcaagtgacattcataagggccccacgatagagaaatcacagaatagatgtaggcgttaatcttaagaagtgccttctacatgaacagctgtataatggatttaaatttcacattttttgtggtagatggttattccttaactacaacataacacctgggctgagtactgccagaagccccttacttagaataattatcataaataagatggaagaattctaggcatggatggaggctaaccagcctccatttcagtagcaatgcaagaggccatacacagctaaggttctcatagatccagggttcaccgtttacactagcgctgtattttaaatgttagagtgctctgtgattaaagcagtgcttcccaagcataaaaacggcacccgccctcctttcccctgtcccactagcaggtcgccccgatgccccttggaagagtgcctcctcctggcctatggcctcagcccttctgcctgctcaagaggctcaggctgccgctcagcctccccactcagccctggccctctttttttttttttaagacaagagtctcactctgtcgccctggctggagtgcagtagcacgatctcggctcaccgcaacctctgccccccaggttcaagcaatcctcccacctctgcctcacaagtacttgggacaatgggtgcacaccaccaccaggcccagctgggacaataggtgcacaccaccaggcccagctaattt

SEQ ID NO: 119216 - DNA, 1032 bp, Homo sapiens
ccaccagtcagtatcttggacatgcagtggcatttttgcccaccagactcctggctcctactgagaaagtgaacctgtatagacatccattttttttttttttttttgagatggagtctggttctgtcgtccaggctggagtgcagtggcgcgatctcggctccctgcaagctccgcctcccgggttcacgccattctcctgcctcagcctcccgagtagctgggactacaggcgccccccaccacgcccggctaattttttttgtatttttagtagagacggggtttccccgtggtctcgatctcctgacctcgtgatccacccgcctcggcctcccaaagtgctgggacgacaggcgtgagccaccgcgccctgctagacatccattttgatgtggaagttgagcccctggccttgaaatgctgccttatgaacccattaactctgggataaatgttttcattgcctctcagacagcttttttataatagtagtactctccattacgtggttgtttttccattaatgattcgcacttactttgttttttgactagtaccttctcaactttattgttcaaaaattaagttctacttttgaggacaaatacctgtctttaaatggtttttttccttgactactatctatgatatgaagaaaaattaaacagtgcttttagaactgctctttttgtaaataataccataaaaaggttatttgccatagacactgcttcacatcacattcctctacgttgtggtctgaggacctgcactatgagaatcacctgggatgttaaggataaatattctgagagagaatctccaggcctctgagcccacccctctacggctgcagccctggcatccacaccaagaagttcctcatgttattcggatactcagtaaaagttgggagccattgctgttgtgcttagaatatgctatgaaattcatgctcatgttccagctgtcgatgtccatatctgattatgtgcactggaaaacaatgtgtggccactgagtgtgact

SEQ ID NO: 119217 - DNA, 1026 bp, Homo sapiens
ttcctttgtttccttttttagagacagggtctcactatgttgcccaggctggactcaaactccttggctcacaagatcttcctgcctcagcctcctgagtagctgggactactgtctcataccagcaagcccagaacccacatatatttttatatacttaccacaattacatatatctacattttcatataaattgaagtttcataatgaaggagcataaaattggaaacaacctaaataccttataccagagtttctccaactgtttttgtctcagaactcctcttgacagtcttaaaaatgctgagggtccaaaagcacttttgcttatgtgggttatatctatcaaccatagtaggagataaaactgcaacatttaaaggatatttattcatttaaaaataacgtgataaatatttttatgaaaaataactgtattttcccagacaaaaatattagtaaagtggcattgtttcaaaatttaaaaaaatctcattaatgtctgcattaacagaagacagttgagttctcttaactgcttcagtatctcctgtatatcggtgaaagaatgtggatgccaaagaagtatggttctagtattatcataaaaatggttttgcccttgaagaccaaacgaaagcatcttagagacctccagaggtgcctggaccatactttgggaactgctgccctgtactgttagaatgcttatggtaaacatgttagagcagtacagcagaataccatataactctgtacagtggcatgtatgtgggggactgtcaatacatcaaaatacactttttagtaagatatgttcctcctggtcagaaaagaaacagtgtatcttgtaatactgtagtgcatatataactaccaggaaaaataaagcataaatgtcagaccccttcttatattaatatttaataaaaatccaacaacttagcattgaaccatctcaaagaactaaactaataatttaccttatagaaatctaacaatataaagacagagatatgagttctg

SEQ ID NO: 119218 - DNA, 1025 bp, Homo sapiens
gatttttatcttggtaaaaaaaaaaaaaaaaaaaaaaaaaaacaaataaattgttagcagctgcgctattcatgagtgatggttacacagtttatatattaaaacgtttggaatgtgcacaattacctcttttactttctcaccaggtctcctacagtttatataaactgcatttttattaccaaagaactgtccgtctttccctccttatcctcgcccatcccagcttggcagagtttgctccctaaagcccacgacagcgagctgccccccgtccccacccaccagccgcggctcccctggcagtgttgaattcagcctctccgctcaaaaggagctgggagggtttgctcagtttaggattacttagcatagacccttctcagaacctccgggagacccactcacttccgaaatgcaagagagtttttccatttttgccgagagacaagaaacaaatatctgtgtttcttgagcaatggaaaaggatgtttcctgtctcatttgctgtaataattgcttctctcaaaatatcctttcactctgggatagctataattggttgcagtatatgcatccatatatagagtccatgtatacaagacacaatgaggtggcattttgtaagcatgttccataacttaaaaatatacatgtgtttagaaaacattggccctgtgacttctctgaggccatagagaagttagtgacaggcaggcctgggctagagccccatgcccatgcgtgcaggaccacccagtggccaggagcagagatttctatgttgtaggcagagaaatctcaactgataattcatatttttaaaatatgaatttaggggaatgcatcattgtttaaaaagcagcaggcttgcagttataaagcactatgtaaactatagtgcttattagaattttggaaattcagtgaacttactcagttcaaaagtgagttgttagctctctacaatattcttgtctctaaagaaataatgagtgctgcttattcctgtaggtgaagtgttt

SEQ ID NO: 119219 - DNA, 1039 bp, Homo sapiens
ctttgagaaaagaggtcagattttaaactgaagaagagctggttgtgagaaattagagataatacggaatcttattaatttggtgtcacgatatatagtaatttttcactaatttctgacccaagaaaataagcaattagtagtaactaccatgctgtgtttggctctagagggcatttaaatataaaaattgggtaattttatgtatgttgtacaaataagtttcattttacaaatgagttttgccaaatattttacacacttctagtatccataccaaatctttttaatgagctctaaattataaaagtacaaaaagccactggaattgagaggatgtttgcaaagaaggaaatcctgtggtataaatgacccaaatttatagtattttcaccatactgtaactagattgaaggatttttctattgcattttgtaatttggggaaaacctgtttatttcttctgtcagacttctcttaatcggaaatatttatagtaaaatgtacacaaaaagtactttttacattataggtcattttaaagttaacagtattgaaatatttaaaatataggcgaggcatttcactgaagtttttacttctatattattgtaacctgacttagcatctcatataagaaaaagcaagtctccaagtatgtaaataaatttcaaacatgcttctacttttggtttatttgtatattcatcacaaagccttaaacattaacagataattctatttctccttttttcatctttgtcatctattggaatattaactgttaagtaattttctaattttgctaatctagaaaaatatcaatatttttcttgaactatctcatgactatgtattgtttccacgattcctttctactcttggaattcgtcagattattaccggagtttgtatatgtatttttttccctctttttcatcctaacaaactcacttcctgtgaaaataatcagagcactgtcaatactaccagggatatgtgacctaaatcttaccccaatacttctcagaatgatgag

SEQ ID NO: 119220 - DNA, 1050 bp, Homo sapiens
ggtaactttggaaatccagttctttcccttccctagcatttcctgtgggttttctaactgttgtagggtgtgtctgtgccagggatcatcccaaattgaaatcttaagatcttgtgaggtcttttctgagtctgcatttcaccctggctatgcatggtggcttcctaaatcccctcatctatgcagctgttttgaatagccaaaaaaaatatgtgcaattcttttgaatcccttggaagctgcttcagccagtggaagttgaaataatgatatcaaagccttatcttttactaaagcttatgtaaaacgttaaagctaaggaatctaccttaggacttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttccaaaacgtgtgtatatacaggttttctaaaacgtgtgtatatacaggttttccaaaacatgtgtgtatatacatgttttccaaaacatgtatttatacatatatatatattccaaaacattgtattcaatcccttgaagcgagtgtgtatccaggatacatatatgtatatatatcctggatatgtgtgtgtgtgtgtgtgcatatatatatatatatatcctggatacacatacacacacacacacacacacacacacacacacacacacacacatatatatttttttaagagacagcgtagctcttctgcttaggctggaatgcgggccacaatcatagctcactgtaaccttgaactcctacgctcaggtgatctttctgcctcagcctcccaagtagctaggactacaggtacatgccactgtgcctggctaattaaagaaacctttttttttagagagtgtcactatgctgcacagactactctcaaactcctggcctcaagtgatcctcccacctcagcctctctaaacactggtattacaggcatg

SEQ ID NO: 119221 - DNA, 1039 bp, Homo sapiens
atcatggtgcctctgacatttggtaacctccaggccctcagagcaattgctcagggaaatgcaacattgtaggtctggatctgttctaccagatggaaattagtgccttaaaatagcccagcatttttcccccaccactgagaacattttaaatggaatctcttttagatttaaatatttttaaatcttcaatggacatttaatgaatccttatagaatagcttttattttcttgataattgatgaaattaatatcatctgttttaatttcaaagcatgccaagcattttaacctgcaaatccgtaacctaccaggattgaactttaactactagattttaaggtgctaattcttaataatttctatttaatttttttgtaaattttaaccagaacctaagctctgactttgtgattcagttatgtttgtatatacatgtcttcatttttgagtgagtaagaatattagagttgttctatggatttgatgcgatatatgcattgtgattttaaggagagcatgtttctcatttagatattgactagaaatagagaaaacctaaccaacaacttcttaatttactttgtttgtttaatgagcagtttgggtttggtattaatttctgccttcataaatttcccttctcttgaataatgaggatctttcaacccactgcccttccatgtgaaaatggttttttaaacaaccttggttatagttttaaacttcgctggaagaattaggtcatccaaaatatgtgtggggtgtgaagttttgttttctgcacaaagacttgtcatgagtctaaacatttctctctcaagtaatttacaatttaattaccttgtgttatgttccctcaggaaggggaggagaagggaaaggaagaaaaggcaaaaaaaaaaagttttaaaaatgtgtgctgcattcaggatttagatttcaccttataaagtttttattacagcgtcctcctcccctcattgtgccatgaaatagtgaatcactctgcttggtctctgaggacagatgctgttc

SEQ ID NO: 119222 - DNA, 1062 bp, Homo sapiens
ctaggcaagcgtttattaaaatgtgttcctgtccacagaaaattcaggattcgggacgggggtacaccacacttaccaacactttgagtcgtgccattaagcatcgtgtatgcaagtaacagattaggaagcaaaaaggccacattgtcatggaatctaaatcctgagtaaaatgtaagttgtttagggtttcccattctgcaaagaccacatttctgtaattttatgttaacttactatatgttttgaagaaccggctatgtcccttccattggcaaagaactttccctccacccacccctgcccttttgtaaatacagaaaaatcaccacaatgatgacatacaattataataaacatttaagaatcttgtactttcccaggtttatcttatcatctgaacatgtggtgagcccaaattggttgtcttttccctaaggtacaatatttctacacattttaatgcaatttacattttatttttaaagacttacagtgacatatttgaacattctgaaaattaaactttgtatgaacgtaattgcaagagttagcggaaactgaaatgaaatataaagacttccacttcctgtatatgaatttttagccttttcccaaactttctctattgtaaacttaaaacaaagtcttatcagcaagtaccaaagaatagcagctggatatcattaaatccctctgtctaagctattcttcttcattacctttttcctgacagctcttgctctgcacagaaattgtaactttgtgatagagatttatgtaattcaggtgtcctctatcctgaatgagagcttggctgcaaaagaatgaagggtttgccagagtccatagagttttataagaagaagaggggaaaccatacgaaattcagtgaagaaacacatgttaatgtaaccagttcatcagccgcttctacccaatctcccttttatggactattttcgtaagaatatttttctgcaaactgatgtagttagtagatgtcattatactaatgaaaggacattagctattttatcataaagtatgcaccagcacttt

SEQ ID NO: 119223 - DNA, 1031 bp, Homo sapiens
agcctggggaagagtccatgtgtgtcacgtagaagtctgaatgccattccgaattgtgagagcatccagagaagatatgaggaaggtcctggttaagacaatggtgggaaaaacggagaggaagtggcatttagggaaataggcattgcaggacgttctggccagtgggatagaagtgagtgagaagaaagcagtcaagtggtggatatgaacaagtcacgtgtcctccagccactggaaccacctgtgtcagcgtccttcctcatggttcttcctcccttcctatctgtgtctctacatcacaaacatacacatgaacaccacctacctgtacctgtacagagagacaatttctatagcagtgacactacagcaaaaatagggatatatgtgcaaaatattgttaatttgttgtgttacccattctgatattaatagcgtcccctttcctaatctttggaaatcttttaaataaacaattatgcttatttgaggaaaaaaatgagttggtaatttctaattagcagtgacatggatctttagtaggaagcaatcatttcaaaaacgttagcatttggttatcagcttgtgagtttgttaggttcgatagaagtttcactttgcagtgagagtttgggaggaaacactattttccaggatcatgtttcttacaaaggactaaaatatgcttaagccaacctcctccctgcataaagttcacctctgaactaagaccaaactgaaaacaaggaacgccttgaaatattttgggatgttctgagagcaagggattctaggagagagagttcatttgatttttagcacttccagcactttagcactccttaaaggtaaatgcccatgacttaccacccttattcttttactacataggatctttttatatcactataaaacattagtcaacaaagcttaaaaaaatcccgagaattaaaaatgtctagctagttcagtctctgatacctacattctgtttatgcagtgtgtccacctggcagaaacatgaaaaa

SEQ ID NO: 119224 - DNA, 1019 bp, Homo sapiens
ttgtggtagatttttggagacaaactaacagcagtgcctgccttctacctcacatccttcaagtctcatttcgatgtcacttccttggagaggcttctccagcacccatggtttggcttaatgccttggccgtacactcccagggtgtcttatacttctctttcatatatctcgtctcactctttccttctcctaaagtgctgatcttcccgttagacagtacaccctcaccaagtctatttcagtgtactcgaacacccagaccgcacaaaccaaaatatcagcctggttgacagagatgttgcctgggtagacactgtgtagaacttaccaactgattagtattggggcaaagtgaaaaatgaattaagaatgactccaaggttgtaaaccttcctaataggggcatgtggtacattcggattactaatattaatatttctatctatgaaacataggttgacacattctgcagaaagtagctgagttctgtattggacacactgagattgaagtgttggttggtattggtgtggagagattagtaagcatgggacatgtgcaagggaacttagggaatggaattagagatgaatgtccactgaggtgatggtatttaaaaccgctccaagacagactgaataggcttctgttacttggatcttctgaaaattgccatgaatgactatttcattgttgttcccccatgatttttctcaccatcttctagatttcttaaagaatatttaccctagggcaggtgccgtggctcatacctgtaatcttcaggaggccaaggcaagaggatcacttgagcccaggagtttcagaccagcttgagcaacacaggaagaccctgtctctacaaaatataagaaaattagccaggcgtggtggcttgtacctgtagtcccagctactagggaggtttaggcaggaggatacttgagcccaggagtggtagactgcagtgagctatgattgcaccactgcacaccagcctaggtggcagagcaaga

SEQ ID NO: 119225 - DNA, 1050 bp, Homo sapiens
atctttgttctctgcagcattgcagattcatatatgtatatacacacatgcactgtctaatatttatctggtctggaataagcattaatctttaattactatataaacattttaaacaggtgtggaataactgcactctcaaaaatgcagtgtttatctccttgctgcctgatggcatcagccccactgcctgacagctttcacctccctgtgcttgaggtggaaacggagaggtggtgggtaaagggcaaagaaatgccccaaatcccacatgaatcagaaatttccagttgtaaattatgcaccaccataacatcctttaccacagtttgccagccaggaattgagtttggggtagtgtttttctgtgttggtagggtgtggggctgggggctgtatatatagccatgcatttttttttcttcctgtggattgtacgccctcagccgccttttcttggggctgtgcacggagcctgtggtgtgaggagatataaagcagcatttttctaactgcctttggaaacaatgagggctctgttaacaggagcccaagcctctgcagaccgcttcgctgggtggaatgactggtggagcccaggttcaaagccattggcctccaagtgctttaattcagcgttatttttgcttctctaacatcttttttcctttcgttctttttttcttttttaacctaagcattctgaggtctccttgtttggtagggaagtgagcagcaactttttataattagattaaagttaatcaaatgaaggcttggatatttttaaatgtcatttaatctgcttctcttcttccttcatggattttatcactctagcttaatttgttataaaatttcacctcatttttgcctagtaccaggttttccagtttaaaataaagtagaaatagaagacaacagatattttcagcagtctctgttcttccttgaaatacacaaactcaattctgtactagacttgacaccaagtagttgtaatattcctagtagtaatttttctgctattacaaatctgctaggttggag

SEQ ID NO: 119226 - DNA, 1037 bp, Homo sapiens
accatggatgagggaaagattaatttgaaagaggggatctgagaaagtaattgtccagtaatagggaaaggaggatgctttgctagccagaagttagaattaagtgcttctcttgcctaataaataatctgttgactgtaggtgctcacagcgtctcacagaaagaggatagtgccagcacatctgggctggctggctttgatagcagtatcttcgtcctcattcacaaaagagaaaagaaaagaaggcaagtaacttgccgtgctgttaatgtgaactatgctcttgtagaaagtattattatgtgagtaacaggaaaataattgagccgtttgtaactgtttttaaaaaatccttacaagaatacatcataattggctttccttactattcacaacagcagcttaggacagaattttgtcgtatttagcatggaacaagtatcaagtatgtttaaaacaaggatcattacgtttttctattataaaattggtagatgaacccttttattatttcatgaaaaaaagtaatttctgtaacaaagaaggatagaaaaattccagtttaccaaaggttgctttcaactcctcatgtcagggaacatcatttattgttatttatttgattgtgttccctgaagtactcaattgaaataataatggccttaactcatatttttacagcaatttttaaaattaaaatattacattctctgtagacgtcatttcaaaattaatgttctttcactatttaatgacctactctttttctttccttaaacgtatttacgtaggtttttaatatatctctatgcttgcacattatcactgagacaacaggcaataaaaatgccagaacgtctcaaacagtgaggccgagaagtcacaaacaggtcccagctggagggtcccccagcttgttctcccctcccctttctggccagccccttttaacccttggtactcgttaactctccttgtggatgttcagagtaattagacagtggtttaagtgtgtgtgtgtgtgtgtgtgtgtgt

SEQ ID NO: 119227 - DNA, 1031 bp, Homo sapiens
cctagaaaggctgtactatctctgaggtctcatacacgatatcgagatcagatctcactatatgtgaggaaagtttttagagatgctttagaaatacaacagatgtctgagttggttaatctgaaaagagtcagtggattattctgttagcatgattaccacccagtactacagatttcaatactgctttaacacagaggagtaaaaatcagaaaatctatagtgaaaggcacttctctctatctcaatattctttaaaaaaaaaaaaacctttggtaacataataagaaataagaataggtttctgtcttcaagaaatatttagtttttagcttaacataaaaatgcctatattggcttataattctgttttatttagtataaaagtgcccatattggctcattggcccataggggctctgaagtcacttgaagtttactcacccagcaagcttgactccttagcaggtgaatattcaccctatgcgaggggtgcatttatttcaaaggtttctgagaatgctgataaattccaccacctttcttagtagcgtatttaatgttttttcttcttgtgctcaagtcctcctcacttgtatgtaaatattttgctgtattttatacccaattttaatttttacttaattttaattttgtttaaatagaaaataaccagataattactttattttccatgtctgtaatgaaatttgggaaataattcttgaattcttctttttaatctttatcgcaactttgtataatcatttatttagcaactatttgaaaaataccagccattaggtgaaactgttttttcactctggggatggacaacaggatgaatacagcagagcctctgccttcactgggcccactgtgtaacaaagaaacatgcttgcagaaaccaagtataatcaccagtggtgaggctgatgatagctcagggcccaggtatatttagaaaaggctggggctctttcaaaccctgctttctgtcatttgcttttttcagtatgtatctgctggga

SEQ ID NO: 119228 - DNA, 1368 bp, Homo sapiens
aaaaaagaaaacaaaaaaccagagatgagaaactgttgttctctgctcatgctccttccttcttcccagctgggcccccatttccactctcttaaattgaggtcaggtgggaaggaggtggatggggaagctgcagccgaaagccagttctttgccttgcactttcgttgccctctttgggacttctcttcctggccctggcttaattacgggactgatataaacaaggagctagtgtggaactctgcacaggccgctggagaggaccaggcagcagttgccaggactgggttctgtgcagcggtcttatctgggagcagccataagaagggaaactgcagctgcaagtcagaatgcgtgtccagtcacagtaggccaaggcattggctgttccattgacacagctaggggtaaaaagtggtaacaccttcttttttgcaaacactgtgaacctaaagccaccctgataaatttgtgtctgtctgttagatccaatagttaatttttaagtaattcatatagggagttaaaagcttaattaaggctgggtgtggtggctcatgcctgtaatctcagcactttgggagccaaggcaagtagatcacctgaggtcaggagtttgagaccagcctgaccaatgtggtgaaaccccatttctactaaaaatacaaaaattagccaggcatggtggtgtgcacctgtaatcctgctactcaggatgctgaggtgggagaatcacttgaacctgggtagtggaggttgcagtgagccaagatcataccactgcactccaccctgggcaacagagcgagattccatctaaaaagaaaaaagcttaattaaaagtggatttatggtagtgggttttggtaacagatttgttactgaaatgcattacagacaggcagattccagattcccaaggctgatggatttcaagtctagggaagacatatttctaggtaaaagctgtatgtgtattgtggctttctctttggatatatatttcagtctcccccgagagaaaagaaatgtcatatttaagtaggaacatactttaataataggtgctacttacatctctactatgttgtttctgttatgtgggatttgtggtataaaaataagcaagtatattatttatagtttttttcttaagagaacactaaattttgaataatttcaaaagcctatgctaccttcagaagttaagcatggatcctaacaatttatatggcgtaactactgaatgtttacagtcgatgggatttgtggagttctgtggcctccttggcaatttcagcatgtggaagaggtgttgatattgtcatatgacctcagccctggatcctcatctgtcttctagct

SEQ ID NO: 119229 - DNA, 1018 bp, Homo sapiens
tcctttgcccatttgtccactctagttcccgccagactttgaggtccttcgtgtgaggactttgtccttccctcttgttattctcaccacttgtttgcagtaagttcctcaagaatgttatggagtaaataaacaaacatgtcccaaaggccttagctcagtgcttctctaaaggcagcaatcttgcccccagggaacgtttccaatgtctggcgacagtttttagggggagtgcacatatctaatgggttgaggccgaggatgctgctgaacatcctccgatacacagggcaacaatgaatggtccaagctaaaaggccagtagtgccaagtttgagaaactctgccttagctccagcccttacataatcatcctcaagccaagctctctgctcccccaatctgcttgtgcctttattggagcccttaggaaattcctctttttccttttccatattcttcattagattgtgctcctggaggtcaggaacgatgaatcactcagctttgtagcttcagtgcctgcactgtggctcggtaagtaatagttgagtagaagaatggatagggaaagaaaggagtaggagaagaagctgatggcatatttcaccgctttatgttttaaacttaggtcagctctggatctgtctctgtatctggtggttctggttagaaacaaagagaggggccaagtggtgagtaaactgagaactatgtacaaaacctattgggcaggatactagtttcaaactgacagggcataactggcgtgcatgttcattttgttacacatttctatttgataatgaccagagtttacatagaaggtgggaagaataatcatgtaaagcacgtctgttcaataaaagattctttagtgatagaaatgttctttatcagtgctgttcaatacagtatccctggccacacatgtgtattgagcacttgagtgtggcctatgcacatgaagagctcagtttttaattgtatcattttaattgatattatcttaaatggt

SEQ ID NO: 119230 - DNA, 1023 bp, Homo sapiens
tctttattcttctccttagtttgaaaaagtcttcaaatgtagcctcagacctattattttttatgaagagtttagagacattgaaaaaaactctgtactagaggatttggtttttggaggtgttttttccctacagagtagttcgtggtccctcaaagaccttgcttagtcagaatgttgcttgaaggtgtgcaaagttgaagggaatgctcatttttaattttaagaggaaggaaaaaagttaaaaattgaggctaataaaagttaatgaggaacatttaaatccttcaatggttcaatttatgttgcaagtcagaatggttcatgccgttattatatgtgtgtggcaacatcctctctctgctgtaattcttttcccttgaaaactagcccatgcagcgtggaaggcatatcatactctcatgattgctgttcattcttttgacaaattccacggctttttttttttttaataggggaaagaacaggcacaaggaaattaaaatataaacgtctgttttttctgccatttttttcctgtttgacagattactgaataaagcatggttatcagcagagtgaccatttctaactgtctctttgtgcttaaaaatttattttgggatgggaaacattccccaaacccagagggtacacttaatatgccagttttcatttgagaagaattacttttcagttgtaggtgttttgggatgtagcctgactcaacatccagtattaatggtccaaagatagaacagctgaactttctgactgcccttctttgggagacattagcatgtccctggagacagtttccccagctctggttacgcggatcagtatgtagggaaagcttattacttttagaaacgttcctcttggagggccctgtctattacccacatcaaatatatggtacacgttgctgttttctttgctttcgaaatgcttcagaactagcccctccatctttccctgactgtagggtccaggctgtgggaacagattttccatcagacc

SEQ ID NO: 119231 - DNA, 1052 bp, Homo sapiens
ctcagcctcccgagtagctgggactacaggcgcccgccaccacgcctggctaatatatatatatttttttagacgcaatctggctctgtcgcccaggctagcgtgcagtggcgccatctcggctcactgcaagctctgcctcccagattcacgccattctcctgcctcagcctcccgagcagctgggactacaggcgcccgccaccacgcctgtctaatttttgtatttttagtagagacggggtttcactgtgttagccaggatggtctcgaactcctgatctcgtgatccgtccgcctcggcctcccaaggtgctgggattacaggcatgagccccaacgcccagctgagtgtgaaattttaggaagtggctctgccttacttcttaaatgtcactacacttccgagtcgagatgggagctaaagagaaattgtaatccaagaggtttcagtatgagtgtcctcaaacagaagtatgaacattatccttctgtgaaatagctctatcaattctgaagtaaagcccaaacatgatgtggaacgatgtgggataagtcatttttaatgcaaataagtcatttctgcaaaaaggagttgatttcagaagatgatatacatatctctatattgttccagtgtttttcattcttacatagactgaatatattgaatttgatactctctctgtcacaacagaaagtttttatccttctcacatccctcctctatttgctacagctctgattatagaggtaaaagtgtatacagaggtccctacaaacatgaaggcagagaagaaccctaatacgtgtcagaagagagacaagctgcctagtgtgaccagataatttctttgttctgaactggcatctgtggtattacctttattcttattagtatgcaagtccttgaaaaataaatgtatcagtggaagcatttaatcattcctgagactctggaattatggcagaagcaataagagaatcaggttcattatgtcctacatgtgtaaatgtaaagataccttcctgtttaaactgtggaatagccc

SEQ ID NO: 119232 - DNA, 1264 bp, Homo sapiens
ataaaatggtaggtgactgtgaggaaatcagtctgacaaaatgagttctgtaggggacagagacagacattgggaacaccaagtgtcaagggtgtcgagtgaaaagagcctggttaggagtgattagaaaagtagcaggagaattaggaggtggtgatatataaagaccaagggaagggaacatatttcaagaagcatggcacagcctccttgagtcaaatgttgtcacctgtcccaggtggtctggagggtctagctgagtctggaagttggatatctgaggtgtgtgccagttggcagacctctgtggttttctctttgaggtcgaacacactgggtgtagaagtggagaagacaaatgggtaggttgtactggattaatggaagatcaagaaggtaagatattggtcctgatagagtgagtcgagtgacagactatggggtctagacttttttctgctgtaccaagatttctgatggaaaatgagccagcagaaacgaaaactgttaaagtagattttacatgtcaaaatgccagttgatttaggatgcaactccaggctctgtccattccaagacacataaatttgtctctgctttcccctgaaagagttgaaatcataaagcggcaattgtttcctgaggggtaaatggccattatgcactggcttcgactaggattttcttacctctagcttggaccatacagttgaattccctgaatcctagtgatacttaacatattgcacgaggccttgtattttgaggtaatttaaaacgttattaatccaggccccattgagtaaggacttgagctattccagacacaagccttattaaaactcacagtaacagtctctgaaaaaagttccactaagcaaactaatagtgcaaacaagattttagcaagaatgtttgaactacttacaacaggactttgtttataagcacccttaagtacttcttaagtacttgagaagctctgacttacctataaactgtctatatactcattgcaaatcacccttatctggttattaaatctgtggattgatactgtgtaagattttattagtttaattccagttgctgtattttatagatttcagccgctaatgtcaaacattcgctcaaataattttctaacgagcattattaaatccaaacatcagaaacccactgaaagctttcttaaaattagggtctgtctttgtactccttgctcctgtatcccacaatccttattttgatcacttctgctgtc

SEQ ID NO: 119233 - DNA, 1083 bp, Homo sapiens
agctttttctggctcgttctcactccacatttgacatgcaacaaaagtgacttttgtcttgttatggaagtgggccaaattgtttgacataatgacaggtgggatattatttagggctgccgagaccttgggctccacgaatgctttgttccctctagattgtgttttgacttgcatgtttctgacagccattgtggcattcacctcttttattgagtttggaacatgcctgtgagagctagcctcataaaggttttaactgtagtgttagcagtttcttaaacattttacatattaacatttattatagtttcattttggtgttaatattatacttaccatttattatggtttggtttggtttgtttttacatagtttcccattatgaggaatacagccactgtgtttatggctgtgaatatttgtgctttgtgatttcttggccttttggacacacacagaatgtcttgacatgtatttacttacaaattgaaaaaatacaacagatcttaccgtttcaggtaaatgaattccttaagaaattaaaacttttgctgattagatatcttcagtaccagaagtaccagagtatactattacaacaggaagtgataggccaatcccaaatttgagatttattataatactccacaggggtagtgatttatctttttttcttacttttcaataaaaatatctttatttgatacctttaaagtttcaggcactgtgccatgcatgggggaggtagcaatgaagcagacaaacagaaaccttgtcctgggcttgtgtgccacaatttgtatctctggctcatcatagcaaatgccctgtctataggatctcaccaaaagcaaattctaacacagattggtagcagtaatgctgtagctactgttcactgagagctagatgctttgtgtatgatattgccaacccttacaagtgagaaagagctgttactagcttcattttataggtaaatgaactgaggctcagaaacattaattaatttgtcccaaatcacaggtagtcatgagaattttaaaactccagtctttttgttgccagttgttcctttc

SEQ ID NO: 119234 - DNA, 1048 bp, Homo sapiens
ttgaggacatttgcccatttggcaaactggaacttcattttgacagtcctatgtgatcaaaggcacagaaatcaaagggtcacattcttagatttatggtgaattatgcctaaaccctctctccacatggccccagcgtgttccacaggaaaagtacttttgtgctacgcagagcaggagtggagggggattcctaagaaggtgtaaccacaagtagaccctcaagcatactgtaatccaaagacgtactgcttgggtagtccagaacattttaaactcaggatttagttttaggagtttgggaacttgtgtaagtcctaggttcctgacacaagccaacagaatttctctctggaggaagttaccacaaataagacccaagaataagttttcaaaagcagtgaacaacacatagtaaaaaataaccaggcactcaaggaaaaagtctgatgagacctctcctcttacatctccttttctcttttactttgggtgctgcttctctttttccttctgcttctcttttctttcttattatctattctcccttcttcaacttttgtagctgttttatttgcattgaaaatcatcctctactttgtggcctcttgaagcatttattttattttgttctcggttctgttgctctggttaagtccttccttgtcatctcacaaatagtctattgttagaaccttttagttgactttaattttattttttcttcctaaattcaatagtaaatcaggttcaggctaattaagtctcttctcacaatccttcagtagtttctctgtgaaaattcctgagcatgacttttgatttccttgtaatctggccccagataaaagaactaaaaagtattggaagctgggggaatgattgagcaccatttattcatgacattcatttccatactggataacagtattttaaatgaatctatacgctgtttgagaaattagttttttttgttttgttttagtattaccattggcttttcgtgtagtgatttacacataatagctgcccaataaatgttcactgg

SEQ ID NO: 119235 - DNA, 1032 bp, Homo sapiens
aaatacatttttgtccatatattagtatacacaaactgtaacttcatattgggtctctgaagataacttattttgcttagtatatttatgaatcgatatagtttattatgatgttatatgagttttaaaactcattgttttcttgtcttatgtaatttttagatgtgctcagagcaacataaatcactctagtttgttagcaaattatgaatgttcaaataataaagattccttatgagcagaatgctttacttgttaaagagcagtgagtactttgaaagcctgaggattaataaggtatgtttgcatttagacctaatatccctgcatactatagtgccttttgtgtctagaagaattagctctcttacaggtacagtgagtaggtgcttggagcaaagactggatacttttaatctctgtgaataggtgatgtggatggaacaaacctctacggtcaagtaatgttacggttttgtttgtttttgttctacaagctcccatttctttctgatcagtcctgttgtcccttcacctgtgtggacacagcccccgtgataacttaatacagtttgtaaccacttttatttgttacagcgcaaaattgcaatacgaaacctttttcattttataatttcatgtttaggtttataatgaataaacaccacgattgtaaatatgactagtttattcccatggttcttaggaagaagttgagcatgtttgactttgtattcatcagggtaggcaggagtgtatgctgttggtgggtgcctgtgtgtcatctggctcagattcttcttggaagcctgttgtagatttgagcaattgaattcaaatctaaaaccacttaaaaagtcctttatagtccattaagaatttatatgagagagaacactctatgaaagttctcctctccctgttcaaacagattgttatgttttattagagctaggtggtattgtaattttgataacagctaataatgtttggaattttgctcataattaattagtggaccacacaaagcta

SEQ ID NO: 119236 - DNA, 1035 bp, Homo sapiens
agtacatatgtatacgtatgtccatatgcataagctgctgtaataatcgagaaagaaatgcatattctacggagcagagagttttagagtaggttatgtatagtacaaagtgttggttttagagaaagacctatatttattcaggctagattaacctaacgccttaatatctgttaaaaggaatagcttggcagagagatgcccatactgtgtttcagatatttgggatgagctgagagatgtttggtggctagagaggaattagtgatgttgttgtgtatcgagtgaacctagaaaatgagctagctgagcagaaatcgctgcacttgtgaagagtgaggtggcgtgtcaggcatgtcagaagtgatgctcaaaaccacgcaagtgttgcgatccactcttagggggacaaggtgggctgagactggaggtgagggtggtgttaacaggcagcatctgtgtctagtccagaggaggagggagcacggctatgcgctgcagtgatggtggacccagtgacagtgacagggcgagtttggatgtgtagatggcaaccattctcaagcacctggtactgttagtgttactggaaaaggcagagaagcagatctccatttaggtgtcccttgttaaggaactagcagacttcagaagacaagaaggatgagagatttgcaaatcgatgcaacaagaacctaggactgccagataagctgcagatgtttttgtggtatttgaaattgtaagagcagattttattatgacacaaaaagacaatagaaggcccacttggcaaatcatagttaatgggaggaatttatcattgaaacaatgtttgagagagaaaacaggtttaggagagagatccgtgaactgatagaaggaaacatggttgacactatagcgggaaagtacacagccacaaagcataatcagaaattagttctcttcctagtccaggggaaatgtgagctctctgcatattgtgggactgtaagtgtgtttatccttactgtattcaactttaataggctg

SEQ ID NO: 119237 - DNA, 1019 bp, Homo sapiens
gaactcccaggttcaagtgatcctcccacctcagcttcccaagtagctggtaccataggcacgagccaccaagactggctaatttttaaagatgttttgggctgggcatggtggctcacacctgtaatacaacagtttgggaggccacggtgggaagatcacttgtgtccaggagtttgacaccagcctgggcaacatagtgagaccccatctccaccaattttttgttttgttttgttttgttttgttttaacagtgctaaggtctcactgtgttgctcaggctattctccaactcttggatgcaagtaatcctcctgccttgacctcccaaagtaccaggattataggtgtgagcaactgtgcctgacccccagtgatcttgtttaatgaccccccagaattactaagatttctgctttatgttgctatgacaccaaggcattctgcccccatattctgcatgtttcacacaactggtaagtggcaaaacctaaacccaaatccatctgattctggaacttcatgctgtctgttgatgcatatcactttcctggatttcattttcatcctctgtcttctgtggagctcaaatgaatactgtttgtgaaaatgctttgtgtatagtggaacaccatgtggtatttattgacattattggtgttatttttattttaggttgccattgtccttaagttaggtagccttttaaatgcttttctcaaaactcttcatctagaccacctttctataccactatgagactgacgttttgcaattttttctttctccccaggatggttcctacctggctgagttcctgctggagaaaggctatgaggtgggtgactcaatgggaagcgggcgcaggctggtggggttgctcgcatgcagcggccacatgcttcctctgctgccgtcctcctgagtgtgttttccactgaaacgcagataacaaatcagaatccggggaagaatgtgtctttgggcttgtgagcctgccaacccattgtgctgttt

SEQ ID NO: 119238 - DNA, 1048 bp, Homo sapiens
aaagtggccagcagatagccaaagaggtttttactaaggagtgagcagttttgatttgtgattcttactgaggttggaagttcctattttgatgtcttctgaaacattatcacttccatttaactgatggggaatgccattttattttagcatctagattatttatttgaggttgattggaaattttgctttacaattctttttcatttttcagaaaaaccagttgtcacatatttatgctttacttttgtgttgtatttttaccaaactgtaggaagtacttttttcaattataaattaaggaatccctcccagagcagttacatgaatgtcaaattgagatagcctttgaattctgtttcccttatgcgtacatatgttttattttgctattgtttttaaactattatatatgtatgtatatatgtatatagcattactagaaactattttgctattgtttttaaactattatatatatagcattactagaaactatgaagggaaaataaaagctggaaccagcaaggtgatgaaaaggccactgtgggagttgaacatgaaagaatggtgctttcatgaggaaggaggtattgatgtggttttgggggctgaggtttgtttttgtttcagctaccatcttagagacaatagtgaatcagaactgtatcaggcaggcagattttaatgcccatttccaaacagagatgtctctcttagatactcagggaaagagtcacatagaccatctgtatttgttctgcttctcattttacccttgaggaatgaaggaattctgttgaacagtgccagcattagtttaggctgaaacatataattgtattgagtaataaaggaattttaaaattcctgttttttcctgtggctctctttcacaaaacaggctaatggtgaaatacttttgcaagtgttcccattcatctctggctgatgcaagatgcctagtgccttgtggtttcctaattactgaagccctaatttctttggcaaatctctcccctatagatttcgttttggtagtgaaaat

SEQ ID NO: 119239 - DNA, 1052 bp, Homo sapiens
accagtggagttttttgttctttgttggctgtaaggacttagaaatacatcaaaattgagagcagacttttttattctaaatattcagaagtggagttccttttaataattttgaccttgcttacaatacttgtattaaatttatgtttagaaacagagtccttatttggcatctactttgccccattttaagagtttcttttaaaagaagcagttgatgtgttctgactggtatttgaagaatttaactgattcatttaacttcagaaagtacagcaaagaaaagaaaaagcatagtagaaatctaaatttgtggtttatgaaatggaagcatagttagggtcttttctacagtgtatcctctctcaatgtataaatacactgtcttagttatttaatattgatttgtggtgatgtaggctaaaggctgccatctgacattcatatcatgtaagattttcttgcctcacattctgaggcccacattttgtttgtagggaagtgaccttttgctttgctccttgtttcttctactcatggatctcaggccttaaagtggtgcgcatgaagctgtccggtatcaaggtagttttggttttggatgctgttgttggtaaagaacaagcttcacgctcacccttccctgcagtttgcagaccctcagagagctaaggagggaaatggaaagaattggagcatgactgttgctaacacatctttccttctgaggaaggaagggaaagagcaggcaaatgtagaaacaataaagatggaaggggcacccttagagaagtttgtacctcctcagtgtaggggcatgaaatgacacccacaaagaagagccatggtattgtcttgctttctgcctcagtattggctaactttcactttaaaggaatttttaaaattggtaggacataataaatgcttcaatgaaggcaccttagtcatccagccatttgttcgcttatttaagcagtacttattgactgcctgctgtgtgaatccggttgtttcactaggcattgaaggtacaagaggaatgttgttcc

SEQ ID NO: 119240 - DNA, 1015 bp, Homo sapiens
gctaacttcatgtgtgtataattacctcagaaaggaaacaaagatttttattgatattatttaaaataatgttttctttttctttttagcaaagtacaggctgataattccaaaggctgtttaaggggtaattgtggctgacagagcagcattcacggaacatcactactgtgcttggctggaacagtgtcactgtgtctgaaagtcttgataatgttcagttgactgtactaattgtcctgttttatgcatggctagccaagtggtaaccaagagttttaaacaatggatctttattaaggtattaatttttgtcaaggaaactgacgtgatttgaaagaatgtttactgtgtgtgacacgtgtggaagaaattgtttgtgttttcccctcttccatgtttaggaaataaaataaccaaaaagtgtgtgcgtgtagcactttttaaccttaattgtcttttatttatattggtatcttgatataaaaattgaaatttgttataatgataaagaaattagagatgtgaaacatgattgataaagtaaggaagtaaaattggtaaaaatgcttaaagatataatttagtgttataatacttttagctgaaatgtttatttattgggtttaaacaactatatatgtatgtgtgtatgtttaaaatatattccatgaggaatcgacctttaagaatcatgaagcatattttccccaactttcttcactcttctttacaagtcttaattttttgtattgtgaatattataatgccatttctctctgctttaatgttcttttaaagaacattcaaagattacagtgatttaaaaaattaaccttgaactcaagaagaactcaatggagaatacagaagcaccttaatcaatagatgccttttcctcccctcacacacacacacagtccaaactgctgacagagctgagattaagccaggatttcctgaggcatgggaactacctaacttgacttacatcatgctgaattgagaaagacac

SEQ ID NO: 119241 - DNA, 1114 bp, Homo sapiens
cagaggggaaggggtgatctaaaatgagaatcacttttatttttacgtaacaataggcgaattgctcttaggggtagtattcattccttcaacaaatatttactgagcatctgctaggtgctaggaacaaaaccgtcctaggaacaatgcagacaagttaatgggcaatttgaatccaatacagattttgtaagtttgattacaattctaaactctaatgttataagctcagtagtttgttgtcattgtggcatggacaaccagttagtcttcacttcctccttaaaaatacaatccctatattatttggggtgaacactgagcttaattaaatgatgacattttccagcttccttagcagtaaatgtgactgtgattcaattctggccaatgaacataagtgacagtgctttgtggaacttctggaaagcctgcttaaaggaagttgagagttgggagacatgtcccctgtgcctttaccttctgcttttctgtttcttggtacatggatgtgatgtctggagctccagcagcagttttcattggtgacataaacttgagggtagaagccagatatagaaggaggctacctaggtcattgattattgttgaccccgtaatcagcagttcttgactggctaccatcagacttcttttacatgatgtgtgttggattctaacttatgtgcagcttcacctaatcctaatagagtaaagcttatgttttcatgaccttataagtaaaacttatgttttctctgacctcatggcatggctgtgaataccaccactaagacttctgggagtgtggttttcagtagttcacccctgtgcttattctcccttcatggctctgatggactgctggagtaatttcagataacaggtaaggacatcctcagactaaggaatatcatctgtactgttcctaaacaaatatacctggaaatactttaaagcagtggttcccatagtgtttcctcagatcagcaataccggcatcaatctgggaatttgtttggaatcttaggcccacattttgacctaccaagccagagctctgaggggtggggcccagcagtctgaatgagtgacttggatgcagcctaaagtt

SEQ ID NO: 119242 - DNA, 1051 bp, Homo sapiens
gtagttgttacctgtgctactgatgagaacattagattgcctaatagttttttttttttttttaatgtagcccactgtaccggccttagaattcagttagtgataatcgtttagcaaaatgtgtttaacttgaagaaaatagtaaaacatgctctttctaaaattatggcttctcaaattaccacatcttgggcaagctattttctaaagtgcttttactttccttcgggtatttcagctacattgagctcttccacagtttgggctgccataaatctatgggaaagtgttttgaataattatgcagacagtttcttagaagcatctaacatatgtgggcctccatcagtaccacctctttgtggccctgcaagctgtgggaaaattgtctgtacagcttgtatataatactctacaattttcctgtgactgtaaaaagtatggactggcgatcagaaatagtagcttctgtttttagctttgctatgatttgatatttatccttaggtgagttgcttagcctttctttgtgacaattgtgtcatctgtaaaacggaatattgaatgtagataagctaactgcactgttcagctgtgatgcagctggtaacagaacaagtctcctgaaaatgatggataaatcttttctaatctaaactgctccagcagcagttttgggtgatggcgtaaacttgagggtagaagccagatatagaaggaggctacctaggtcattgattatcgttgaccccgtaatcagcagttcttgactggctaccatcagacttctcttacatgatgtgtgttgggttctaacttatgcacagcttcacctaatcctaacagagtaaagcttatgttttcatgaccttataagtaaaacttttctaatctgggaagggaatacctgtctgccttttccacctcatctttcctgactgggtttttcatatgcctggaaaaagctactaacttggcaaacatatatatgcttaatttcttggttctcaagatcctgttttagagaaatcttctcaatattttcctgttg

SEQ ID NO: 119243 - DNA, 1058 bp, Homo sapiens
ttcatcagtcactccccatcccctcctttcccagcccctggcagcacaaatttacattctgtcttgtatgtttttccctttgccttagatctgggaaaggttttttttcgtcatggtggggaaatgggcttctgtgcagtcaggggagaagccgatggaggaaaggagtagtgtggttatggaagaggctgaaggggagaaggtcgcgggcatctggaggcctgagatgtgcatgagcatccagtcctgcaccggcgctggtgctgcagtggtgccgtctctgtcactgcagtgctgttctctgagagctgttccgcagcgtgattttgggtgctgttcctcattatgaagcctctcagtcatcttcttcagtctgcactgtacctttcatagatttctgattcaattagctgcagattggtttttgtggcttcctacctgaacgaagatagaaaatgatgatatatatgatggtggacggtaagatgacaaaccagttttgaagtcctctaagaaacatgaaagtggatgtgagtggtagatcacaccagtgaggttgtgattttgattagagtgttgtgagtaaatttcatgggccataagtgctgacaaacaaagattgttatggtttgatgtttcaaaaggggcatcaggaattgaggataaagtgtttgttgtacccccttttggggtctaggagaatgaatgagtaaaaatcctgaatgtcagtagctcatggagtgttagattttacatagactggtaaaaacctgagattgatatatggtggctaggttattttgaaagtaagaatcttaggagtaacaaattgctgtctgctatcacagtatttaaaaaaaaaaacccgttttacacaccaaaatgtaagaagaacatgctcccagaataaagaacactcaccaaattatatacttttgactatgtgaactactttttctcatttccatttttttcattttgctaaagaacgggttaaaaatgtgtcatggattggcattagtccatacagtacatttgggaaccacctattgaatact

SEQ ID NO: 119244 - DNA, 1005 bp, Homo sapiens
ttccttatgacattgatagtctagtggtatgatgatggtgatagttataattatggtagattaaaataattaacaagtactgagcatttagtttgtgccaggtaccgttcaaagtgcattacattttgttcaaagtatatttgttgaagcaacagagagcttctatgaggtggttttctttttcttttctttttttttttttttttttgagacagtcttattctgttgtccaggctggagtgcagtgacgtgacctcggtttactgcaacctctaccttccaggttcaaatgattctcgtgccttagctgcctgagtagctgggattacaggtgtttgaattactgcttagctctttctgaactgcactggctttgggtaagtcacttatcttttctgccaggttggaagaataattcttatcaaataggaaataaatctgcacatagtagtggcctttgcctcattactggaatggaccttccctccatagtgttaacagaataataaaagatttcttgacttttaggaaaggaagttgaatgtgggaggtattactatttagccttgctttgcatggggaatctattatctagaagcagaaagttctgtaatatttggaatcaaccacaaggctataaagtactgggaggccaacagatttaatgtccagtgagtctttcaagactgtgcaaagcagatctgggagctggtcttatcttctcatataagaggattgtaggcagtgacttccattctaaatcttccttgctgggatttgcagtcctgggataaaaggtttggcattattgggctgggcgtggtggctcacacctgtggtcccagcactttgggaggctgaggcgggcctcccaaatctctggatcacgaggtcaggagatcgataccatcctggctaacatagtgaaaccctgtctctactaaaaatacaaaaaaattagctgggcatgggggcaggtgcctgtagtcccagctgcttgggagg

SEQ ID NO: 119245 - DNA, 1102 bp, Homo sapiens
gtggtggttcccatgggtgctggtctctctgtgtcttaccagcttttcaaactccatgtatgtcatcttttctagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggtatattaacttccttctaccttttggtcgttgtgaacatcaaacaatataaagtgtgtgagatcactatacaaacgctagagacttacgagctttgtttacaaagaagcgtaggcttgtgaacccatctccttcaagcctatttctccatacatttcttagtgttttttgataacaagaaaatgctttctctatctgataaatgaaatggttggcatatccctgagctatacgtatcagaaaagcacctttgaatcaaatttccagttttaggaatttttaatctaaatactaggagtcattgtgaacagtaaaataatgattttaaggtcattattttaatgggtttttaaaaattactttaacagtatttttattttgaaaattaaacaatcggtattttctgtaactccaggctctgtcttcaaggtgaatgttggaagagctaatgattactgtttatttaaatgggtttctgaaataaaaggacacaagctatttttataaacaaagccacttagggatttaaaaaaaaataaacattaaaattttattgggctgagatctgagagctatactctaaataaaaaaaaattaaatttttaggcataactttaaaaaatttttttttgtaactttttaatcatacatagaatatttcacaaaactctactgagccttttttgaacctttttgaataaaaagacccttttaaagttctgacgaggcgttagcattctaggtttcatattggaccactgactcatcttagtattttttccccataaaacagcataataggaataataataatatgattgagtgcttgctgtgg

SEQ ID NO: 119246 - DNA, 1083 bp, Homo sapiens
tatgttttgcattatccagcataagggataattacccaggtatcaagagcctttttctttaatactattgcccttttcatcagcagcaagcagagtaaaatgaaagaatgttaagcttaaaaccattaattggtcaacttgttagcaattctaacaagaagttaagttaggagatatcataggccacagaaagaactcttacaagtgatttccgaatacaagtacctgccaccccaactgtcagggataattaagagtggattgggatgtcttttagttgttttaggtaaaattttgctttccaatccctgttgacagctctatatacatccttgtgcatataaatcagatttggtgacactaatctagttgaaagaaaagacttccaaccccatatacttactttctctctccaggaagctattggtgtgcatttgtattcttgtgtcatgttttggtgccctagatagcaactagaacatttacagagaagtcccaggctgttgaactgcacgtgagaggaggtgagcagggcactggatttggaaactaatcaagctgccgcttagccgttcttgattgcacttgaggaattgtgagttgtcacacagtatactcatgtaagtgataaattcccattaaagtgaaataagtgttctttttttaaaaaaaaattccctcctgtagttattattcagtcaaaattgaagctcctgcatatgctaggcattggctgagggttgaaaagcttgttcctgtgccttcagagggagcgcagtatgatgaaggctaggggagcaggtccacttccagtgccacgcttatacgccaagtgcagtgggcgtagagaagcagcattcagaatatgtgaaatccagtatttcacctcctagatgaggggatgcggagttgagttttgaaggataagcagaatttaactgagtgaaatagaaagctcattgtctacgccatagttgctttggtttgtatggctaagcagtagtgttcaggtattttgctctcccaaaaatatttggatcacatgatacaaacagtgaagattctgtctgctctgggttaatt

SEQ ID NO: 119247 - DNA, 1786 bp, Homo sapiens
gggcttattatttactgtagatgttctcagctgaatgttgatgacatgggtgaactgtaactgaaaaattttatttttttgcttcacaaatgtgcagctagcagctcagccaggaataagaccccactaagttatgaaatgtgttagatgtcttgtttaactcaactagggatagaaaattttactgagtcagccttctgatcatagttagatcttatttatgagggtccaaatttagaaatgtgactgtaagttttagtcctgatgttcagagagaggttaggtggcttacccagggtctcatggctatgtaccagcagtcttctcgtcgcttcccaggctaatgacctctctgctaccctgtgcggattttgcatgattagtgtccactatgagatgacctactgcagcatcccaagattccccaggccaagagaatcctgagacctgcttctaggacctgctgtgctcagagtaactagggacccaatttgttgtttttaaaatgaaggaattgaactgcatgatctggagcccttcagagctaatattcagatataatgctgactctcccctgtgtggaaagtggtctaagcacatctgtctcatcggatgtaggctgcatttggaacatgttttccatacacggtaatgaggtgctagcatttctaataaagttttcactgttgtgcagggtagaaccagagagaccacctgtcaacagtgactttccaggccagtcagtgtctgtttcacacagacttagatgtatgaacctatgcagtgagataccctcgacactcataagatacagggcgataacctggtgacttaggagccccagtcagttcgtagtcttgatgatgcttaagcacattgacaaaggtgagaataagaggcaaaggccttgaactcttcagtgtccttgctgagaagtatgagtttctaagacatgtgcagaacaagaagtatgcagcctgagtgtgaccgtaactaaccctgcttgtgtttcaggcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtaagtaattcacctgtggaaagagtgaaaccatacggaaagaagtgtgtgcacacattctcatttccggaagcctgactgggttccggaagcattccagctgggtccagagcattccagtgattctcaggtggatctgcatgttggtattaagccttctacacagggctgacctttccgaagagaggcatgaagcagaagctgccctgttgagaatctagaggagttttggggttggaaatggcaggctgcacattcaccttagaaggtagttggctattccccaccttgcagaatacaatcacctttgaaagcctgtgcattcacttgacaatgaatatgttttgtgatcatttacaacggcagtaaataaaaagaggacttttgtcataatgacttattagttttaattgagaattaaaatgctttatttctagagtctatactaaaaaatagtcatggatcttgaagtttttattttatgtagtagctttttcaaaaatttaattttgctgtgtgcacttatctgtttttgtagaact

SEQ ID NO: 119248 - DNA, 1061 bp, Homo sapiens
tgagagccctttcgtttccaatccttttctttactagcaatggtttgttgtctttaaaaagactatgtttgaaaaaaaaacacagtcgcctgggcattgacacttgtcacaatacaagatgtctctggagttgttggataaggagaggacagccacagccttcctgcctctgactgcttggtgtctctcccccttgtcaaggaagtggcacatgggacataggacaagtaagagtgctcacaagcttctggcagatgaaggggccactgatcctatgtgaacaaacaacacctacgtgcaaggggaggaagggaactgtgagtgcctgtgcgcttgtacatgtgcactgaagtcggaatcttaaagtctaattctggtctttcaggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttct

SEQ ID NO: 119249 - DNA, 2888 bp, Homo sapiens
tatgcatttatcatttattcagcagagattgactgagtgcctttttttttttttttttgagatggagtctcggtctgtctcccaggctggagtgcagcggtgcaatcttgggtcactgcaacctctgcctcccgggttcaagtgattctcctacctcagcctcccgagtagctgggattacaggagcgcaccaccatgcccagctaatttttctatttttagtagaggtggggtttcaccatgttggccaggctggtctcgatttcctgacctcaggtgatccgtctgcctcagcctcccaaaatggtgggattacaggcatgagccaccatgcctaacctgactgagtgtcttctatgtatcaggcatggtgctaggtatttttcagccatgcacaaaacaagcaaagcatgcttgccctggtgaagcttatgttttcttgggggagagacagcaagcataaataagaaaataggagcatattagacagtggtaaatggtacagagacataccaagggaggggataggaatctgtgtttggggtgggagtgtagggtcaggtaagatctatcaaggacagcttctctgccaaggtggtttttgaacaaagaccgtaaagaggcagaagttcactctccaggttctggaggacaagcttactgcgtagagatgagatgaactgggtttgctggcagtgcagtgaggaggcctctgtgactgtagcagataagcaaagggagagggaactggggacgagctcttatcacaattccaggctttttagggactttcagctcctgctccgagtaaatggggagccagggaagggtgtccagccaaagaacaatgtgatctgccttaggttctaccgggcccctctggccactgtgctgggaacaatcacaatcatattatcacaatattccagggctaggctggtagcagcagaggcagaaggaacaggtcagattttgttatattctcgaggtagagccaatataatttgccagtgagtcagacacagggtgtgagagaaagacaggagtcaggggcactccagggcttttgaccactggacagtggcactgccctcagctgagatgggcagagttgcagtagacagagccgacttggaggatctacggagtgccgcattacaggtggcgctgggagtttcttttatgtccaaacataggtgcaggtgggcagtaaaatgcaggaggcccaaggacagggcagaggcccaggcgggaggtaaatttggtgtgatattgtgtttaaagccatgagactgaatgcgatcaatgagaggaaagacacgttgggtttgggccctgggcaccccagtttctggaggttgaggtaatgaagatggcagagcaggcgctgccgggtgttctggaagctggggagaaaccgagctgcgtttctccctgcagagagtggccagctccgacacatttgtcccatgtgtcagtggggtcttgtttcaacttgatgtttatctgttttctttgtagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtaacagctaagctgtgagcgaggcgtgctagcaaggagccactcgggggtgtctgctgtggctgctgtccctactttgcggtcagccgtttaacactggagcgctgctgaccatagccacgctgccactggtgtctggcatccacagcatagcacagggccctgctgggcagcagcaccctgggtcttaaagtcttcaactgtctccctctaggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattcactccgtgtgtttgtgtgtctgcacgggagatgtttcctaggatctgaaattgctgctctgggtctgggttatgttagtaggggcggcaatgaccacctagctcacccttgcttgggggaggtgttgcccaccccccacagccatggggaccccacgacttcattgtgggcagacagctgcccttgaggtcggtggtgtgactcttccttggcacaggaagatacatggtgcttctctgtctcctctactcagtagtggagtctcatcccacttctagggagagaatggggtgaaatggggtgctacagggaggtgcgggaagctcaattctaaaactaccgcaagctctccggaagcctgcatggaggtggggggagcaggtgaaccagatgagggtgacagcagtcccctgccctgtgggtgtttctgcttccctgaggactggtggatcacatg

SEQ ID NO: 119250 - DNA, 1877 bp, Homo sapiens
tctcagctcactgcaacctccgcctcccgggttcaagcgattctctttcctcagcttcccgagtagctgggttacaggtacgcaccaccaggcccagctcatttttgtgtgtttagtagagatggggttttgccatgttggccaggctgatctcgaactcctgacctcaggtgatcctcccgccttggcctcccaaagtgctgggattataggcgtgagctgctgcgcccagcctcggatagatcttttaagcagtaataagggtctggatggttgttaggctgagtttggggttgccccatttcctgaagtcagagcatacaggaatgatttgttttcattctgtttttgatttcagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcagtaagtcatacttgctcttattcactaaagaaataaaggtggccaggtagtgggggctggggcccagcaggaagcgtgtggctctaaatgccattatgccatacataggcttttgtaatttcttttcacctgccaatatgttttaaattctctgcatttcaataaggtggatctacttcacgcttttgaagtgtcttgtcagcatcttgtcaggcagctccttgatgcatggctgctcccttaaaggatccagcagttggtgaagttcgtttgatattcagagactgattcaacttagtgttttttgcttttttttttttgtttttttttttttgagacagaatctcgctctgtcgcccaggctggagtgtggtggcctgatctcggcttactgcaacctccgccttctgggttcaagtgattctcctgcctcagcctcccaagtagctgggattacaggtgcatgccaccatacatggctaatttttgtatttttagtagagacgggctttcgccatgttggccaggctggtctcgaactcctgagctcacacgatccacccgcctcggccccccaaagtgctgggattacaagtgtaagccacagtacctgaccttgacttagtttttaagctaggattaaatatagctaaagctaggaagttgtagtttaggttaagtcctcatatttatttgtaaattatgtatgtcaatcataaaattatagattttctgacttggtgcaatgaagaagtaggccgttggtgttcatcatttttgtagccaggcagttatgtcactctgtctatcctagtcttttagagattcctgccaaaaattctaccaagcagagatggaggagcttgactttatcagcgccgtagagaagtccagaaaacacataaacacctgggtagctgaaaagacagaaggtgaaaatgtattgttattctacttttgtaataacctcttaatccattttattgtcagttccttcacaagactgtcaattgtaaacaggaatgatttttttttctctgaataactgcaaacttaaaaaatctgcttctgaaatcagttgccattatttgacattttggaaatgctcaatgtgttctgttctctctgatttctccctgtttccttggtgtacccgtgatgcctttcagtgtttggtatacctcttctggatcaatccacgttttaattttgaggagggggttagtgtgttaatgttaatatagtttttcctttcacaagtaacataaaaaattcgcagtgtggatctcaagctgcctccctcttgggtagcacagtctacagttgccatgcattgctgtgggacactgggtcacgccctggtctatctgtg

SEQ ID NO: 119251 - DNA, 1057 bp, Homo sapiens
ctgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatcactctattttctttttcttttttgagacagagtcttgctctgttgcccaggctggagtgcaatggcacaatcttgactcactgcaacctccacctcccaggttcaagtgattctcctgcctcagcctcccaagtagctgggactacaggcacatgccaccatacccggataatttttgtattttttagtagagatggtgttttgccacattgaccaggctggtttcaaactcctgacctcaggtgatccccccacctcggccccccaaaatgctgggattacaggtgtgagccaccacaactggcgatcattccatattactctccagcttaagaggctccaagggctttctgtcaggcttagaataaaatcctc

SEQ ID NO: 119252 - DNA, 1695 bp, Homo sapiens
tagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaagttgaatctgggcctgttgcttaattttcttctttgtctttttaaatttacattaggactatgaagttttaatt

SEQ ID NO: 119253 - DNA, 1112 bp, Homo sapiens
gcctatttctttctcaagacggaaaaaccgagccccagaaaatggcgataagatggggatgcaggaaaaagctagctaatgaacagttcagcagtgggcaccgtgtgggaacctctcctaagccgccctccctctgatggatgcatgctcaagtgatttcgttggcccttaaaggaaagtgttattccatcctgtaatcctagcactttaaaaggaggccgaggtgggaggatcacctgaggtcaggagttcacgaccagcctggccaacatggtgaaaccccgtctctactaaaaaatacaaaaattggccgggtgtggtggcatatgcctatagtcccagctacttgggaggctgaggcaggagaatcacttgaacccgggaggtggaggttgcagtgaggtgagatcgtgccattgcactccagcctggccacagagcgagactccatctcaaaaaaaaaaaaaaaaaaagacatctgcccaagggtcatagctgtagaggggcagatgtggtttgaacccagggcgtctggttcctctctggaagcaaccaaagtgcctgtgattggggtagtgacaaagcactctgagccgctgcatggcagatgctgtgaagagtcatctttgcctgtcccatatctattcccattttttctgattgtaacaccttgtttttttgtgtgtggtgggggaaccatgccctttcaaccaagctatgtggtgttcataagggtagcccctcctccgaccccaggagtggcagttcacagccctgactgatcacagtgttccgtggcctagctgtaaccaccccagggagtgagactgaactcaggggttcattggacctatcaggaaagagagacctttcttgtttctggacttggagctgtgatgaagtaagtgggtcaggggccaacacatagacagcgttggcctacaaatgcagcccaggcagaggacggtgcagccaagccacacagagagacaacttcctagtgacacgctgtgaactcctgcatccacccctgcctgaactggagcttttcctcttcagctcttcagttatgtgaggcaagatgttgccttttttgcttaatgctgtgagtt

SEQ ID NO: 119254 - DNA, 1001 bp, Homo sapiens
agcaacttgtttattgtggtggtggtggttgtggggtgaggggttggggatatgcttgggcattttccttcatttttatgatcttagtaacacatttaaaagtgcacttgctgtgatttacttggcatctagaagtgttgctgcaggagagcttttcagatgtcttgtctgccacagaacaggaagtgaaagtctctgcatggtttttgacctcacccagacacgacacaagaatctctgacccacaaaacatgagatccttgttgagccggggaccccgccttaggtttctggtgtcgcttcttaaaaatggcctttgttcagtgctgcttcaattccccgaagggttccttccagcagtggagcagagcacaagctttggaaaaggccgcctggtttttagtttgcgtgctgcctcttgtaggggtggagcctggtcaagtgacttgagctctgtaagtttcggttcaccatctgtaacatgaagataacaaaaccttcttacagattgtcagctcaggctgcgagacatcaacagaggacataccttccatccatgattcaagagttcagatgacacacacttggattctgggcagctttactctcaatacattctcatcaaacacatcactggctgcatcgacgttccagcgcatcagcccactttatgggaagaaagaaatggggagagatgagcagaaatcagacttcttagcagacacaacccgaggcagggtcagcacctgggccgtcaggatcccagacaggatttcaagctcctcctgggattctagtggggaaggtttctcctgacaggactgaggacacactggcaccttgcgtatcagctggggcagctatggaagctagactccctttctttcatagatggggaaagtgaggcccgaagaggtgggggagcttgttcaggggtactcagctgctggcagagctgggcctggatgcaggactgcatcagcctcttctgcctctgtcac

SEQ ID NO: 119255 - DNA, 1028 bp, Homo sapiens
atggagtttctgttttgccacgaagctttttgccagcccttttcccaaagtgtttgtaccattttatactcccaccagtgatgtttgagaggtctggttgcttcacatgtttgccagtgtttggtgtattagtctttttagttttggatatcctggtagttgtgtagtggtgtctccttgtggttctccatgggtttttattctatatttcagtttggggaaaatgaatgaatggaagaaaagaagggaggaaggatgaagcaaatagctgtgctttgagatctgacactgtatacttcacagccctgatggacattctccaaattctactcctttttcacattttcttcttagagtttgcattgttctttttatattcttcagattccttcttttgttcataattacttaaacctattcattttctaatgcctttcagttgttaatttactgaagttctttggtgcttactagtgctgcttgctgtagctgcagggtctgtctcacagtgaattttttcttttgtgttttataattttggaaagggagctcatgttaaatttgtatttgtaggaattctgtctggcctggcttgaggttgttgtttgctttagcctataacctcaggatggcatcagcctgtgaccacttcctgtgtaaaagttcatagtttaggcgatcctctcaattcaaagtctgtatctatttcaagacaggcccaaggttataaatttgcacaaactttttttttttttttttaataccttgtgcccagtccaagacaaatatgtttgtttgccatgggctgctttttttctagttcatcctttcatcaaagggttgcacattgagcagtgccgtgttaaggggggattcttcattctaccttcttttcttgtattccttgacctcagctgggctttaaaccttgacttctggatggcgaggttggcactcccctgtgtgagctactgcctgcctccggtgctctgtttctgtccctagagttcttttcctttccacggagt

SEQ ID NO: 119256 - DNA, 1067 bp, Homo sapiens
gcattgttcatgtccttaatgtaaacttagtatgatgtcgtgtgagtatcccacagaaactgcttgctcgtatatttattcatccattcattcaacaagcattccaggtacaatcctaggttctaaagatacagtcctaaataatatatatttttgttctcaaggagcttaattttatagtattttatgcattaccaaattattgtgggatttttgtttttacactaacaaaatacaacacgaataccctctgcccccccccgaatgaaatctttcttgtttcccagtgacagcagtactgtggtgcacctgctggaaggaaacctggtaaccttctcctcaggctcagatcccaccaccctttcatgaaacagttgctttggcctatttgataacctttccatttcatagacttaatatcacttgttttagatgagtactccgctttctgtaaaaggaaggataattttggaaatcattgaaggaatgtgctacttacatggaaaaggcgtgatacacaaggacctgaagcctgaaaatatccttgttgataatgacttccacattaaggtaaaccatcatcggtaggcttccagaaagttgggtgattttagttttaattctccaatgtaaatccattctcgtacattggagaagctaaaggaagacctagctcagcttataactgttgatgatggtgccgaaaggctctaccggtgattgagaggaaggctgcaggcttgatgggatcaggagataactgtcaggataactcatatcttttgggggaggagtggagttgaatggggtagatgagaagacctctttcctagactgtgttttttcctctgttagaaacatttagaaacattcaagggttgcccttttcatcctggaatgggccattggtgtcataatgttctccaggaaatctgtgtcaccaagactctcctcctctggaaatgcaggggaatgtgaaggtgtgtgcggaaaatccttagagttcagatatggcctaagagtgagatcagcggccgggtgcagtggcccacgcctgttatctcagc

SEQ ID NO: 119257 - DNA, 1138 bp, Homo sapiens
ttttatatttgtattcgattgtttacttctgtctgtattttaaaaatcagtttcctttgaacacattctttccattgtcgtaaagggaacaagggaaagggatttttcttttgttcattcaagggcaggatttagctagggggagtgtcatatctaattggcttctgcagcaggaatccaagcacaagaatccaaaaggggaagcggaaggggaagcagccctgggggaggcacccaggagctgctgacacaggggcctctcatcaccagcaggttctgcgtctagcgctttgtcctagtcttggacaaagggctgggaataaaaattccttattcataacctatcttcaaattcatgacttccctcttatgtcgtgggttagaatctgtgaattttaggtactcatgtgccacagttcatccccacatgcttgcttggattcctggaggcagaagtggaactggcacctatattctcttctgaactgtgctgccctgtcattttgccctgccagcactgttcttgttctgtgtctgaccttgctatttttctctctgcttttttgtctgtttttctcctcctttccaccctatctcctcttaggttcaggctacagctcaaaacaagcaacactgcagtccttatcctcagtgtgtctttgggatccttggacacttgcatccatgggcctctggacgccatttggggaaatagaaggtgtagtatttagccactgtctgctgcataaatgtgcagagaagaaaataaccattttccccccaagccctagaaatagttgaaaaacatacgcagagtcaatggggaatgagaataaatatgtttggttgttactgttcttgtcagaaacatcttccgcttttcccctcccccttactgcataaggaatacgataccagaatttcatgtgaacgtttcctgggcgacattttacaaatggctgaggagacacacagtttctatgagtctgttgagaagtcgctgttttgaacctgcccagtgcaaccatttctggaaaatttaccgtaccttatgtataatggataagcccaaaattgaaagtcagatctgatttgcttacggccttcaccaaacaatcccagtggctcaatgtctttc

SEQ ID NO: 119258 - DNA, 1033 bp, Homo sapiens
tgcactccagcctgggcaacagagtgagattgtgtctcgaaaaaaaaaaaaaaattccactggctgggcacagtggctcacgcctgtaattccagcactttgggaggccgaggtgggaagatcacgaggtcaggagattgagaccatcctggctaacacggtgaaaccccgtctctactaaaaatacaaaaaaaaaaaaaaaaaagctgggcatagtggcgtgcgcctgtaatcccagctacttgggagggtgaggcaggagaatcacttgaacccgggaggcagaggttgcagtaagccgagattgcaccactgcactccagcctgggtgacagagcgagactgtcgcaaaaaaaaaaaaaaaaaaaaaaaaattccaaaactcttcccactttgtgacgtgcagttctccaggcactggagctataactgaacaaacagcctgagtcccttccctcacacagtttaaatcctagtggacagaaggcagaccctaaaccaatatttaatgtgtcattttttatcttttttctacatgagcaacccaaatacacccgtttagtgccagaaatctctttgtgttttcacctcgttctggttcctggttctgccagtgacagatgtacagggatgcagcttcttcagggttctgagatgctttcagtgggaaaggggcgcttggatctacaatagataatagaattttctgtgtttctgctcccaaagatgatcctgccaggtactaagctagtaaatgaacacgctgagtttctccttgcaaatttaaataagtcttctgcttgcttttatcatcaaaaagtcctaactctataccaaaatatgagttttctaatttgccataccatagaagaagggtgtgtatgcagtaagtacaaaaggaaaataaatgtcttcctttcagtgaaagagctcttagacccactgctttttattcactgtgctgcttgaagtgaggttagaaaaggaaagctcactgggctaagagtcaggagacccaggtctagtcctgctt

SEQ ID NO: 119259 - DNA, 1027 bp, Homo sapiens
atatggtaattctatctttaatttttttgaagaatcacgatttttttttttttttttttttgagacagactctcactctatcaccaggctggagtgcagtggcacgatcttggctcactctgcaagctccgcctcctgggttcaagtgattctcctgcctcagcctcctgagtagctgggattacaggcacccaccaccacgcctggctaatttttgtatttttagtagagaaggggtttcaccatgttggccaggctggtcttgaactcctgacctcaggtgatcacctgcatcagcctcccaaagtgctgggattacaggtgtgagccaccgcacctggcccactatactctttataggagcagctgcaccatttcacattcccaccagcagtgcacaagggcttcattttttccacatctttgtcaatatgtgttatttctttttttttttttaatcataggcatcctaatgggtatgaggtggtttagccagatttgaaagaagaaaagtttaaagggtggcataggataattaacttaatgtttggcataaagccctgcttttttgccatgctgtatttttttctcttgcttttgatctagaattacttacctgtgtgtttctctctatgcagatgaatctataaaatataccatatacaatagtactggcattcagattggagcctacaattatatggagattggtgggacgagttcatcactactagacagcacaaatacgaacttcaaagaagagccagctgctaagtaccaagctatctttggtaagataccctggaaggactcaacgcctagcaaccttgaactttcttacttgtgagaaggacatagtggaatcttaaaatttctctgataattcttcttgaaagttttcttatgttacttctgcaaaatatctttgtaatttccatataattcctttgtcatttatttatttttaatatggagataatcacagtatttaatttatggatttgttgtgaaaattaaatgagttgat

SEQ ID NO: 119260 - DNA, 1074 bp, Homo sapiens
ctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggtaggtctctgagggaagggccaggggaggaagggtggctgggcctgtcttcatttattttgtttaaattttgttgttatatttttctacaaaataataccatgtgattgctatagaaaaccccaagagttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctcagcctcctgagtagctgggat

SEQ ID NO: 119261 - DNA, 1273 bp, Homo sapiens
gatagtgccacagtagttacaccattttatggtccgggcagcaaatatcttggagtaatattaattctttacctttaattttccagtcattccattcttttttcttggcggcctctctaagatgtaatctttgtccattttccctgccaaacgcatgtccagaccctctctgattcacccgcggactcacacaacctccccatgacgctgttctctgacagcctggctcttgccagttcttcccacagttgctttaccagataccctgcttcactccatccagcagagctcagggtcccctctctgatctacagaactgttctcaaggtccttgctcaggcatgcatatgcacacacgtgcacacgcatacacacgtatgctgtatttgtcatatttaagtacttggtctccattgattctagttccttgagctttttatccaaccagaagatgtagttccctcctaattcaaacccataccgtatgctcaggtttttgtgacaatttccactaaaagtaattaagagaaaacatgatgtcatcaaatggtggactctagggtttttcttttctgactaattgatactccagcctcacacctgtattgattctgataattagtgattcagtttcttttaacagagaggagcaataacccgtgccgtgcattttgtcgtatgatcataggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggtaggttctgcgaaggggagatgccgggacggcagatccttcccctctctccgcatctcatctcttattgtgggatatgttgacaagacacatctctcgtgcttctagttctcaactctcaggtaggaagaataacgagttctcagaaaagtaatgcagtttaaccagtctgagttttaaagctttctgtttccaggagtgaaacttccatggctcaggaaaaggctaagtaaaatcactatttctatttactactactgataatgaacttcagggaaggagggggtggtgtgaagtgttattaataatctcatttaaaatactgtgaggccaggcacagtggctcatgcctgtaatcccagcactttgggagctcaaggcagaaggatcgcttgagcccaggaggtcgaggctgcagtgagccatgattg

SEQ ID NO: 119262 - DNA, 1061 bp, Homo sapiens
ggggtttctccatgttggtcaggctggtttcgaattcccgacctcaggtgatccacctgccttggcctcccaaagtgctgggattaccagcgtgagcccccacgcccagcctgaggtctttacaggcactggaataggggccagtgaacttcagcctgtgcattacacctagcctgcctcccacttttgtgcagcccacgtaccaatcgaggtggctagtgctgtgagtcacagagaccaagctggggtgtccctttaccacccagcattgctgccccagacctgcactggtggtcactacacaggggtgactgttggcaatgagcaggcacccagccatggaatttcagtcagcaactcaggagttgcttagcctccagcaagctgccccattgagatgaccaggctcttgggaggaaagaagggtgcaccaggatctaggggttgctaggacaagaagtgaaactgacctgcgttaccctactacccccacctgccagcctggcccaccaggaccctcttcctcaggccactagctttttgtccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagctcttacggtgagtctgatgtggttgccagtcctgtctgtgctcctgcttgtccttattttgctcctgcctggtatccatcttgtgcacagtaggccattccgctctgtgaagggtctgtcccctcccgcggcctctaggacaggctgccttgagttcttcctccctctcctgtatccttaaattctctccactgg

SEQ ID NO: 119263 - DNA, 1066 bp, Homo sapiens
tccgggaagatttgcatttgttgctcttgggaaccacaggatcataccaggttggggccatttttagctcagcttgatccaggagtctcaggttgggccccggcctgcctgcgaacactgcgtctccacccagagcaggcctgcctttggagctggcttacttcctttgctgtattttcagggttctgtttctcatgtgcagacacactcatacacactcacaccccggtttccattaaccactgcaacttcagcaatgccacagaattctgttttgtgaaagatctagttattcccctgcaagaaggcctttcagagggtatggtctgccatacggccaaaagtagaagcatgtgcagggacgttttgctagccatcttcacactgtcttgcttgcttctctctcccttaccctccgcccccaaatgttttcttcttcctacatcttctccccacctcttcaggctgtctccacgtacctcattcaagtcttttcattcttgtgcagagcagttcatcctcttcagcctttatcttcagctcacacggggcctacctctgaatatttaagccagtcagcagaagcaaaggcaggcaccaggcactgtcctgtaatgggggatccgccctcctcagaaggcagttgtgattgtaaatagcagtttttcctccatttggtgatttgaattcactaagcacacagtgagtgcctgccaggtgcctgacgttgtccgggactctgtagagattgttgctcatgtgagttcatgccattagtgttatatttcttccatgtgtaacgtgtagctctcaggaagcaatatttaatatgctcaagagcattagaatctttacttatcacagtgtatttaaagaaatatagaaaacattggcctaaggaattgcatttgttgattcatgttaatggttgtttttagctattcttccctactagtgaatcatctataatacagtttgaagtttggtacttagccttttacacccatatttcttcggtagcagaaattagaatgaataatttgtgtgcatttttcaatgtccatac

SEQ ID NO: 119264 - DNA, 1096 bp, Homo sapiens
agaagtgatatgccatgttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccctgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctatctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagccagataggctggactgtctacagagaaagacttcacatgtggcaggctggggattccctgcctcccagtccagctt

SEQ ID NO: 119265 - DNA, 1050 bp, Homo sapiens
aaagtctctttcctctttctgtctttcaatttgatcatttatattttcatgtctttaacttcacttttctccagtgtccagtactctgttaggaccatctagcaaaattttcatttcagatattgtgttttcagctctagaattttttttttttttttttttttttttttaagatggagtctcactcactctgttgcccaggctggagtacagtagcataatctcggctcactgcaaccttcacctcctgagttcaagtgattcttctgcctcagcctcctgagtagctgggattacaggcgtgtgccaccacgcctggctaatttttgtatttttagtagagatggggtttccccatgttggccaggctggtcttgaactcctgacctcaagtgatccaccagcctgggcctcccaaagtgctataattacaggtgtgagccactgcgcccggtctcagctctagaattttcatcttttttatttttagttgagatataattaacataccataatattgattatttttatgtctaccatttatctcctcattgtgttcaagttttactttgaattctttagtatatttatgttagctgtttaaaaatttttgtctgataattacatttttcccccatcatttctggttgtttttctactgacttgatttttctcctgattatgggtcagattttcctactttttggcatgtctagcatctttggattgaatggtggacgttttgaatgtttcattgttgaacatctgaatgttgttgtcttcttttaacgagcattgaacttggttcttgcaggcagttaatttactgcacgcatagttttatcagtatgatccttctgtggctcatttttaagctctgctagagtggatctaccgtcatctctatgctagcactactttacttacattcttgagggctgatctctctgtggtttctaatgaatgtcctgggtgttcattaagatagccccacgtaactgccagagctcaaatgtctgcagcattgtgcaagctacaactacccaggag

SEQ ID NO: 119266 - DNA, 1048 bp, Homo sapiens
cagctgctcttcccctattctcacagtttcttatcttgcctctgcatatcagttgtcagctgaagacccaagaggacctctctgctgacctccaagctctctctgtgaagtttcttccacttctgtattctgctctgtgtttctagctaactcgagttctcagaattctaacttggactttgaattctgatttctgtattttcaactcaatgagaccaccaaactctgtctgggtttctccctccctgcactgcagcatggaaaatacctccagatagtaaactggggaaattatatggctacctcatttgtttcccttttctctggagtcactgtcattcattgcctgatgtccaatgtctgctgtcttccacctatcccgaaattgggtcatttctaaagtctcctgagtctcatagttcctactgtcatgtttctatctcatcatccttttgcttcaacaaatatctgctgagtacctactatgtgcctgacacagtgctaaggatacgaatgtggataaacacgctccagcctccaggggttccaagccagcgggggagagagacagaagctcaggtaagcacaggcagcctgcgcacgcactgtgcacagaaaactcactcatgttggctggaaatcagggtcactttcatacaggaagcaacatggacatcccctaaactagcaagtctaatggaattcacatattaataagaatccgggttcttgtaggtggatggactcaaaccatggttcttgaaacagccaagatgtgttattactgaaaatgcagctggataatgagggctgtctccttcatggagctcatgcttctctctgtcatcattagcctggcctcctttcttgtttgtttgttttcctcttcccctagcaatgttgacaggtctctctctgggaggaagacagtatggctgttgcctggtgttgatccctagctcttcctcccacaggagacaccagattagagctttccattcctctgctgaaagaggaggctgccaggagcctttctgcattcttgacc

SEQ ID NO: 119267 - DNA, 1036 bp, Homo sapiens
gctggagggaaagtcagcgccacagaacatgttagatgcccatgttcagaagtggctgaaaatctggaaggacagctgagagaggcgagccttgaggggttaagacgggaagatacaagcgttcagcaggtccgatcattcaaagataagtctctgaagagcaaactatacctaagggaggcagaatgtatagaagcatccttacgacttctgctttcgtgtgaacctctaggtagacaggcatgatttgaggatcttggtttgcaggaaaggggaaaggaatccacatttaccaagtgactgctatgtgctaggcatgttaccatcgtccatagcgtctggtggaaaaagagctcaactatgtcatttattaactttgggagcttttaacaagctacttcctctctctaaatccctctataaaatagagttctctgtatctgcttgtacaggggataaaatgatattaagatatgtagtgataagaaagtaataatagtcagtatatgttgaacacgtgccgtttgttgcatgtttatctaatttaatcctcacaagaatactgtgtagtttgggtgcttctgattgtgcctgaaatcaattcaaaacttgcttacaaaagcggtaagggtgggaaatcattggctcatgtaattgaaaagtccacgggtagttctttcaggttctgggagcctctaatgatgtcatcagaactttctctttcttcattactctcttggctttgtagtcctcagttttgtctttattctttggcaagatctccccagatggtggcaactttaggcctgtatcaccctattgctagagaaaaatccatagctgggcatggtggcatgtacctatagtcccagctgctcaggaggctgaggcaagaggatcacttgagcccaggagttcgaggccagcctgggcaacgtagcaagaccctatctcaaaaaaataaatataaaaagactggcaaggactgtgtcaggtacccatccctgaatcagtcctgtggtcaggggaagaggga

SEQ ID NO: 119268 - DNA, 1284 bp, Homo sapiens
tggattcggttaggtctggaccattcggccagatcttcagaccagacaatttcgtgtttggtgagtgcctggtgtggctgagagcatgagggattcattttacgctgggcagtggaggctgaagaggtgtgattgccagagggaaagcatgaagaacatccgcggtgtgccaacttagctttaatatagtgtaaaattgtttgcctttcagctgctaagagcttggtgtcctggccttccttatttataattatattcatgaacaaatattttaacgtttggccattttggtgataatctgaaatagtcttatctgagcattgactcactgatctatattgaggggtttgaggtaaggtatttagtacaatcaccggtgacttaagatttctctttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactgcattgacaacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagtt

SEQ ID NO: 119269 - DNA, 1528 bp, Homo sapiens
ccctcccacctgccggcactggagcacctgacggcttctccacatgctccagtcctccatcgttcccatccggtgccagctctgcccccaccccggtcaggacgcgctggtggccctcgcctcgccgccctctcaccctccttttcttcactgttcccccatatccccatacccagacccccaccacagccccagacaatgcgcacgcccccaccatactcccggtagcccccacccctctcccggtcggcacgcccgctctgattggccgcgggccggtggtccagccccccggacggtccctagggctcggagcattacgtcagccgggcctggagagcgccagcgcgaaggggactggggggctcgggctgggggcgcggcctgtgccggccgccccaccctccttgcataaaagccggagcccgcggggccggcgctctcagcccgtcggttcccgagcgccttcccggtgaccccgcagtgggtgtgtgaggggaggacggacagacccagacgccgccggaccaggaggacgctgacgaggcaccatgcgtgagatcgtgcacatccaggcgggccagtgcggcaaccagatcggcgccaaggtgggcgcgccgcagcggagggggtccaatgggggcgcgaacctgggccgagagcccctcggggtccccaggcgcggtcctgggaaggcctggggatcgccaaatgcagaccttcctggccgctttgtgccgccgagtgtggcctgggctaggaggtgactttcgcggacggagggggcacctctctttctttctgctgtaactcatttggagtccccgtcaccccctcggcctccctccgcgctggctgcttggcaggcacgcgtgcctggagaagacgagggtgtgtccgcgaggctgtgcgcggcgctccgcgcgaggggctgggacaccaggaggattaattgtactcgcttgaaccggagtcgagctgccgggggaggggaggagagcgattgtcttgcggtctcaggacgtgctttgaatctaaaaccgcggtcctttagctcctttgcgttcctctttccccgcccacccgctcctggcgggctgcagtccctgtgccctcgcctcctgccgcagcctggggctgcgaccagtgcgccaagctccgccactgcccggctttggctggtccttaccccctcgacccctacctccccccgcgagcggcagctgtttgcctgggaaacgcccagtttcaactttctgaacctgcaaaatacaagccccgcggctgtgcccgggtcacgacgccctttaaagcttcaagctcctgaaatgttgggttgtcggaactgagtcggggacatttcattgtgagccttggcgtttctgggggcatcgttcatggctaaatgcagcctttctgtctcagttttgggaggtcatcagtgatgagcatgggattgaccccactggcagttaccatggagacagtgatttgcagctggagagaatcaatgtttactacaatgaag

SEQ ID NO: 119270 - DNA, 1035 bp, Homo sapiens
actcgctgaccctgaggagcccacaggggctggagcagcatgctccctcacaggctgagatgaggagattaggcatcctgcctctgagccagctgctgtggggcacgaggcaccagtgcacaggtgccccgactgtgagtcactttcttcttgctgtagccttaatgatcttgtttgcttcccttttggttgtggtgttgcccttcagcatgctttggagtttgagacactaaaacgagcctttcgtgtgaaactggtcctagaacttagtagcactgtggttccagcttcatctttcccaactccgctgacctcatatgcgacatggggtccacctacttggttgttgacggacgccacccctctttccctcggcacctgtgcctgtcctctctgaacctgccactgccatcgtcgtgaagaatcagaagcccggaagccagaagtgtggctggcctgcggggggtggagaagctgcagtgtgccctttgcttttcttttaggactccatccccgtgtctacctccctccttggagacacttccgacacgacctctactggccttgcccagcgcctaggtatgtacccacagctggcgctgcatggccagccaggtggggcccactctttaatggaaccatgaagcaagtcccttcggaagtaaagcatctttatgctaagaaccatcacctcattgctgctgggaagcacagacctttgcacgttgggtcttatttaaggggcacattccatgctcgcctgtcatcaccaccgtcccagggctggcctgttcccaaaggactcccacctcgtccttgggtgtgtccttgagtccatgagctgatttagttgccttccgtaagtgcatcaccacctcctgggaggagagcatgagaagtgcccacagcccctgtgggtggtggctcaaggtagcctcccgggccttaggaggagtcagtgcagctggtggagcaggtgtcacctctgtgcaggaaggactgtcctcactcagtgtgataccgttcagggctcgg

SEQ ID NO: 119271 - DNA, 1108 bp, Homo sapiens
caaagtgctgggattatgggcgtgagccaccgctcccggccattttttgtgtttaaatttttttttttttttttaaatcaaaacaccagaaacccctctgtgtagggcagaggttcttaagcagtgcggggcacctgcaggatctgttccagcagacagctggccccaaatcctggctttctgggtcaggagggctgggtggggcccagcagctgcctctcgaacaagttccagggaggctgctgaggtggggcctgcccttcagaaccctgggtctggtggagagactgggagaggcctgagtgactcgtctgcatttgcagcacctgtctgaagagaggcatggagattagagctttcttttctccctacaaccccatcctctttctgagcatttcccagctgcacgtggctgtgaggaacacggggcctgcagtatttcaggagtggctgtatcaatgtgttttctctttttagccaggaagaccaacaaacaggtgtttgtcagctataaccttcagaacacagacagtaacttcgcattacttgtagaaaacaggatcaaggaagagatggaggctttccccgaaaagttctagctgagtggcagaagtgagaatttgtaaacttatgtacaatgtacgtgtaaataaatggattgaatttcagtttgtcatcaggccgcgctcccgttttgtttttaaggggttaatcttttgagcttccttctcagcagtgtgtgggccaaaaggctcatactgacccacctggtgaaggagaggcaaagtgggcagtatatacttcctcatttggctgtgagtgatagagggatgaaatgggatttttgttgggattgaagactgtaatctaagagtttcaatcagacatgactgtgacgtgcatcctcaattagaattaaagtgatgtataaatatgctttagatttgtgtgtgcattcctcagaattctgccttgtgaattgatgcatttatctcctcattgcagtgaaaccccagggcacgtctcttcttgctgtgttctccctaaacccctcctctgggcactccttttttgctgtgttctctcttgggcctacatttgagcacct

SEQ ID NO: 119272 - DNA, 1066 bp, Homo sapiens
caaatataggagggaaatgaatcagtgtaattaggatttgagaaaacaagctattcccagacaatattttaacgtgaaagaagcagagtgtgatgacttaattagggaaatgccacaaacaaattgtactgtaagcctaagagcattaacctgctaacgagtgaggtctggggaaatctgggaaagccatctggaccgtccaaaacgagcaagcatggccccgctggagaaacctggattgagtactcactactcagcgcagggaagtttgtatctatccagagctctccctcatgttagagcagcgtggcaaagccacccctgctggactttgcacccctgctggacaagtcctcgctcaacttcttagcagctgtgtgacctctggaagctgcttagcctctctgtgctcccgtttcctcatcggcaaacggggctaattatagtgcctctctcataggctgtcatggagaaataatacacgtgaagcacttgggggctaaatattaaatatgaattaatatttgcaaatcacttagaaaaggagctgaaatgtgagtgccatgtgagtgtcatcgtgtttctcgtcactgtccctggataaaaagggaccacagatgcaccagcactcagcacccttcatgtcaaccagacctggctcatgtccttcttctgtccagcgaagcaaaagcttcaggcgtccctgggtaggccccaccccacccagcacgtggtccagcctgggtgacctgactctcacggccctgcacaagttgaggcagagggtgacatcctggctgagctacggcagcaccaaggagcttctagtgacctagtgtccccgatcttctgaactgggagtctaacgagaggcctgtccaggtaccaagggcttctctgatttggggttcccgtgcatcccttcccatcgtaaatggatacctgcagggcacattctcccacctcactcaggcccctgcacctgtgcccctggagcaaagcttccgcagccactctgactgtagtccctccctgccaccctctatcccacagccctgctgtttca

SEQ ID NO: 119273 - DNA, 1050 bp, Homo sapiens
gatttatgctccagcaagtggagccaagataggcgagcgatgtcattgcacgagctgcctggggatgcttataatatgttgagccttctgggccatggcaggatcggctgggctttaggtgaaggaagagctgcggcagctggtggccagagaatgggagggtgcgctcgcctggtcctctcgtgtggtttgcagagtcaaacttgagcacttagttgtgaagcaggagcggcagaagaaagagcccttgtgagtgtttttcacctgaaagtagacgccgtcaaagcgctgggtgattgcactgatggacgcagatgcctgaagagaaatgcatctttagtcattttgctcaggcattgattgtcactcggtaaagagcagcagggatttagcgctcatctagaaggaagtcataccgactgatccttcttccagaagaaacatgaaatccttccagggtcacagccaacaacgaggggttggcggggaagatgcaagatccaaaccacaagaagaagggagtatctaggagcatctaggaggaattctgcttagatgcgctaggaagataggtggcaggaggtgccagaatggaagagggagctgggtgcaagagctgctgctctgaaattgtgcacactgcggaaaggtgccccttccaggtggccacagcctgcactgggcacatggcttaatgacagagctccttcctcagctgggagcccttgtgcaagacacagcctggtcttgtgtttggaggtccaggtctacgttacgttagaacatcctagaaaaccgcagcatggaagatcaggaaggtaatacgtgggacagggtgacatcaagtttcctgcgcgggaattcactattgaggaatgacaagggagggagaaggctgttggagaggctgccatgtggtgtttatctcaagtggcttggaagaagtcacagggagtaaggacttctggagatagtggagatgtgagcgccactctcccaaaacgttggtgcatgccatcaccattcctcatcaggtaaattaagggtact

SEQ ID NO: 119274 - DNA, 1039 bp, Homo sapiens
aattctggtgtgtcagcgggttcttccttgccatatagtcatttttataggtttaagtaaaaataggaactggtgcacagcctaaacaagctgcataacgaacccaccttcctggcaactcacatcttggaaagaggacgccgctgcctggcctgattggacttcctctcctgtttggcatctctactaatcttggctgtctttcctcactcatactgttcttgcccacccccatccctttcacagctaatgattccccattctattggatttgtgtgtgtgtgtgcataacttattgcattggaggatttgttttaatttccctgaaatcttacaaattaaattgcccatccttaactttttcagtttttcatcactctgacccactttatgttgaaatgtggccaatttgacagaagcgaaagccccttctaaggcagtacttctgaatcttatgaatatttttgggtcagagacccccttccagaatttgatggcagctacgggtccttcccctggaaaagcgcatatctcttacacacacatgcacacatgcatagagtttcacataaagttacagaggcctcccgtatccctgaacacattcatggatcccaggttgaaaattacatggccaaggagcagctcgggttgagcatggggtgcaagggcctcgcggggaagcctggcctacatccttgccagcactgggaccatgtggaagagcagggtgtgaggggctggagaggggaacgtatccccaagatgcagatgccatcaagccctttgtcatgtaggaccaaggattcaaataaaccttctgtttccagaaagcagcatttgtccaaaagggtgggaagtgagtggttgtgacttcccagcccaaggccaccctcctttgctctctgccttcagtcaccttgaccttgctcaagtccagtgatgggtgctgggtctctcggtccgctggtgaagacgcagagagatggacatttctgaatgaggctgagacagcagagaggactcagtgttcaggaaa

SEQ ID NO: 119275 - DNA, 1097 bp, Homo sapiens
tgatgtaaggattgatgctgggtggctgaaagtctttggaaatttaggagaagggaaagaacggcatgaactttgaaagataggaaagtctccctatggaaggaaggactcgagagggaggtatttagttgggcagaaggacaagaaggcacattctggggtgaaagaggcacagagctactgaaatgggagctacaggatgtcggtgggggcaggcagagggaaggtgcgaggtgaggggcggtagggactataacccagctcagaaaggtcaacttcagaggaggacagtgggaaggtttgctttgctccgtgatatagagttggtttcctttggctggggcacagcaatgggcagatgcgttgctcaaatcagacgttgaaatgaagaaggaggaggaggcagctgggtgtccagtcttcagtctggtttcccgctaatggacagagctctgcaatgactgcacaataaaccttttattctgaagccagcattggtatttactgatatgctcttactggcacaattgtttaataaaatctgcacgatctttattgcctgaaaagcaatgtgtttttccaaagaaatgtatatggccataaaatattcaaaaatgaaatatggaagaggcttcctaatgccttctagaaatagaattgaaatacacatggcaccaaatgaatttatttctactattaaaattcctaatttaccaactacttaaaaggcaacttcaagtaagcagaataggcgtgtgttttcctctgaggggaatattttaataagaatagagacagttgatagatagatatttgtacctggatcttttcattctgctccattaaaccagaaattggtctttgccagtagtgaccaagtatatgtgtccaaagcaagatgattaactggaagggggccaattgcagaagtgcttatcctgtcatatttaatacccaccttatatattcaacacagatatacacattagaggctttaaatcccctctgtggtgagagagactatacacaaagctgtaaattacatctgctgaaaataggttgagcagtttctccccagaactcatatccctgcccac

SEQ ID NO: 119276 - DNA, 1317 bp, Homo sapiens
agcagagcagcatccttgaagagctctaagtacaagtggaggatccacctccactgagttattccccttatgttaaagtggacccccttgtcatcgtgacatcagggtaagtgaggcggaacattgcagggaaagagcatgggcctggggcagacagatgggaatctgggtcactcatagtcttctcattctttaagcagggtgcatgcctgtctcacaaaatcattgtgaggggtgtgtcttgctcatggtggcagcaaatgagtctgaaaggagcgtggctgagggaggccaagaggatgctgataagaaaaggaactagggactttactgtgcactgccaggcattgttctagctcttttctcctgattccattctcaccataagcctgtaagaaataaattccactactgtccccctcgcacagatggtaaatggagcagagagaaggcagggcgctgggccaggcttgcttggctggaaggctgtagagctgggattgggagcacagcgtgtctggctggagagtccccactcttctctgcgacatggtttatcacagtggctgtgctgatattttaagcctggctgttgttaatttttattggggactggtcctgaaacgcctcaccactgaggctactcagtcagccccattctgctgtcctgtagttagttgatcctgcccaacctatggcagaatagacaaaaggtgtcctagggaaaggtccccaaaaagatcagagtataaagttgaagatggctgagcccccactgtactacagtgctgtggttaatgggcagatggacctcactaaggcaggcttctcttcctcacctccccacagagaggccccagcaggctggggagatgtggtgtccccatgcctggcagagagatagccacgggaagggacttcagttagtccttttgatggttctcgggctctgatgaaggagacacagaaagtggcctagagacatcagccattcccctaaggacacaaagcacccaggacgtggtgtcagtgccttcacatacgaggcatctctgaagcagtttcaaaaagttgaagagatttcaaaatgcccatgaggttaggcagattcctgtgactggtcctgaccaatgagctgcgagtggaagtgacctgtcacttctgggctggagcattcagttacctgtaagagacctgctaggcctcctggatgccggccagcagcattcacaatggtagctgctccgtcagcctgcatccccacgtgacaatgacaagcagagacccaccagccctcaataggcatgtattgtgaat

SEQ ID NO: 119277 - DNA, 1204 bp, Homo sapiens
taccttcatttatttgtgtatttgtatctccgcataccactcatccactctagaggaaacaccttgaaagcagggtccttattgttcttgctctccactccatttccagtgcttggatttgcacctggcacagaatgggtatctaaatactagtttgatgaatgaatgaattcatggaacatgatgaatgaatgaattcatggaacacgatgaagatctgtgccgcagtattgcagaatagatatacatatgtgattctaaattgttaaagctggaagggctagactttttagtccaattcccacatattagagatatatcacaagtgtttttgaatagtagagggaatttgctgagatttctcacaaagcctcatgacccagatggatttggcgtggatgcccgaacagttggtgggattcaaaacctgttgctcaacccacatcctacaggtattgattaatgaattgatatcagcaagaataaagtctccatgagctggtgaggacatttgtgtgcaaatcacatttccatgagcccaaaaggggaatggtgaataatgaatgataacctagagtcactctcttccttttccttaccattactggttgattcccccgagtcattgctgttattttcattgtagctccgtgagagaagggacagggctgatcttgtatcttcttgtcaggggcatttttggtaagtttgagaaatttttcatcactctaatgagtcagggtatgattctcttcattccattcaggcagttgaccaaattcacggaaaaagaggcgccaacatcaacagtaagtgtcatggttccctcagatctctgggtgcggcttctgggcagaactccagcttccgcattggaagccagtggtttggcagataggcagcatattattgaagcctgtagggcctgagactgatgtttagaatataaatgttcagtgatgatgtttagtacactccatagccccacttggggtccactgatacataccaggctcagagatgctgagtggcagccagcttttggtgcattgaactgatccatagtgaaatagaaccatagtggccccagtgtgtacatctctgcattaggttattcttaggtaacatttaaacctgcaagtgaacccgaagtgtacctcagaactctaggccccggggagcactagagttcactccaactgtg

SEQ ID NO: 119278 - DNA, 1051 bp, Homo sapiens
gaaagcatgtcttgcttgttatttgctttgtgtgagttctgggaaaaggctcagaactccctccaaaccaaagtcagattatcagggttgggggtagggttaggaattaagggctatttacttctagttcatttccccatccatatcagttttaaatagtaaatacattttgctaagttcctgtggggcttagagtttttcactatttcttccttggcatcagtttaatatgtcgaactggcattgctaagtgtgcaaggctcccagggtgaacaaggactctgagatggagaagaatgcaagggaaaatatgatttctcctctttggtaaatagtactggctgctttgtgttagggtggggtcatgtgactaccctcactacatgggaagtgtttgctgggaggccccagggccccccattcttggtcatttgctccccgttgggctgacctcagtgcttggagcgtgattgtgtctcatatctcattatgtcattcccttacctctttttagaaagaaccatatacagccccggagtgtaagagttagacatctagtagctacagtgaatcttggcttgagacctcccttttggcacacctcagcatgtgtgcatgtatatagcatggtgctgtatagctgagcactgttttgatattaaagagtaaaaagggattgaggctatcatgatagtgccttgacaacaatggatgataataagctatttattcagcattttctaagttcagaaactatgctgagttatacatatgtacatatacacaaatatatagaaagatatgtaaatttcatagtaaccatgtaaagtagctcccacaaatagccccattttacagttaaggaaactgagacctctaattcctggaccttgtctaatttgctagagatgcctttaagccagagataacacttactgagcttgtacactgcgtcttccctgagcccctctcgccagggagcctggccagccaggatgtgactctccataggtgacacggaattgtcatgtggggactgtgcaaaggtgaa

SEQ ID NO: 119279 - DNA, 1044 bp, Homo sapiens
gaagtgtgaatttaaattcaacgcaattctctagcttctagaatatagcaaaaccagcctgcagccccatctacttctaacctttgacgtttcattagaaagagcttgaagacttatgtgcagggctgcaggaggtggatgcactaaggggcagctgcagaagatgcattaaaaaataggggatggggaagctaaagacccttcccccatgcgagctgaatgagtcaggcaatgctgattagctcctctacatgtcacgtggattttggagaggggcagtccttggccaggagatgcctctgtggggtctgtagggagctgcaccttgagtgataaagagcatttcggtaatacagatgggcgctgtgggcaggggagggtggtggccagaggtgagaatgcatatgcaataatgataacattagcagctgaaagattaccgtgtagcaggcactgtgctaagtagttccatacattaacatctccttacaacaccccgaataggagatgctattattacctgtgttttacagttgaaaaagcagagaagtgtaagtaaaatctccaagttcactcagctttaagctggagagccagaacttgaaactcagccaccacgtggcctcagagcctgcccctccaccaggatgctgcagcgcttttatttaaggcattctgtggtcacaggggcagcagcggtgaggtgtctaagcagggaggcagttgcacaatgttgacaggtttttcaagtagcgagattgctcaggagagaggcgtagtgtaactgtctccccagcttacattcttttatctttaaaggatttttttttttttttttttttttggtgaatcgagacatcttggccttgaggaaataagggcccagagtgatatggaacaaattctataggttctgtgacctctgcacctcagttaactgagaatgctggccaaggcaagtgcctgggcggacagcagcagagggtcacattacacatgtggaaaatttcttccaaaacccagcgtgtatttgggagttccttg

SEQ ID NO: 119280 - DNA, 1077 bp, Homo sapiens
cccctggaacctaatttccaaggtagagatgacacctatagcataaagctttgtggggattacagaaaatgatggatgtgccgctccctttcagcagagtgtgtgctttgagatacgcatttaatctgagcccttttctgcaaagagctcccagtggagctcagaggacagtcatgtaaccaacaactacaatgcattatacaaccacctgcaatcccccaaccattaactctagacctctaaaacagaagtatggaagctcataggaaatgaccgaggtcagccctggcaaatggcggtctttgtggtccccagctggccacctgagctgtggacacgtttgtttgccttgtgccctcactttcagaacccctcctcctttggcctcatattgtccctagctatttgacatctcctcatttaggagtgcttctcaggtgctctcaaatgacctctttttcaaaatttcctctctattcctactttccaaaaccaaaatatctgggcagctaattttagctaagagatgaaagcagttcacactaaggtacgaaggactgataggattgaccctactctttctgagctcatccataacttcaacctgttaattgaggactggccaatagcccacaaacttcatgcccacccatagatggttttgaaaggctgaacctttaacagccctccctccctttctcccttccctgtcccctgcagagccaggcttaggaatttggtcctccttttctgtgatccttgatcaggatatttctaacaacagtagcatcaaccgaaagccccaaataaggtttgattgagttaacattttcattgcattttaagtctagtcctgattaacattccactctgtgacatgggtgcagggtgtgtcctcacaggacctgcccccacgcccatctcactcagtgtccagtccaggtgcaggtatccctcctggaagcctcccttgagcctgccccacatttttaaaccctcacacatgctgtgttttctttttctttctttctttttttttttttttttttgagacggagttttgctcttgttgcccag

SEQ ID NO: 119281 - DNA, 1023 bp, Homo sapiens
ctcaggtgccttccttcctccccttggtggggtgaggacgaccgggatgagtcgtctgagaagcactttgaggggggaggagctgaaggccacacctggaagggcgatttattccttgggcgctgccaggtgtctgccgccttcacccagaaaccgatgatgttcggagccaggtatgcccttcagacaggaagcctgcatccagggtgatgggaggagccccaccaaaaagcaccctctacagggtttatgtgtctaagttccaacctgaaaacaaaacaggtcaccgggccacagggctcagagagaggccgggatcagaaagccaggggaccttcctgggtagccaaggcctggttagccaaggccgggagagtggggctctgcctggcgcttcactgcctcctggagttctcaggccagaaatctgagtttatgccattgagtggaagatgagctgcatgtgtttgaaagcctggcttgggtgtgctgcgtgaacatatggctcagagagagtggaatttgagagacgagttgttggtgactttgagctcatagcagcagagctcagagagcaaacgtaggggcaagttgaaaactggagaaagggctggggccccttcccacttgcagctgagattttatgggatgccatggactttgacctcagtattgtagaaaccttaatcttctgcaggctggggtttagttgttttgttctttgtgtcactattgatgagcagatctccctccacacaagtgatttagagattgacagggacctatttgtctgggaaagggcaggggctgttgagtgcatgaagtggattcctctaaaataaaccattgctgtgagaggataccgccagcacgcgcccacccatggcatctgcatggtattgtatcctgtcagacctctcttcggtctcttttggctacaagtaactaaaacaaatttaaattacattaacaaaatataaaaggaatttcttggaaagatgcagggcagcaggtggaaggtgg

SEQ ID NO: 119282 - DNA, 1009 bp, Homo sapiens
gtcgatagaaaactcggggcctttggcgtgttctgccattttctctggccctcctactcaacaagggaggatgctaattaagtttccacacagctgaaagacccagatatgtgaaaccatggggctagaatttgccttcaaattcagctggctttgcctttgctaattgcttagtctaggtaaaagattgtcctgggcgtggccatgtttaatatgattatctagtccaagccttcagtttagatgagaaggctgagctggagggccattggcttgtccaaagccaccaacctattagggtttgaattcagttctccttatcctctgccccagagtggcccttaccatgggagaggggctgggaagggctggcaggggctcccaccctttgtgacttctccctggcgctggcctttcagaggtgaccctcccgttgtgcttgagaatggtggttgctgtatgtttgggtttctggacagttcagctgtggctttgcatgggtggacttccgcagaacacctctctgggcagatttctctactctctgtcttcttagtcccggctagccaggcccccatcttgtcttgctgcttttaacaccacaggcccgagagacagaaaataagatggaaacctgcccacatcacttccctgcttgaagccttccatggctccccatcactgcagcacccatcaagggtgccctcagccctgagccccacatgtctttcctctcctcccctgccacccctccttgttgtagggggcatcttgtatatattaatagttcccagcccggtctctctcactgccttgtgccttgctcatgctattccacttgctcgagccccttccctccttccttcagccccttggttcctgctcatccctcaggtcagctcagtctccatctgaaggacggcaaccagctgtccccttatccaagccctcactggaccctggttggaaggatgcccgtctctctcccctcctgaagctctttgacttt

SEQ ID NO: 119283 - DNA, 1011 bp, Homo sapiens
ttaggctttgctaccccagtgtctcctcccatgttttctcagcacttcagtaaacatcactacagtataggaaggacgcggagaatatgtcatttgggtgttccccggccgtcaccgctcttacacagcagctgctttgggctgaggcactgagaacgggggtgtgctttagctgaaacatgcaccttgtcctctgagtcctgtagctaaagctcccttgcagaggtattgcgtggtgtgaaatgtagcagaagggagttgtgagacaagtgtgaaggcctaaacacagagtgggcaatggtggacactcaatgcccctagacagctgtaattttattcttaacatataagagatatcaagacatttgtagttttgctccttgtgtctaaactaattaattcacattttaaagtaaatacagactctcctccaccccacccgctacccattctgggctgttctggcagagttttaaatgctttgtcgaaatgtatgaaattggacagttttaaatagtcaatgtgcatgtaacctcctccccccgtgtgcattggttaacagttgtagctcatggatgtgtaagataaactcttacatcatcataatcattgttttaatcttgtaccaacctggccagaaatgctctgtcctgtgggaactgtctgactgagctgcccctgctgccctgcaaggtaatggggaaggtccttctagctgggttcaccttgatcccacccacctcctaccccctgctttctaaaggtgtttctgtgactgttttcccttcacggagggcaatatttctttgttggtttagcagcaaagaaaaattaagaacaatgactatttaaatcactgtgtatgtctgacagactgaggatttggcaacattgttaagtatttcaagtgtctttctagagcagagggagaataatggatcaaagtgagtatgtgtgaagagcgctgtgtcctggggtcaaagtagaggtgaacttgaaagtgatgagatg

SEQ ID NO: 119284 - DNA, 1053 bp, Homo sapiens
aagactacttactgggtatagtgtaccctgcttgggtgatggatccaccaaaatctcagaaatcaccgctaaagaacttatccgtgtaaccaagacccacctgtaaccccaaaactattgaaataagaataaaatgcacactgatttcattcagtcagaacaacaacccagggcagtcaatattgttactcatgtctcagccacagtgagagctcagcaaggagaggtaccctgggcagagccacatgtcactgtgccatagctctgctctcacacgcagactcacagatttgagcccagtactccttctttgtactccagcttgaagcccacagcgaagggcatatggagagcgtactcaggcagcagagcatctttgtcttgggagagacacacagcaggcctggctcctgcggggattgacctcttccctgactttgtgcggcagagctctgaatgggtctcgggtgcacggcattctcttacggtgtggaagagaggcacgggcaacaggtggaggagaaagcagggagatgggagtaagttccaaactccaaaacctcaagctccgacccctcctgaggactcaccttgttgctttggttttcagaaatcatgaggtccaatggattttgtttagcaaataccgaaacaatagttattgaccacagtataccaaatggaagagaccagcagctgggcgtggacccaacagagcatttgtaagtatgctgatttgaatatcgtttcatagactgtcctgagccatttgccttgtgggatgggggctcactgttcttatggaaggaagtgggtgcccagagccacccagcagttcctacctgcatttggacactgattttagaagtttgcctttcctagagtctggtgagatcttgatgagtgaatctgtggaagatggagttgctggctctgaggggcatttaggagacgttgcagggctaggggcctggttcgtgtggggccctgaggggtgtgatgctgtctccagggccaggagggccacatgcctcacactcaatggtcctgatt

SEQ ID NO: 119285 - DNA, 1020 bp, Homo sapiens
cttttcccctgcaaaacaaaatcagaccagaacttctgaaaaagttagtctccgtgaccaataatactaggttggtgcaaaagtaatcgcagtaatcacggtttttgccattaatagttctggcacttaagcctttgtggtttaatcaccgctcacaggcacgtttgcatcagcctcggtcacacaagtgtgggggagacgccagtgtccttgggcacctacttccccatccctgcaaagccgacggatagaacctgtgatgggaagacttctgctctgcgcttctcatggggagatagaaaagcacccgagccttcatgcctcgagctatggtattttaaaaataaaatattatgctgcctgacagccactcgggtgtgtggtgaccgtgagaagcacagaggcccagattcctggaaagtggcatgagtcgtgtccactttggttttgtccaggcagagatctgacttttttccttgtgaacttggcatgtaaatgactggtctaaacagaggctccatttccaggggtctgcgatctgagcagccgtggccagcagagtgagtccttccctgtgtcactgggggtgggctggtcctgggccagcacccctgactgtagccaccacgctggtggggcctgattcgccctgggctgagctctggctgtgaccagggtgattatggagtttgccaggctgccccacttggagggatcttacacctcccatccccttttcagattgacagtaccaactcctgcacagactttatggatcactgggtaggtgaaacatggaatgaggcttagagcaggacttccagaaagcggctataggtgcataaggctgaatgaatgttcccgacatctcattacagatgacgaccctggcggtttgtgggcacctgttgtgtattgcattgggagcgcgtttcctggtgtgctattctgactttgagcatttctgtctcaattctaggactggttgccataaaggaagcccacgacatagagaccagg

SEQ ID NO: 119286 - DNA, 1113 bp, Homo sapiens
tatgtacaattgtgttaccaattttttggtttcaaattcttaattgtttggctacatctggatgaaattctcatgtcacaaattgtgtaggatgaaatttttaaagttgaggttgtattagtgattatttatcagaaattagaacagtttccggggctgtgaactctgaggctaacttccttaagcgtgcgttgcagtgaacgccatcctgctttttccgcagagtgcgcgcgccccctgctggtcagtcctgaaagacccgagcgaagcggctctgcttccgttttcaggttcgcttggcagaataggcaaccctcttcacctgcctgcggtattcatccgtgcgatctcaggcagtgaaaccaagtcggacaggaacccccagaattgtcatgccatcaacaatatttggaatataaaaaccaaaagttttagatgatctaaaattactgtatttaagtgcagttttgaaaacaagttttcaaatcgttgcttatggtaaacaggtgacaacatttggaaagaatccactagccatttggaagccaaagcacttgagtcacaaaggaggagtacaacaggtaggatagaaagaaacgcagatgcactcaatagtttgctttgggggaagcagtatttcttaaactcatagttcttgtctgttcctggaaaataaagcagtgtcttcagcgtggattctgctcagaactttttctttataaatttgagtatttgtaatttggcatgctggcagcaggagcttgaggtttccagctgtgaaactgagaaaccttagtgaatataaaacaatcagaaattgcaagatgaagatttcttttatttctgcactgtggtcccagtggacagttgtacagtttttttttaaaaagtgttttccttccacattaaatacacccatccgtttggtgtatttgaaacattttaaaaacaattgaaggggagtagggaaatgggagcgttggcattttaggaaggccaggctgtctgtagtctcttgccagtgtcacttcttgagtgggggcggggaggcgtttgctgctcaaggcagccccgcgctgcgttcttgtcgccgtgctctggagctctggtggt

SEQ ID NO: 119287 - DNA, 1149 bp, Homo sapiens
gtagtgtgcagatgaccccagagttttcagcctgaggtgcaggactggcaggattgccatttgctgccatgggggagtcggcaggaggagttgacatgggggagggggtggctcaggagggcagcttgggaggcggcattttagcgttttctcttagtaaggccatgatcacaagcccgccagcccatgtggtgctaatgtacctgcctgtgctcatctttatcaccaaagacattcatctacctgcatgctaggagactgtcgtcttagatttgagatccgagtaccaggggactggcatctgggacattaccagaaaagggctggacacagatgtgactaccagactcccacaaccctgacagctctaggaagatgcgtgatttgatcccagggcctgaacctgctcatgctgttctcgggtggacagtgaggggagaagccctgtgttaccctgaaacataagggagaatcccacccgatggccaactgcaaagccacggagtttactttcttagtgacagtggctcagaaatgatcatgggccacaccagtcccgggcagcagagcaggggcacagaggcaccatctctgccccatccagtgggcccttgcaagtggggtgctggctgggcctgccctttgccttcaaccatagctccacccccgtgcagaattcacctgcgtcattctgccccacccagaggggcagctttacttctcaggggacttggatcttcctttctgactcacagacctatttttgactctgttgacctggccaagtcaccctgcactgggggtgccctgccagggctcccatggggccacccaccttcacgcggcctcctcttcctctttcttccttctgttttgcttttctttgccaagcccaaaccccgccgcccactctgcttcccccatcctgctgtacctgggatcctcttccttttccataaatggccactgagctgcgtttggtttgctgcccccccgacagatctcagactgagcccctgggccccaggcgacacctgagctcacttcccagctggagactggacacttccacagacagacctgcttccagggctactgcctttcacggtggcagttggcactgaaaagctgcagctttctcacagaaca

SEQ ID NO: 119288 - DNA, 1109 bp, Homo sapiens
ttgtttgccaagtaaaatatatcccagtaatgtaaaagcagattgcaccttatttccatgcagatttattgtttgcataaaaagattatctggatatacaaactataaacacaaaaggcagccagatgtgtgtgctttgctgtgctgcaatgccggcttttctctgcatcattccctatcacattccccagtttacatggattgaactgtttctgggacgggttagatttgcattctctagttccatttaagagatttgtgaggaaatctggatttctgagcttctgctggcagtgggctggtgactcttggaagtgtctgcacacccttggagggtgtgggagccttggccccacttgcagctttgaatctgctagcaattaaagggatgctgagcccttttcttggtcccttgagtactgcagtgggggagaatgtgctttttctctctctgcacacacacactgtggagtggtgcttggaggccatccctgggccttgtatgtgtcacggtgacacatctgcagggatatgtcaatccctgcctggggtggaggcacagtgctcactagcgctctctcctggacttctgtttgggtgaggtcggaccgggctgacctcaggacttgcccagcttctgtcctctctcccctttcctcgcactctcactctcccacccgaccttcttctccatccagattggatatgccccctctccctttcttgtcccgcagccctaggggagggaggtagctgtttcctggggatattgtcgccgggttaccaaggtgttccgttcttgtgttttccagactcttaacaccagtgggcccaagtctttcatttcagtcccctctgtgcgatacctaacatggttcagggttaccctttatttacatctctcgcatctaggaaggtttatgctttaaaacataaacatgttgaatttccttgttggcattttgaggctcctagactttttcgattgttatttctatagtttcaggctttgtgatgtctgagccaaccaggtcaccactgcagcaacagattgtgttcccgagtagtcaggtgatctttcattcttagtagctgtacaatcaacattt

SEQ ID NO: 119289 - DNA, 1328 bp, Homo sapiens
ctgaaggtgttcctgaagtatctgaaaaatatgaaattggctctgttcccacttttctgtttttcaataattctcagaaaattgaccgattagatggtgcacacatcccagagttgaccaaaaaagctcagcgacatctagtggctccttcccacccagcactgatgaacatcttaaagaccaaaaaagctcagcgacatgcatctagtggctccttcccacccagcactgacgaacatcttaaagaagatctcaaccttcgcttacagaaactgactcatgctgccccctgcatgctgtttatgaaaggaactcctcaagaaccactctgtggtttcagcaagcagatggtggaaattgttcacaaacataatatttagtttagcagttttgatgtctttagatcaagaggttcgacaggggctcaaagcctattccaattggcctacctatcctcagctctacgtttctggagagctcataggaggacttgatataattaaggagatacacgcatctgaagaactagatataatttgtcccaaagctcccaaattagaggaaaggctcaaagtgctgacaaatgaagcttctatgatgctctttatgaaaggaaacaaacaggaagcaaaatgtggattcagcaaacaaattctggaaatactaaatagtactggtggtgaatatgaaacattcgatatattggaggatgaaggagatcggcaaggattaaaagcttactcaaattggccaacataccctcagctgtatgtgaaaggggagctggtgggaggattggatattgtgaaagagctgaaagaaaatggtgaattgctgcctatactgagaggagaaaattaataaatcttaaacttggtgcccaactattgcaagaaatacttaattacattgggagcagttcatgatttagtcctcagaaatgggctaggaatagaaaaatcctgcttactcagttacatgttttttgtatttcacaatgtcgtgctaaataaaagtatgttacatgttttcccactaaaaatagaatgcaataaacatcttcaaattattaacaataactgtataaaaaagtgtatctttacagcaatattaaacatacagctactagaaaaaaactgaaattggtacaatctacagagctcattcagatttcacaagttacacatgcccgtgtgtgtttggcataactttttgcaattttatcacttgtgttgtcttggatagccaccatcacaatcaagatacacaacagtaccatagccgtaagagtcccgcatgttaccactttatgaacatacctattccct

SEQ ID NO: 119290 - DNA, 1011 bp, Homo sapiens
atcagaagaccagtctcaaaataagcacagtcgtcacaaaaaaaagaagcataaacacagaagtaaacataagaaacataaacattcctcagaagaagacaaggataaaaaacataaacataagcataaacataagaaacacaaaagaaaagagattattgatgcttctgataaagagggtatgtctccagcaaaaagaactaaacttgatgatttagctttgctagaagacttggaaaaacagagagccttgattaaggccgaacttgataatgagttaatggaaggaaaggtccagtctggtatggggctcattttgcaaggttatgagtctggctctgaagaagagggggaaattcatgaaaaggcaagaaatggaaataggtctagtactagatcttcaagtacaaaggggaaacttgaacttgtggacaataaaattactacaaagaaacgaagtaaaagcagatccaaagaacggactagacataggtctgataaaaagaaaagtaaggggggtattgaaatcgttaaagagaaaacaactaggagcaagtcaaaggagaggaaaaaatctaaaagcccatccaaaagaagtaagtctcaagatcaagcaaggaaatcaaaatcccctacccttagaaggcgatctcaagagaaaattggtaaggccagatctcctactgatgataaggttaaaattgaagataaaagtaaatcaaaagataggaaaaaatccccaattataaatgaaagtagaagtcgcgatcgaggtaaaaaatccagatccccagttgatttaagaggtaaatccaaagacagaaggtcacggtccaaagagagaaaatcaaaacggtctgaaactgataaagaaaagaagccaattaaatctccctctaaagatgcttcatctgggaaagaaaataggtcacccagcagaagacctggtcgtagtcctaaaagaagaagtttgtctccaaaaccacgtgataaatcaagaagaagcaggtc

SEQ ID NO: 119291 - DNA, 1064 bp, Homo sapiens
tattcttgctcaggtccacaaccccttacctccaacccttggggccatatgtgctttggaactcagaaatttttgagttttagaaaggtgatatggtgcatctattatgtgccatcagtggggtctgcagcagaccccataatcaaacacgttaatatttctacagtgaggcatactgtagtagtcacactggggagaaaataagacaataaatggtgcctcatctgatcaggtccagtgctgccacctgatgaatgtgcactgaagaaagaaaaactttttcagatttttgtgaatttagaaattacataagggattgcagatttgattgaaccaataaataccatttggtttgttacattatttgatacgttctcttaacttttcactgcagcaactcttagccatgaatgtatttggatagcatccaattttatgaaagtattatcttctgtattgttattacagaaatataaataccttgctgaagatagcaacatgtctgtgccatctgaaccaagcagcccccagagcagtacgagaacacgatcaccatctccagatgacattctggagcgagtagctgctgatgttaaagagtatgaacgggaaaatgttgatacatttgaggcctcagtgaaagccaagcataatctaatgacagttgaacagaataatggtgagagagttttgtcctggcgacgcttttctctgaattgttagctctgtaactttataataagagacgttatttggggtgggattaggaaaagtaaaagattagacatgttgcttctgctgaatattgcagtaatataatattaaatatgtccttagaaatgttctctataaatgtgtttttattagttcacatatcctgaatagtatactgaactctcacatattcgttaccttttgttttgcttgctattttaaagcaaatccaattatgattttattccccttctgggtacttgtttgtgtctctgtcagttaagaacattaatgttttaaaacattaaataagaggtttccactttttggttaccccaaaagatagtttg

SEQ ID NO: 119292 - DNA, 1113 bp, Homo sapiens
attctaaaagcagcccagaaacatcacaaatggagtgaggtaaagtcttgatgtacaacctaaatatattcaaaattattttcagccatgagatagtcttccagaaggaaggggtacgtcacttactcgtcttgatctgaaaccaagaaaaacgacaaacaggaaactttggatgccagtcatgcggtatttgtcatgcgggactacaattggaaaaacttaatgttaaaatcatcagcagttgataggacaacaggaactcttgtagtgatctgaagtaggcatgcagcttctaaccacactctgatagagtgatcagtggaggcatggctttgattcttcattgtgtctaggaaaccaaatagtagagatttaacacaatttttaaatgactgcactgtgtttcctactttctgattctatttattatagtcagaattctaatttttcaatttgcctttttaggtgtgaacataggtgaagtcctagataaacgttacaatgtgtatggctacactgggcaaggtgtattcagtaatgttgtacgagccagagataatgcaagagccaaccaagaagtggctgtaaagatcatcagaaacaatgagctcatgtaagttcagaagacgtgaggaaacctttaacagtacggatacttacagaagaacatatttttaaactatttttttaaagtgatacatgatagaatgtgtaaaacaagtattgcaattataaagtaatggaaacagttgttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttaatagagacggggtttcaccgttttagccgggatggtctcgatctcctgacctcgtgatccgcccgcctcggcctcccacagtgctgggattacaggcgtgagccaccgcgcccggccaggaaacagttgtttttgactggattttaaaattatagccatatgtcatatgta

SEQ ID NO: 119293 - DNA, 2147 bp, Homo sapiens
caggcacccgccaccacccttggctaatttttgtatttttagtagagacagggtttcgctatgttgaccaggctggtcttgaactcctcacctcaagtgatccacccacttctgcctcccaaaattctgggattacaggcatgagctaccgcgcctggcctgttttgagataaaatatacaagattgatattccttcaggcaaaatcaaaattttttaaaaatcaaaataagatgggtttgttcctcaatgtttctgttttgtgcagtgattattttggaaattaactctatgtatgataatgatagttgactaactataaagtgttatgtgaatgatatatagagacaccatttctcagtagatttattagtacttaaaaatatacagacttctcccacacatcacctgatcgtcatactggggctagcaaatacattatttagtgctcctaaattctgtatatattcaattttaccccaatttttttttttattttaggcaaaagactggtttaaaagaattagagttcttgaaaaaacttaatgatgctgatcctgatgacaaatttcattgtctgagactcttcaggcacttctatcacaagcagcatctttgtctggtattcgagcctctcaggtacaatgtcaaaacgtgtgcattaaattgcaaatttaacttcttcatctttacgatctcattttggataaatgctgtaacagattttctgcgtatttgatttgttttatccacacagctctggtttttgtttttaacttgtggttaacagctagtctttgttgttgttgttgttgttgttgttgagacagtctcactctgttgctcctcccggagtacagtggtgcagtcttggctcgctgcaacctccacctcccgggttcaacagagagtctctcttaaaatgaaatacttcaaggaaggaatttttatcttcaacagtgtggctttgttgtgttttcagatgtgaatctattctaaaatcgaaatgggagttttaccttgcatatctttcttcttacctatttagaaaatttgaatttattcagaaactgtgttatatacatacaatttgatatgctctcctttcaatataaaatgatttatcaaatgtgggggtggttcttacatatttttattttgcgcttgattttactttatgcttgcaaatgtttttgcctttttatatttccattttgcattttaactcctattttgttttctttttttaattttctcctaaaagcatgaacttacgagaggtgttaaaaaaatatggtaaagatgttggtcttcatattaaagctgtaagatcctatagtcagcagttgttcctggcattgaaactccttaaaagatgcaatatcctacatgcagatatcaagccagacaatatcctggtaagtcaaacagccaagctgcgctgtacatcttgaacatacatttcacttcttactagcagtaatattattactatgagaaacgacatcttagaagcatagttcagtatattaataacctatttcaaatgactaatacttttttatctttcttggaaatcggacagtgaaattttattgacaagtatgaagaaaaaggaaatgtacaattgtccctttttttctcttttgactgatagatttaaagtgtgcaccaatcctggaatgctttactgtagtaatgagtttcttctgttatctttagaaaaatgctgcacatgttgctgttttgaaataaggagtgtccgtactcttctgtttgctaattttatagctccctaagctgtggctcctgggggctcaaacacaataaagctcagttgtggttaggtattatatttaaaggcatcgcttttgaagtttattttattttatttttaaactttcaagttcaggggtacatgtgcaggcttgttacataggtaaacttgtgtcatggagggtttgtacccacttttcctgatcctctcccatctctcaccctccagcctctgacggaccccagtgtgtattgttcccctgtgtgtccatgtgttctcaccttttgaaaccttaattctcttcgactagtgacttctggtggtaacagcagatttcacaatgtatatgtttttaaaattttgaaatacat

SEQ ID NO: 119294 - DNA, 2387 bp, Homo sapiens
tagagatgggttttgcagtgttgcccaggctggtctcgaattcctgagctcaagtgatccacctaccttgggcttccaaagtgctgggattacaggtgtgagccaccgcgcccagcccagagttggcatcaactttttcatttaagttttttggttaccttttaaaaagatgtacagcatagaggaaaccacagcaaagttttaaatgaatagatgatgatgatacagtcatgcgtcacataaccacagcatacactcacacacatctagggtaagtagtatggccttttgcttctaggcctgaactgtaagttggtggactgaatactgtaggcacttttgcaagtggtaagtgtatgtatgtatctaaacatagaaaagggagagcaaaaatacggtattccaatcttaagggaccactgtcatatatgcagtctgtcattgcccaaaatgtgcactgtgtgtatatattttgtatgtatatgcatgtttttaatatttttgatagaccccaaaacaatctgatttaagttgtatatgcttagtaacttatttagagatacgcattttaaaaattatttttaggagaaagttactgttatgagcaccattaatccaactaaggacctgttggctgacttgattgggtgccagagacttcctgaagaccaacgtaagaaagtacaccagctaaaggacttgttggaccagattctgatgttggacccagctaaacgaattagcatcaaccaggccctacagcacgccttcatccaggaaaaaatttaaacaagatgaagaaactccaagggtttgagtaaatacaaagactgaagaaatttcacagcagtttattaatgtatataaacttataaatatttctccagcaaatttgaggaagcatgatatatttgaattaacaccaagggtgatatttcttttagagatgttagttaatctgttttgtgtcttacgtgaaatttcactgtagactgttttaaattgccaagactgcacaaaattacagtgctaatgtatatggttgcagttcacataaagacaaaagcatctgttatgaaatgagtagtaatattgggtggttgatttgttcttagcagacttggcttcattttggtcttgagataaaatggccagcataaatgctgtttatattcacgttttcctaggtgtgtgtgtgcaggccacagcagcatgcccttggtgtagtcagtgccgaaaggggtctgttccttcttgagcctgcctgcagggatggtctccttttaaagcaggttgtgtgcagcattcagtacactgaaggtaagctaaaccatcaacatctctggtgttttaagatgttattttattggaacaactgacaaatgagggatgttagctttgtggcagaattccctgcatgtgtgataactgatcttgttttattttttggcattgcaactgtggcatagttacaatttctgtttgttcatcacatttaaaattggaagagaacgcgcttgatggatagagcgccttcagtgtactgtttcttattaactttactttttttaaatcaacttgctatagactttatatacattttgttaaatatagttcctagtgacatagaaacgatgcgtagttttcatttactaattacaaatgttgaggcctaattctgaaagtcctcatatttaaaggctagacaacgtaatgaaatttttaactatttgtatgtcattttgaaagtgtactgctttatggtaaaagtgtttttcatttgttcattgttttcattatttgtgatcatgttgtctttcaatacaggcataaaccttccactcttgaacaaagcagctgctttttaaaagcggtaattgcttctttaccttttatttcttttgtaaatgaagcttttctttaagaatgtgactttaaagtgttgtctattgcataaaacagttgacactcacttattgtaaagtgaagattgttctactgcatgtgaagtggaccatgcagatttctgtatgttctcagtatgcatcactagataataaagtcttttgtgaacaaggcatttgtagccatttttaaaagtttttgtcttcagtgctggtaagtcaggtaaaccataaatagttaaaagcaaccttttgtttttttcctgaaagtttttaattgaaagtattattagttaaagatgtaaacctagccaaaattaccagtttattaataattaggatcctaattatttcaaaaaatcctacaaatattgtcagctttcagtgtagtgagattattcctgtaggttatggggtataattcaggatttaactaatgtttctgctattttctcacttttccttttgatggtgcggaaagag

SEQ ID NO: 119295 - DNA, 2696 bp, Homo sapiens
atgaactacagccaggaaggtgatagatgatataataagccacctctgaacctacaccccgtctcttcacggtttagacttactaaaataaatacaaggtgattttcatcttcaggtagagtgaagccttttaattaaggcgtcacaggtgcagctattctaccttaatgaaatgggtagtgattttcccaccattatttatttcggtgataatatgctgcatattcaagtctcttgtagttattttcacccaaagtagttgacaatttgatgcttctggtgatgtttatggcttcattttatgtaattttttaagtaagttccactagaaacagttcatcttataccttcaaaactgttacctgttctttaaaaaacaaagttgcttgttacttgttctttgtgttttaggtgcagctcagtggaagatgatgacaaccagaagacatgagctaaggtttctgtcctataaaagatttattaaaaaacaatccttcatttattttttgtctaattttttagttttcagcattatgatttgggttttattggtgtttggtatttagaattagtgctgttgtggagtgcgtctgtaaagtgcttgttttatcatacttcctgcctctcccctcccccagtttctcctcccctaaaataaaaatagtggtcaactttagtaatataaaaggctgctggatgctgagattccacataacacatggttgtcaaaattggatgttaaggattcttagaaaaacagcaaccaccagaatagcatatatctgaaagtagtcttcagctttaggcagatgcaaaagaatacaaactggaatattaagaatactgttcaactcctttagtatctgttccccaacttaccctgtagaaacctcgttattaaccagtgttccagtcttaaagtagacaaaatattcagagccattttttttaagggaaatgaaaaagatactctgggttttttatactccccaatttagcatatctagactacctatttgaaaggaaccctatcaactgtcttatgtacgttacatgattttcctacactctgtaattttgctgaggtgcaatttggaactctgcaagacctactagattgaatttatttagtgaatgctcctgaataaatgtgcattcctcttttagagtagctgtatgcttttcaaatgctatctgccgtgaattttttgcttttattatactttatggcaaaagtgatatcaagtgattgtcagacttgagggctcatagaagtgttaggtacggctctcaaagatgttacagttttttctagggttgggagaatagttgagatctggaaagcatagacattttttacactctggatagactttattcttgaagatcatcagaaatgaggttggaatttcgaggttttgagcagggggagcatcttatattcacccttaaatcgttattaatacatcctgttttcttcattccctgatagctatctcatttcactctactgtctcaaaattttgttttaaaataatagaaatgttttgccattattaagtaccactttattcctaacaaaaataagtactcaggacttttttttcaaaatgaaatatttatgtactgttttatggtatgtggtagagtaagtaaaatgtaatgttctcagttttgttccatatttgcattcctcttatgctttacctgtattttatcatttgtaagcagaactctagctatatggggtagaaataaaatctctgagatgaaacaaaggaatcaacatgataaaatttaggcgaagtagttaagaaatggcccttttgaatgttgaagataggaaagaaagccatatattcaaatatgtaattttcctcatttagttataatgacatctttaccaattgggcttcataaatgtgtttctttcttaatagtatcctagttccagcatatattcaacatgaattttatcattctcctcctaatggaatgtcttccttatagaaatgttcacgacaaattcatttgtgttttttacatgtcaataatgtatgctaaattaaaatgttttccagttattctgatagatgtcattatggcatccttaatttttcttctccttctgtatatagggtaagggactgttctgaagaacctttccatttagtgatcaagatatggaagctgatttctgaaaatgctcagtgtgtactctaattatttatggtaccatttgaattgtaacttgcattttagcagtgcatgtttctaattgacttactgggaaactgaataaaatatgcctcttattatcatattgtctcctggtttttttctttggttgagttcagattttcctcacaaacatcaaaacattttcaaagcattaggtgcacaacaccaaagagtgtattatattcgtgttcctgttacatacatttctgctttggttttcctagtaaaggaaacagataagtaatgagccaactcctgtttttataatgataaaaataaattggttcattgctcacatgatagcttgacaaatcttgggctcttatcctcagtatacccactctttattttcttcttttaaggaactgtttttggcttttcaaaacagtgagtaaaatagattcacagtgtagtttgtgaatcttagtgcatgcaaagcagataaggcaggcaga

SEQ ID NO: 119296 - DNA, 1047 bp, Homo sapiens
agcttctcccttactgagaaataccagcaacctcaaaagaccatgagtacatctctctaagcctcctgaaagcagttaactgaagccttgttttattaagttagtatcttaaccttgcttcttgcttttcatttcaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgttagtattcatcttttacttctaagaaccttgaaaatgatttcctaagggaaaaatttatttgccttcagagaataagtcataaaaagcacaagacacatctttagttacctctaagcacatctaaatttggaattaaaaaataactgtagtaatgttggaaatgcagtactgatttttacaaaacttatcaaatagaccttccatttctgtgtggggacagagggcaattctgtatggggattacttgagcaggatgctaggcagtatttgctgagcacttttactttggaatccaggtgagaagcatggattagctactttgagagtcttattgtatagcacttttgtttttgtatgtggtagtgagtgactgattgcttttatattcttgctattcaaaatgtagtcctggagccagaagcttgagcagctacctgaggctttttggaaatgtattatcacaggcctgccccacacctactgaagcgatttatatgcacactgaattttgagaagcactgtcttatattacacatgcagcttaagatttaacagcattagggccgagaacagtggctcacacctgtagtctcagtactttgggaggccaagaagggcagatcacctgaggtcaggagttcaagaacagcctggccaacatggcaaaaccacatctctatttaaaaaatacaaaaattagccaggcgtggtggtgggcgcctgtaatcccagctactctggatgctgaggcagggagaattgc

SEQ ID NO: 119297 - DNA, 1050 bp, Homo sapiens
aggtatttttaagacaattggggaagttttgagtaaggacagagtgttagaagatacctagaaatcatcgttaatggtgtcaaggttatataagaaaatgttgatatttttaagaaaagtgtactaaggatataggggtgaaatagcatggatagttgaagttctctaagcacaaaaagaaaaggatagatgaggccaggcatggtggctcacgcctgtaatcccagcactttgggaggctgaggcgggcagatcccttaaggtcaggagtttgagaccagcctggccaacatggtgaaacctcatctctactaaaaactcaaaaatgagctggactggtggcgcacacctgtaatcccagctacttgggaagctgaggcaggagaatcgtttgaacctgtgaggtgcaggttgcaatgagccaagattgcgccactgcactccagcctgagtgacagagcgagactctgtccaaaaacgaaagaaaataaagagagagagagatgaagcaagtaaggcagtttgataattgttgaacctggatgatgggtattgggaattcattatagtattctactttggtatgtttggaaatttttataacaaaatttaaaaactaaagctcttaagtttcaatgccaaagacttccctggcatgtctgcctctctgggctcctgtgttatctatttttctgtcctatgatgggtatgagcttctctttcatatgggtgtgtatagtaaaaaatttaaccttgccccagaagaggtgtggctttgccctcagcttctgggaagtgaatctctaatgactggtaggagtctttatttgcctggattgtcttaacgatgtgatttagggtgggggcttcaggttatacagtcatgcacaggtgatggagccctgttaaaaactctggacaccgagactggatgagctgagcatctctggttggcaggactccctgtgtactgtcacatcaattctggtagaggtgccctatgctgactccatggggaaaggacaatggaaactccacatttgctactgc

SEQ ID NO: 119298 - DNA, 1048 bp, Homo sapiens
agctcttgaggcagagaacctctgaacatgagtgtggtcaattcagtggctgggaatgtgttgcctccagctctacctgctgggcaaagcctgacccagacggatgtttgatgatggaacaaggaatcaggggagcgtcagggagccctttggaggttgcctggatgatatccacatcattcaccttcactctggggctgcccttggatcagctcagttttcttccttcctctacccagtcaagctgactgccagtctggctccctgaggtcagcagaaccccctgactttttcagagtccagcctgccttagacatgatcttattcacctcccaccagccatgggtgcagagtatcctcaatggtgccttgagattccatctgctcaggcactgctcctggtcactgcctcccaaggagctcttctcactgtgatcactgatgactgccttgggaagcaacgcactggcgggcgaaaagtggggtctttggaaccaacccaggtgtgaatcttatggagctttctctctctgtatcccaaattcctcatctgtaaaaatccaggtgctaaggttcactttcagaaagcaggttctgaggtttcatgtacttcacacattgcacttagaacagtgtctggcacacacaatgaaggcttctttaaagattaattgaagagtgaatgactgtctgagagaaggcagtgcatgtgaggtgcctggcacctccacacagcagatttcatgtaagtgtagggataatgggcttggaattgtaaccaacattgttccccagagtctccacccctttgaccttcctggcatccatcagccacacgtcctgggcttgttgcccccggggaggaatgagatggagcataaagtgaaaaatagcatgtgggtctttttttggctttagtttccaaaagcccttgtggaaaataccttgccctgggcaaggacaaaaaaagataagaaatgggggctgggcactgtggttcacgcctgtaatcccagcactttgggaggccaaggtgggtggcccttgg

SEQ ID NO: 119299 - DNA, 3033 bp, Homo sapiens
ggttctgtatgcttctttcttttgggtctcaggtttaaaatgttctttcttttgagtgggtgattgagatggaaattccaccaagttttctggagtagatactctatgacaagaacggcatttaatttcccttcagccactgtgggtttaaaaccaacaaacttaggtcgcatcttcataaaaatcacaattaaattttgggttatggaggaggtaaccaggatagaatatgctttgggggtacaaaactgttgaagggaatcattatcagtagcttttcacagctacccaaccataaaacgcctttggctctgagaatagtagtagctagattttggcttcttttgtttttttctgtcccatcccccatctccccttggatgcctttggattcaaatgtagatgaaatgcagattcttgggagaaaggaagacatgcctggtttggctggtgattgggaaaagaggaggatctcagatttcaggttttagttatcattctcccgagatgggaagaggctgtgattcttgatctgaagagtcttatcgtcggtagaacttgccatcgatgatcaattgtttggatttgaggaggagagaattgaattatgttggcctacaacaacgggagcaggtcaggtaagaatcgtttattgctggtagacgtgtcttttaatcatgtgtgtatatcgtctctcttgttgaccacttctctaatcttttaagagtcatatgtcttactagtgcatggtattgtgctgtatgtatttttgctgcaatcttcccggtgtgcttaggggatgtgatttcacttttattcttaagccactgagaaaataatagcacccacacacgtggtcatggaaactacagaacttcactgtttcataaaaggtggtggaaattccaagtcattaaataatcttgggcatatttacttctgctatgagtgctggtaaaatgtttatataaaaaagtgacggaggaaagcaaagtttgcttaaaagtaagacaaattgaacgaatgaggttaaaatatatatgtatatataagcaaaatagcattccataaatcagtgagttttaaatggagggcagatgaaaggaacaaagtggacaattgagaacttcctcaatttctcagtcgctaggtggatacccatctccttcgccagtggaagccaactgtcagagtggagaggtggttggaacttaggagtatggctcactcctgctttgttttagaggctactggtggttactcttaatgttgtagactaaggatagcagcataaacattccagattgtcaagattgaaaagctacgtaaattgacaaaggtctatgtaaattgacatttttgagttgcctttttgaggctataattcttcccctttttgtttccacaatggggaaaatcgccttactagctcaatatctggatatgtttgttgtggatgtctatgttcctttctttccctctcctgggcaacaatggcagttttggagactccttggagaccacagtaccattacgcacatggtggagccccttgtgaatgcctaagcttgtggatgttctgaagggggcaataattggagtaatggtcatggcgagaagtgcttgtatttgtattggtccatcattgcataataggcttatatgttatatgtatctatttcctattgaggatctcttttttacagttgatttttcttgagggattttaaactatcacctgccagtatttgagcgcttgccgaagtgtgcactcaatgctttgagatttcccaaatgtataaaatcctagtccttgccttcaaggaacttacaacttttgttgataaattggtaaacctagagagaaggcaacaatgaaatgcagcatataatggaaatgctaagtgagaggaaagaggcgctgtttggaggagggagagggaattggctgggccatcagggaaagaggcagagcttgaggcgccttgaccagttgatgaagtggtggctttaatttgcgattcttgtgcaaacatttgataatgggaattggatgtgtaggtattgggctttctcgtggacactgaaattccattcattgaacaacaccttatttcctgtatagagaatggtgctaggggccagcgtcaaatttgaagatgaagtctgactgaaggtcatcgtttggagttggggtggggtgaagagtagacaaaccttaaaatacagagacgagtgctgcagtgagcacgcgtgagtgcttaggcagcgcttgaagagggagttaccgatttggccctggaagtcaggaaggctatccttttaaggtgatccctgagctgggagtttgtttcaaacggtggggaccgcaggtagaagcaccgcttaaggggaacggcgattcgactcgcagtgacttaagggttggcgtggtgcttgttcctgggcgtggggaggacaggaaaccgcggggtctgtgagacgccccgtggttgttgaaacgctgttggggggcacaaacgaatagggctttaggaagaaaactggtgggaggagccttgtggctccaaggtaggttaggaactggagcgagatggagcacggaggagtgaggcggcccgaaggatgcccggggagacatggaggaactggcgagggcttcccgatgcagggcctgggggagagggtgaactaatgcctctgcagtgccccgtggggaagttccgcatactcggccagagtgatcggagttggcggctgtctgggggagttgggtcaggaagccccttctttcgccaccgatggggcacgtccagggcccggcaggtgtgccctggcagtagatcttccctgggaagtggagcgcgggccagccctcgctgttctgagcgagggcctgtcgtgtagtccacaccgttccgcgaaaggaaccaccattgacagcctcgttcgattagaacccggacctccctggaatccagactcggtcccttcccagctgcgcttcggaggaggcggacgctccgagaggaa

SEQ ID NO: 119300 - DNA, 3854 bp, Homo sapiens
cccgctcctccccttcctgccggctcgctcccggccccgccggccgcccgcctcggccccgagcggagcccactgctcccctcggctgccccgccccgccgccgccccgcccctcccgcgcgggcggcccgaaaacccggagcgcgggagcgcggctccgcagggccgggcggccgcactgggcatgctcagtagccggggcaggttttttggtcgcaagtaggaagctttctgcactacaccggagaggggagccgcgatccggccgcgccgcccgcacgccgccgcgcccgccccagcccgcccggccccgcggcggggcgcgatgagcccgagcgcgagccggcccgccggggagtgagcgcggggcgcccagggcgcgttgcgtagctgctcctgcgcacaaccccgccgcgccgccggcccgcactggccgcggagtgcaagaggctcgtccgtgcccagcgcccggccggccgcgggagcaggaagcgcaggccacgcaggacccaactgaaacaaagtgtcggccgcccggcgccggcgcccgccccgaccctgcccctcccgcccgcaactccgccgcccaccatggcttccgaggagctgtacgaggtacctcccctccccccggcctcgggccgccccccgcccgccgcccctcccggcccggccgcgccgcccgacggccccgctcgccgcccgcgcccgccgcgtcccctcccccgccgcggccgcagtttgctggacgggaaatgtgtgtgaggggagcccgagcctccgttccgaggggccccggccggggggtcctgaagttgccgggcgtggggtgggggggggggtcccagccgtggggaagtggtgctgacacaagtgacttgctcggactgagctcaaagtgctcttggcgtgggtcgtggaagtggtgcctccgttgccgctcggcggggaccgtgggcggtacggggggtggggtgtgggggggtttctggatcatttgataaagcatttgggagagggttttgcccctggtcggggggtggcggggagaagaccggtgcaaacgctttcgactttgctgttcgccaaagcgatgcaaaatctcgcaccgaaaatgctaaacgttgaccacatgctttaattaggttagcattgtggccagagccaggaaatttaaatttaacgctgatacaccgtcattcatttgcgccgcagcgttgcaaatgagaagggcatagccagaactgtaagttctggtcgatgggtttaaaccagcttcaagtttgagagttaccaatttggatctttagacatgttttgtatgtctccatgtaacttcttttgacgtatttcaaagtagacttcctgggagtacagaagtttggaaggctttctgttcttctggataaatgattctcttgtttcacatgtatttataaataagttcctaagagacttaaaacttgcgaagactctctagactcacctttatgatgcgtttagggacctgggtgttgagggacttaaggaagcatctgtaacaagtagagccctgtggccccagggatcctttcagttgtcttctcttatgggcgtattattgctgttggcatagaatagagctttgttgtctgcgatgttagtcttctagcaacttttttgttgctttttaagagcaagtgtttgcagaagttctcaggaggaagctgccatctgtagaattaagggtaaggttgttgcttctccttacattgtatgtggtcagtataccttagctggtactgaaaatgttccattcttttcaaccattttacacattagctgtgccccgctgtattcaggatactattttaggtcatttggggatgtaaaagaagaaaaatctccctgttctcaggagctttccttctaggaaggaaagtgttgtgtgtctggaagacacagaaatggaggctaggatgtttgaggttgaggtcttccaggtgaagtctgtacagggggaagtacatagcatgagggtatgggggattttagtttctacattagatcattctttggttgtttagtcatgagtgttcactcttggcatttgcttttatgagtatgattacataatcagttccatcagtggatgagagtagcaccttatacgtaagttgtatcctatgtgtgtaagaatgattctgaagacagcacatttcccattagtatattatgaactaagtttagttccttctgtgcttattctatatcttcaggtttctgttcctaacagaagttattaatgagtaacattttgtactaagtttgtgttcatttaacgtttattgaatgcttgccatatggaggtttcatggggaaatactgaggtgtgagaatggttcatgctttcaaggagtgtctgttggggaggaagtaagtatattgcaaataaatgatacacctgcacaattgaacttttgattctgagttttattttagttttggaaaaaaaggtattatagaagtatagttcaggtgataaatttaagtatgtgtagtaaatatgtagtggtcagtatctttcaaggcaaaatttgtaacttttcttttacttgtaggcaacactgtgactatgttaccattgaaagttgacattgaaagttttgcatggcagttgagagcctagatttggagtcagacaacccagttagtgacttccaactctatcaccttgggtaaattagccttgaaagctcagtttcctcatctgtgaaattgggatcagtgtttcccttatagagctatgaagtttacatgagaacatatgtaaagcccaccctaaaattcccatggcaagcacccagtaagtgatgatgattgtatggtaactggcttaaaatgcctccctgaaacctggttttgtttctaaaggtatagagttgtattgttttcataaaggcagtattatctgtagggcagaagtgatacgcaattgtaaatgaacgcgatagtctgacaaggctgggaaagacactaagatgatgttttgtggccaagtcaagggttgttagttgccttgttttgtccagttctgcctaaactgaaatagaagttttctgtttggcctcaggctccacaaatctagagggatatattgacaggaggaaatgtgaagtcttgcttctttgaactcacatggtctggtaggaggacaggtctgcagtaactgggaacttgggtgagttacccaactgctgagccttggttttctcgcctaaaagaaatgtctccaatacttagcatggaacctggtatgtagtaataggtctttagtaaatgtttaaatggctattgaaactaggctttgtgaacaaaaaataaaggaacagatcctggaaaagatgggtagagcatgaaccttgcaaaatttgaagagttactattagttgaaggatggaatagatttactccctacttttccagctgctaggattgaggaaaaacggatttttgatgcggcgtaggttagaacttcatagttttcacaaaaagacaagcgtcctttacatcacgcttctaatgtaaagggccagataatacatattttagacttgtgggttatattatggtctttgttgcaaccactcagctcacctcatgtagtgcaaaagcagtcgtagactcctatatgaatgtgcgctgtgtctcaaactgcttatggatagtaaaattcacttagtatatttcatatcattttatgtgtcatgaaatacacatttgtgttttttttccaatcacttacaaatgtaaaaatgattcctaacttgtaggttccacaaaaataggcagtgggctggctttgccctgtaggt

SEQ ID NO: 119301 - DNA, 2100 bp, Homo sapiens
ataaaaaggagttcccctgcacaagctctcttgcctgccaccatgtaacgtgtgaccttgctcctcattcaccttcctccatgattgtgaggcccccccagccatgtggaactgagttaattaaactcgtttcctttataaattacccggtctcgggtatgtctttattagcaatgtgagaatggactaatacacaagtcctcactattgtgttaaaattgcctacagtgttcagtacagtaacatctgtacaggtctgtagcctggaagcaataggctctaccatacagcctaggtgtgtagtaggctacaacattgatgtttgtgtaagttcactctgtgaggttcgcacagcagtgaaattgcctaacaacgcatttctgagaacatatcactgtagttaagcaacgtgtgaccgtatagtatactttcttttttgtggagaggttagcttcaatatatctagagaatgtcttttatttactttttgtcttatttccatttgtagtaggctctctgctatgtgaagttttctttgttggtagcttcctagtgtttgttgttaaaacccaacaatgttgactgcacatcatgaatgttctttggttaaaatgtatccgtttttcacttgtacccatttttcattagtagtttactgtttaggaattcaaggcatcacatagttgcacacagaagcttttcttattttattaatagcatgtaactaatgtggatatcccagctctttagtgtatctcagaaccaggacaaaaaaagtcatcttagtttgcaaaaagatgcaccaccccatgcacactggacaacagctctgggtctctcttggagactgttgacatttcctttaggcattatgtacttggacttgactggcacctttagcatgttagaaacaggttatttggtaaaggaaaaggctctgccagaggcaggtgaattgacgttaataagtttgttcatgaagttcgctgaagagggtagctggtgatggcactccaagtcttgaggtgacaggctccgtggggccagtcctgcgccccttagagcaagtgaagggcatgcttatgaaagaaaaggcatatgttgcaaagagctatcaagaagagtttttaaaaagtgttgctatgtaagtgtaagcgaaaaaattaagtctacttttatggtaaacttaaacataaattttatggtcatttccacccaagttctccagacggcagaggagtcagcaggaattctcctaaggaggtggaggtgggagggaggaggaaatggcctttgcaagcctgacctgttgtttgaaatctcaagttaccttacatgttttatgatattaaccatgtagtccatacaatttttgggattcaatatgaaatattttaaacatatttaccaaggagctcttctccagagatccttgatttaggctgatgtttcaggaagctgagctgtggattagtggccctgtgtgcccttggtctcttgctgtgtgtgtgtactctggcttcagaagcagagacggactgtgttaccttccataatgatgccgggtaaaggaggcattagctgatctggtgaaatgtaaataagatttgaattaagtagttcaaaaaaaatttaaaaagtttgttttagtaattgtttttaaccaataaagattaaaaatacttgttttctgtctgcagtcatcttactgctaggggttcaagagaaggtgcactagtagtttttatctcgagtctcgctgtttattctctgtactttaaaaaagtgactgtgctgttgccttgagctggttgtgggagcatttgtagggtccctgttggaatgaggaccaatctgcttcataactcctctctgtctatgggctagaccaaagtacccttggagaactccatgtcttccaggaagtttccaccctttttctcctccctctttcctgagtgttattgtctgcatgtccagctgtgtccctctaacctgattttcagccatctgccaggtccctcgagttgaggcttcactcctcctgtcctgattcttgaccctggcttctgcacttgctggtggccctgcagagctctg

SEQ ID NO: 119302 - DNA, 1432 bp, Homo sapiens
caggtgaacaataaaatcctcctgttcctctaaaacaaatcgcctttcagacgacagaaagctgccctttatgcctttgtgctcccccttccctgtgggttatttgtccttgctggagaatgggttttctctcctgctgtacatcattgaggacatcatcctgtcagggttttgctaggctggtgttgtgtggatattgataatgataaaaagcaacaagcatataggaagatttgctgttctcctcagttatctcttttggatatatgctgtattagcaagaagctatttactctttcagtaagtgtttgttaagggtggtggtatttgaaagccttgagtttataaagtactaatgaaaccttttaaatacgaagacagctttttacttaacaaatgtatagtgagcagttaacaatgggacttaatactatgtgtaagtgaccttttgcatgctgtataaaagcttgtcagagttcaggaggtgttactgctgtggttttgggtttgcttgagaacattagatgttatttttctccaagacacatactagtgaccttaacaacaacaaactcatttttcttggtatgaggactagagttaggagaatttctgaagcgcttttggaaagtaggcggacatttgagttcctcatctgccttttcccctggtcatcatacatgggatcattaagcagaacacagagcagacttgactaaagcaatgacattttgtaatgtagcttatggaagtagaataggaaggctcagctaattacctgtaatttcaaaggcagccagtaggtttcctgtgtacagcaccttggaaatcttttgtatggacccaaaaatgagtgactaattacagaatagaaaatgaataagctttgtacgaggttaagcaaatttgcaggaagaatgtatttaatgcatcatcatggaaagcaatttttgactgtcatcaacgatttcaagttaagcaagtatctgtaatgaagcacaaaagattgataaaaacagagaaaatatcagagattggatttgtccaagtaggctaactgaaaatttggtccaacaaacatcagcaagtgctcactttggaagagaatttgagtttttaaaaaattagaccccaaaggtaggtacaaactgatgatttaatatctgttattagtgtttcttagagaaacagaacgaagtgtaacgtctttggagaatacattaagggaggaagctttccaaaacccaacatgaagactcatatacagtggccagcattgacattcctaagaatcaagaaagcatcatatgatctttgtcatcaataccactgttcactgtataaccgattccataggctcagagagatgtggaaatcaggatgttttgagaatcagtgaggtggagggaacagggctgggccctagtgatga

SEQ ID NO: 119303 - DNA, 1185 bp, Homo sapiens
agtcagttcttgcctttttaaaataatcggatagtccatgctttttaattgaaattaatccatttacatttaaagtaattattaatatggttatattaggtctatcattttttgcttttcttagggaagggattttatttgcttttgttcctcctcttttgctgattttgtgttaaccaaaatttcttattaattttaattcttctgttggttttctagctatatgcatcttagctttttctttaatattgaatcactttggataagacatataattttttcaatgatgtgtttccagttccactacttatccttagtattattgtcacagttgttgcatttatatactttgtaaacccatcagtagtgttgtattttttgctttatgctgtcatcttttatagaaaactaagatattacatatatccacataattaccatttctggctgtcttcatttcttcctgtagctctaagttgccatctagtgtagtttccatttggactagagatctttctttagcatttcttgttatagatctaccaatgacaaatagtttatttgaaaatgcccttattttaccttcatttttaaaggaaacttcttctgaatactagaattcttggttgactggttttcttccttttccttcttcagtaatttgaatatgtggtcccagtgtcttcagacttaaaagtttctaaggagaagtctttgttcttatcgttattgttgccgttgttttcctgtttatgacgtcattttctctggctgctttcaagattttgtttatccttggctttctaccatttgactaaggtgtgtctagaagaagttttgtttgtgttattctgtttgaggtttattgagcttttgggagatatttcagttgttgtgtcttcagatgtcttttcctcctttcctctctctagagtccaattaaggtactgcttcctgttgtcacatttttgggaattctacttatttttcattcatctctttctctttatgttcttcagattattctgtattcaggttcattgcagatggcagaaccaagcatcaatccgttgcttagccagtctaatgcatttattttagtaaatgttttgttcagatctaggcttttagtttttctggtttcatttttctcccttgagattgccatatctgttcacttattga

SEQ ID NO: 119304 - DNA, 1059 bp, Homo sapiens
gcactggtggtggttttagtgtggcaccctgtgagtctcccctgtgtctgcaaaatttgaaagttggctaaggatctgagtagagatggacttttctctgtggttgtctttattctggggattcccctagtttctagcactccaccagctttgagctctgtactctgacatttcaagctttatgccgccctagcttgagcatagttgggaaagagcatcatattcacagatttggctccatgttactcttttttaaaaatattgctttctggtttctgactgctttttcaccgtgctgcttgtggtttcctcagcacatatgtagtatgtagttcagctgtcagctagggatttcagcatcttatgctctgaatttgagtgtcacctctatattctagtgctgtcagagtgctttaaatttctagctgcttccccaattccagattttgatatctggcacctttagttggtgaggaactggcttttgtttgcccccatgttttgcagcaatagctgtgggagttgagcagtgccttgagccaagatgccacaaactcacaattcttaacccttctagttacagtttttgagatttaactctcttcctggcttttgcaaatactacctttagatcattgaaaaaaaaatcactaattagcttggcatggtggtacacacctgtaattccagcactttgagaggatgaggcatgagtctcacctgaggccaggagtttgagacaagcctgggcaacatagtgagaccccgtctttactaaaaataaaaaaaacttagctgagtgtgatggcagtgtgtgtagtcccagctacttgggaggttgaggtggaaggatcacctgatcccaggaggttgaggctgcaatgagctatgattgcaccactgtattccagcctgggtgacagagtgagaccctacctcaaaaaaacaaaaaacagttattataaatgttatctgtgagtgtttgtgtgacctcttcacccttcctgccattacagaaagttgatatttttagttttgaaatactagggtgagtatagc

SEQ ID NO: 119305 - DNA, 2783 bp, Homo sapiens
ttattcagtttattttgttctttttttttcccttgagataagtttgtatgagagtcagccaccatcctttttctgttcttctttttatttgaaattaggttgtgtgcacttgtgcagggagggtgggcgggagaggttttcagaggccacaggattctcttttccggcatctcactaagtacttgacagtgtggcctggtaccttttgagctcaagggctgtcctcccattcctctccttccccatccatctgggctagaccttctctttccattgcgtcccccaccccacactatccctttcctgctccattgctgttctgttcccagcagtttttcttagtagaaggaggctttggctggctagtttcaagagcccttcagccttagactgctgcagtcccttcggacctggctgtgatcacttgcatccacctatagatggaagtgtgcaaagacccttctagttttggctgctattctcagctggctccctgagttttcctgtgaggtgcctgttgacagtgtcagggttcttctgctcccatccatcagacaccctgttgctatcctctgcttcctctgcacagatcctcatccacctggtcctgcagcttttgcccatttatcatccctttccagtcacttagttttctcttggctattatctcaagatttgagggattgggcaatttttgcacctcctctgctgtccccattctcctccatctgccttgaagtgaagcagattttatcctgctctgaagcctggggcatggatgagaattctttcaggattctctcaccaactttctccagtaacaggattgacagacgatagacaggtgtgggctctgttccctggttgccctttcacttgagagtgtagcccctgaccttgcctgtctgcgtgggctctaatctgaccttacagccccgtcactgtggctctgtgtccctgtccagcatcagcacgtggcctcgggatatctcctggcttcagacttggctcactttcctgattttttttttttttttttttagttttcatctttattttcctgatgacttctcttcattctagcttgtaaatgatgtatttttaaaagtagttaaaagatattttatccaactctatgtgtgtatgtgtgttttttgtactaggaggaattttgggggtacctttgtccttatattggtggtgtaaattatattttttaaaacttttctttttaaaaatagcttatgtgtctcatggcgtagcgtgcttttttttttttttgctctcctaagtctttttgatttttaaaatactttgtttgccgtgcatgttttaagagtttgctctctttaggaaaccagtcaaggtccataattttatgaaacttgggctgtcagttatttacagactaaccagtgtggacagaagtaagaggaaaagtgtaacacttgtgttatgaggtctgggagagctgaggccactccccctgttttacaggaggaaggtcctaagcagtggcctcgcccagtcagccaacctccagtttcacccacgagaatggtgggcctgagaccaagagaaggccattattcagtcatgttgaagtgcggggcgctgcctaagaacctagctcctaggctccccacatcactgcagggcaggcattagtcaccacttttagagctgaagagaatgagtctttggttaagtgttgaaatagaagtacagttcagatctcaaaataaagacctttgtcttacgaccgcatctccaggccagtggcctgggagccagagagagcttgttctctgatgcccagggccctgctcttcctccccatcagtaggaaacgatggccttggaggcttattttgctcatcactctcgccccactgctgtaaataacagaatggccctcgctctgcggtttctagaccctggcactgtttttcaaacttgactgtcatagagaccgctgctaaaaggaactgtctgcacgtccgtctgggtccattctcctactcatgaccagtggtggaaattttaggttgtttgaaaaaatgtcttttaatggcaaattaacattcaagaagagtaattagacttaataactggaaggcttttttagtccatcacttaaaacacaaacgtggaaaatgtcacagaactcttggcccatgtagcgcatgcatctgtcccatttctatacttttatctgagtgttccaggttacacttgttttaaataagagaagaaagagggagaaattgttcatagtagctgcatggttaacggtgttagctagtttgaatcagatttctaaatcagaccaaaaaaaccccaaaaaacaaaaacccagaaaacagactagatggtgcttttgaataggaataatatataaaccattgatctcaaaacactaaaaactagtatatgctcatcagtcagtgaattagctttttactctaaacttaagagtaagttttgctttacttttagaaacttttagaaccaaacatgggaactcatgtaatctaagtaacttagtagtgaaactctattctgctccccattgggggaaaaaaaagcatatgcttggtagaaagaatgttagaacttgaaagtagaaagaaatgttagaactcgaatcaggcaaggtaccatcagggctcagagccacactggtaattcgaatggcggaaatttcatagaattgttggagaggtgtttaggatcctccagagaaacgaacccataggttagagagagatatatagaaccag

SEQ ID NO: 119306 - DNA, 1404 bp, Homo sapiens
tccacctcctaaaatgctgggattacaggcatgagccaccgcgccgggctcatttatgtctttatgcacttagatttttttttaactctatgtattataatccagtattcttattctgttactcagattgtcgtagctttggtcattggaagctcctgcagtttgggtcctatgtcctttcatcatgttttcccaatttcttattttcagctaccacaggacactcagggtgcatcttgaattttctttgctccagctctggagtcaggcacttgagggagcactgtttcattttattggcaaacggcatttagaaatgcacatgcggggcaacacgtgcttgttgccgttgcctctcgaacctctaggaggacaaagcttggaagtgcatgcctgtatcttagcccacacaaacctgcacatctatatatggatctctctgcatatgcagttaaaaatgagttcctattgatgaattccatttccagtttaacaccatagcattcattctaaccttcttcttttccttaattgttaactcctttctccagcagtgagaaatccatactccgctgtctgtaatacatttactcatttgctcaactctagtataacatcaaagtagtttcaaatttgctaacccaaatccctctgagaagcagctttattaactagaacacatgccagtgaactgtagcccatgggttcaatctggcccgcttgatgtttttgtaaataaagttttattggaacacagccccgcctatttgtttatatatcacgcatggttgcgagagagaccatatggcctccaaagctgaaaagctttactgtctgaccctttatggacatggtttgctgactcttaaagtccaagaatatagattttgtgtacggctctttttgtctttagctttatggtgtcccagtcaaaatactgttttccaagattgctttttcttttcacctccttcaatgtggttattttattcatttgtaattgagttagattaatttgttactgcttggattccatttttttgttccccatacacacatcctggttgattgtcattgtgtgttttggatgtgtgaaatattgatgtggcttccaagcgtgagagctgtgcaccagggtatacactcagaaaagcctcctcgttccagctttcccattcccattctgtacgccctccactccttttctacccaccctctgtgggtgaccagtctctttagtttctagtttgtctttcatgtatgttttgtgcaaatcaacagatacatatgtattttattgcattatctttcttaaaaaaaagagcaggtagtatggtataagatactcttctgcacttgacttttttcacttatcaatatgtcttggaaatcactcacatcagc

SEQ ID NO: 119307 - DNA, 1472 bp, Homo sapiens
ggggtattatattagtccttggcgatattttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatactttgtatggtaggggtattatattagtccttggcgatattttgtatggtaggggtattatgttagtccttggtgatattttgtatagtaggggtattatattagtccttggtgatattttgtatggtaggggtattatattagtccttggtgatgtttcttggacatactttctccccgttggcttttgactttgatcttggtgtatgtgtgtgtgtttatttttgcctttatgactcgcccttgcctacgggataatgacataatgcatagttgtctaagtgtgtgatgggttaccctttgccttttgttgtttgcattgtacttcctaactcctacttcacaagatttcagttcaggcatcagttccgaaatgatttctcaactagcatgagttaaagaaagagattatgttctgccttctcagagggtgctacttttaaaagttgtttgatcctcatggtaccctttaatgactccctgtgattatatgtctagtaccagttaactatgtcagagttactttcagattttatcagttgttgtgactgtatgggatgactcagtgttggacctgagactttgcctccaattttaatatatttcatgaatccatttccactaaaatcttttttgttttagtatataataaaatctacacatctcagttttgacttgcctggtgtcatagtccatttggagagctgtaacaaaatactataaactgggaggcttagaaataacataaatgtatgctcatagtcctgggggcccagaagtccaaggtcaaggcacccagcagattggtgcctggcgagggctgctctctgcccttctcacagtgtcctcacatggtggaagggactagccaggtctcttatcagggcaccaatcccattcatgagggcagagccttgtgccactctcctatgtatgagacctagttatttctcaaaagtctaaccttttagtaccatcatactagggattgggtttcaacataggaaattttgggggacacaaatattcagaccatagcaagtggtcatttgtgtctattcagttattgcaggcaattccttcagtaaatagagaaagagcttgtcaatgcatatcatcttgtgtcagatcagccgtacagaggtccatttactgggagctaatgaagcttcagtttcaggtctgacagaagtttttgatagttggcgtta

SEQ ID NO: 119308 - DNA, 1687 bp, Homo sapiens
tgatcttcctgccctgcctttccaaagctctgggattacaggcatgagccaccacccctggcctctctcttctttaacaaatactaaattaatttatttagtttagagatgggtctcactgttacccgggctggtctggaacattataaagactcctgttggccatctcacttgactgttgtcttccaccctcttccccattcatcagctcttagtgttggtctcccctggaaccttccacatcatctcctgtgcctttgctgtctgcagggtggtccatggactggcagcagcatcaagcttgctggagttggttagaaatgcagactctgaggcaccgccccaatccagttgaattggaatctgcatcttaacaagatctttggtgatttgtagggacatggttttgtatacatgttttctatagtgaacatagaaagtactgccaatgtgtgtttagaatgtacacaaacgatatgatgtaactttttccatcaacaagatgccctagatacctctaaagatcactctgtgtggtgtgtgtagacctgtctcattctttcttagttgcttcctaactttacttctgcagtgttaaatgattagtcacttccccattgaaggacattaaggttgtctgcagcttttgtttttttgggatgtccggtgtagcggtgaactcactctagggcacgtcttgtgtacatgtgcccagaaagtagctggatagaagagtgtgaacatttttaacttaaacatcctgctaaattgccctccaaactggttgtatcaatctgactcttactttgtttcagtgatcaatttacatagtctttattctttataacattgttttaatggccatagcattataatgttttcatatcaagttgcctatccctcccctttgctgtaattcttcaaaattatattggcttttaaagaaattccacagtcttctataggaaatttaaaatcagcctgtcaagttctgtgaaaaattctagtagggatttttttttttcatggctgaagattgtattgaatttctagattaatttgggttggagactaggtatgtgaagtgttgagccttctgatactcatctctgaacatggtatttctcccaatttacttgtcttcttctgtccttgagtaaagttttatagctgaatgtataggtatatgtgcatttgtatgtgtgtgttgtgtattgtagttttgtctgttttcttttagatttattcttaggttgtttttctagctattacgaataggattttcaaaaagactgatttctaattgattgccgttgtataggaaaatcactaagttttcatatgtttaccttgttcctttgctggacactgttttaatggtcagttagagctctaggattttggagtcggcagtcttctaccttcgaattaattatagttcgtacttgcttttccttgtgtttatgcatccatttcattttctcatctggtgtaggctgggaacttccaggaccattttgagtagtaacatggtagagaacactgccgtcgtcatcttcgcctactggagtgcttctagtgtttcaccattgaagtatgagcattcccaaaaatgtctagttgtagatattctatccagatttgctggcgaagaggtctttgttactttttaaaatcatgagtgggt

SEQ ID NO: 119309 - DNA, 1899 bp, Homo sapiens
gctggagagggagctgttagttatcttggacctggaaagggcccagaaaataggtgatttattcctggttgactttcagagttaacaacacattgaagtgtgaactctgttcgctgtatgtgtgtcttgcatgctactagatgagatggtgacagaagcaagacatagaaaaaataggttatttattaaactcaaactggcttattttaatgcaatagtgaatcataatatttaattaaaaatgaaaaatacaaagacaaaaccagattggacattgagacagcagttgtaagccaagactgttttaggcaaaccaagacatatggttgtcctatttaaatccataaaattaaacttttctgtaatttggatagttctactctttccttttcccattttggtcagcaaagtagccccctattaggtttctgcagtagtctcagatccacttagatctgtgatccccccattcttattctgcacactacgtttacacagccctgctgtgtgaactaatgagacccagttacagtcatgtctatctgctgcttaaaacccagcatggaccacccaggaatgccaccagtggccctctaactattgcgtgcaccaaaatcatcagtgtgtgagggtagttgcaaatttctggttccctcctagagattggtattcagtaagtcttgggaaagccctggtgcatcaaagttgagtctctgtgcatctcattactttgtcacttgccgcccccatccgtccctgtctcatggtccacccagctgttgtaggtccccagtgtcctgtttagtggacctgtctgtctttttccccacattctttcagcagctaaggagctgctgttgtacatctttctgttgaaattaaatttattgctctttgattccatttttctctagctgagcatcttgtgtgatagcagggtctaggtctcagatcatctgtattcttaacctgatgcctgaaacttgtagttactgttgagtgatggtataagattcaagttaacagtctttccattgtttctcttgtcatgaactgaaggttcagtgaattaaagtaggatttgtgtagtcacttcattgtatgtatcaagttctgcctttaaaacttcagttttctccaggatcaatcagtgtggtaatttcaaatttcatactttaaaaattgagctttagaacgggcaaaaatgcctcctaaacatttacaacttctgctgtcttttgaattaaaataaaaactgtgtctccctacagccaaggtagggctcaacaaacgaaagctgaaaggtgctggaagcctcctgcactttgggaatatacagtcaggaacaattgtcaggagttctgtagttgattctgtaggttgggattgccataaggttggttagaaaaaagatgtgcgaaagctttcctgagggtttttgcccttgctttcacatgtcccataattgaaattaagaactgctggcaactggttagtgaccagtgttgaaatgggaaaatattactggcttatgcttttgcttatagatattgaaatttaataaaatttaaccatagttacatatgattctatgaaattaggtaggctcttcaagaaaaatgtgagcaatgtaaggcagggtatttttgggaggggggtgctttattgtataggcaagctctcgaacagtgtctgataattagtagtgtctgacaatatttgctgaatgagtgaactcatggtaacataactccagtatggcagattgattcttggtgctttttttccagtggcaaacttttatagaaattggagagtttcgtaaagacttttaaaaagttgtcagaattacctattatgtcctttcctagataatcaatttggaaacaattgctggta

SEQ ID NO: 119310 - DNA, 2183 bp, Homo sapiens
tggccagtttggcccttcttagtgaaggtgatagagacaagggcagaaggtcattgtatttataggatatttgaagcttatcttgtttactttgttaataatacttgagtcatttttctaaacattctttgcataacagcaaagattaaaaagataagtaatgtaatatattaggccctagttgtcattcacctgttcttgtagagctgatacttttttcttgatcaaattttaggtttaatcatatttagcttagaagagtggtctgtcttaagagtattctgattatttaggaacatctagatgaaacttctttgccttagtccatcgtttctcctttaaattcctaaaggcaggaatgagtgtttcttaaaaccaacatgtataaagcaacattttaggcaaactgggatgaggaaaaacatcttgaagggggcttcataatggtgttggagcctgttaaaaatgtggaatggaaagccgatcatgaaaacagatagtactgacttttggcaaaatgagtctttatgaaaacataccttaatgattatctgacaaatgcaagtgctttttgaggttaacagaattataaacaggagactgcagacactaaggtcactactgagcagcacgataattcgtgtggtgtgttctttttaaagattaacaatcttaagtcttttgtatgttatgttgctaagttatttgggggaaagtgttaaaataagtgctcttactttctttctccactgcttttgcacaaaaactttactgttcaaagaatattgtccattcagtttactttttatttttaagatgaagtatcccccaaactggtcatgccaggaaaaaaaaaaaaaaagtctcttccttccaaatttaagcatgtcagaaaattcttacttcttttgcacctgttaagtgccaggcacttaaaagttcaagggacatagcaggaaacagtactaatgaactgccttcatgaagctcacatgtagaccacaaacacagaaagaaaacacagtgtgtttgatggtgagatggtgtgacgtgctcaggagaaaacaggaggcagggaaggggatagaattggggggaaagggtggggagggaggggggcagttccagccctaccactaactagagtggactagctgggtgacttcatttaactctggaacctgttttctcatgactggattggcaaaaatataatacatgttcaacatacttcatagagttttgtgggtaagaggaatattattagtagtaacaagggccttataattgcacataggataactgtatttgcttactgaatcttcatagtaatgcttcacgctaattgccagtatcacaattcattctctgattaattcagcaaatacttgttgagtgtctgctaggcacgagggatatagctagattttagatacacaaaactctgttctcattctggttgagctatgactgaagagatgtagtgtcttatacctttcaccgttgctgtgtattttatctttaaatgttcagtttggtgacttttgtcaattaactagaaaagtcgatgttttagcgaaaaagtttataattttaatagagcttgtggtagggaactcacagtggttttattttcctattacttactcttggggctatttaaactagtaattttgtttattctataagtttcttaattttaaaagtattcatagagttcttttccttgtaagaatgctactgtatagccctaaaatttataatggttcaggagaactttggatataatacattttgtgataacagtgtggatcaagaagtagaaatgaaatatgccatttgataattgaaagcatatagttagatcgtgaaagccacgcactagaatttgtctaagttgatgaaatgctgactgatgaataaggtgaatctttcttcatttgggccagtagaatggagagatccatataatttggatatttaacaaaaattttcaagtgttaaaaaattatttgaaaaaatgtataatttgcattagccagtacagaattcttaactaacaagcagaaaatccaggagtactgctcattttttaaaagtttttgattaccaggggaaatataatggcaccgaggcacatggcaatgactaattaaaactgagcactagggtctgtggctctc

SEQ ID NO: 119311 - DNA, 1092 bp, Homo sapiens
tttagagatgaggtcttgctctgtcacccaggctagagtgcagtgttgtgatcacagtgtcatgatcagagctcactgcagcctcgaactcctgggctcaagggaccctcccacctcatcctctggagtagccgggattacaggtgcatgccaccacccagctaatttttatcagcagtttttaacctatttaagcccagggtcccttctggaatgtgccaagaaggcatagattctcaacctagaaagttgcacacatgcacccacgatttttcacacagtttttttccatttggtggaaggaccaggggaatcacaaattcatctgaaagttatttgtggatcttttatctcaaaaagttttctggactgtagcccacagttgaaaatgtagtttacatcacaatctacacgtaagcatataagatgaaaagcttcatagaatactaacctgactatgggcaacacacactgttctgttctggctcgttttatgaaatgattttatgacacactaaggggtctccacctgcagttagaaaaatgtagctctcactatgcagagtgggtagactttagaacccttgccttgtcacggccaagctcagtactgggcatctcatgctcggacgtagttcttatgctcattgtccatttgttgccaaggttgattctggctaaatgcataccccaggcagttagaaaagaagaattgcaaatcaacttctgacacattaaaagtgttatgatctggcccacattcatatagattatagagatctcacatgctcagcaaatgtgcctcctttgtggtcacagcacaggtatctaaaaacaccagggtatagcagtgaacaaaacaaacaaaagttccagccttctagtagaggagaggggcatcacatgagatcataaaatatgtcagactgtgataaatcataaggagaaaaaataaagcagagagtggggtatgaagaattgggataaggtttgaaattttagcttggatcgctgggttgttggtgtcactgaaaaagcgacctttcctgagtgaagtgaagaggtcggccggatagataattgcagacagga

SEQ ID NO: 119312 - DNA, 1554 bp, Homo sapiens
ttcacgagaagcccaaaccccagctttatatattataccattgtaacaaacttgtacatgtagtccccgaatccaaaatcattaaattatttttaaaaagactacctcttccccttctttgcctcgcttttcgtggcaaaaatagaaaaaatcgagtcacataatttcttgttcttttggaattaaaaaaaggtcactttacactcaaaaagaatgatccttccaaaggaattaacagctaactaggtattgtttgacatttgcatttggtggcattcttctctaagagatccttgctttgatgcagctggttccagttgcaaaatggtatttcccatgagtgtgaaattatgaagagttgctcctagaaagccattttgttctacaagcatgtttaatcaagaaaataaatatccttttgcaaatttttataagcatgtaaggcatatttcttgcagaagctgagacatatttaatgcagaagctgatttcaaattggcttaatttttaatgcctgcattggaataaacctgtatcccatttcctttccttatgtgggacccaagaccttgtctcaagcacgagaaggtccagtttaagtaaaattagtgtttctcaggagacgagagaggccctgataagatcctcaagttgaaacacgctaaaaccctagcaaattgaattgagacctagatatattattagaaagtacagaccctcaaaggtaaagtagaagatgttgaaggcacagagggagaaagagagatcgcctgagggtctgtaatgacactgactatggatttccacagtaatcatagaagtatgaagatggagctgagaacgtaactgccaacctagaatactttactaatgtaaaatatgattcaagaaacaaaatgaaatggacactttcaaacaagccctgaaatttttaccactggtggactcttgctaaaaagatcatgaaaagatattcttcaaaaagaaagaaattgaactcagaaaggcataagatgattggtgagcaaggaaatgggagatggcaggtatgtctaaaccacattagttgtacgaaacagtaatactgattttgataaaattgggaaacattttattgactaaaatttgtagcaacaagaagaagataggtgatcaggaataatattttatcctgtccttttattatttgggagggaaggaaataactttagattttaatagataagcatgctgatatggtttggctgtgtccccacccaaacctcaacttgaattgtatctcccagaattcctacgtgttgtgatagggacccagggcaagggggtaattgaatcatggggccggtttttctcatgctgtgttgtgacactgaataagtctcacaagatctgatgggtttatcatgggtttctgcttttgctgcttcctcatttttctgttgctgtcatcacataagaagtgcctttcacctcccaccatgattctgaggcctccctaggcatgtggaactgtaaatccaattaaacctctttttgttctcagtttcaggtatg

SEQ ID NO: 119313 - DNA, 1043 bp, Homo sapiens
ctcagcattgcagcctctcacgtggcagacctacaagctagtgtcaaacctggagcctgcaaatattgactgtgcatctgtgattcgctctagtgggttgggattttttgtaaaatttatatttggccgtgtcctctccaccctaaatagtctcccctagatgagctttagaagaaatacaaaggggcgctttctcacaaaaactgctaagtacccctagtctgtctgacactcatcttctgatattcatgttacggctctaggaacctaagttcccactgacccctaatattccgcattggcattgtgacagttttgctgttaggagcctgcatcgtgaggttggaagaggtcctgcctccataacatcgcccaggatctctgtgcaggagttgcagtttgggtttctgaccagagctgttgtattctggttcctaaatgctttatctgtctgtcattggtctcagtatgtgtgcgcaagtgtatcagtgtgtggtttgagtagtcttttgtgggctgtggaacagctttgctgcatttcactctggagtggattttattcctctggtggaaatactcattcttgttagcagagggcttagtttttcaacactaaggtaccctctctgtgagtgatcatcagactgcagctgtgaaacctgtcatgacctttacaccaagagcttactatgtgcctggtgaattctatacccatttaattttggcatgtcttggtgttttgatttggctttttttttttttttttggttggtacattaggtttaaaagcgaacacgttggcagagttttttggttttgtttttgagacggtttttacacttgttgcccaggctggagtgcagtggtgcagtctcggctcactgcaacctccgcctcccaggttcaaggattctcttgcctcaccctcccaagtagctgggactacaggcatgtaccaccatgcctggctaatcttttgtatttagtagacacagggttgcaccatgttggtcaggctggtctcaaactcctgacctcaggtg

SEQ ID NO: 119314 - DNA, 1083 bp, Homo sapiens
acaggcttagctgttaacgggaaaggtgagtgtctagggagctgctcaggctccgtggtgatcccagagggctcgggtccttctctagagatcaggccttgagctgggcagagtccggggcttctcacggcatctgctggagccttgcagagatttcgccttctcctttcttcgctggaagcctttgatatttctcttaattcggcaactagttttttctgtgtaattcgccatccacagactgtgctaccacactgacttgctttaaacagtatctccctctaactaggttattaggtgataagtttttacagcaagtttctgaagctgtctacctttcttcacctctgaagtgctgagtcttgtctcgtgttaagcgttttcttctaagtgtggccagcattgatacagaagtgcaggttcttattttgctcatctgtgtgaatacccaggaatgcctttcagtgggagcgttgctaacccagcagagcctttgggagccgggctcgtttctctgttgtgatcggcagtgcaggtgccattgcttcccccgtcagagcccagtctgcctggcaccggtggtgtcctctgttttactctcatccccagccccgctcctgggttctgcagctgccttggttgtgccatgacctgtccatctcccaggacagcacaactgggagttcacatgggtggcttccttctcctcacttgccacactgtgccggccacagttttctcttacgaggcctcatgacttctcacctgctggagctttctaatagggcttcctgcttcctgccttctgacagctcccatcccttttcagtcattcttggacgagggtggtgtccactggtgcccccaccccattgccttcagtagcaggtgtgccctgtgtgtctgcgacctggcgctccgctgccctctggctcgctctctctgtcagcaccagggccgcacgtggtcccttcctctccatctgctcaggggcccccaccacctggccctctcctctctctcccttctgagttgtagtcttaaaattgtctctttagccgggcgtggtggctcatgcctgta

SEQ ID NO: 119315 - DNA, 1389 bp, Homo sapiens
gacagagtgagactccgtctcccaaaaaaaaaaaaaaaagagactccgtctctttacctgtgtgtgtctcctccaacccaagctcagtagaataatagcaaacaaaatacaatggtgttggtttgtttggggagctactttcctctaaagcgaagtgttcactaagacattctaaccgtcctgctttggtgcattcaacaggttttctcctcggcccaggcccttgtgtagcaaaaaagtggaatatgaactgaaatctggggtctccctttgacaggaaattgccatcttgccaatgtttttcagatacacacttgacccaaacggtgccttttccggcttcattggagcttgtgaacttgtttgcaggtttgacttcctatattgtttgacctcatggatacagttttctcttacttagttgtatgtgagggatcagagaagttcagaggtagaagggactcacttaatagcacgctctattttgcagttagggaagtcgagtccagagagaagatgatgttcatggagagaaccgaagccagaaggggaaccagagcgcgtgccttagtgcctccctggcgttcttcccagcattgcttgttgcctcctggacagataagcacctccgtcttcattgatgacttgggggccaggcacggtgctggactgtagtgctaccaaaaaggactgatgagctatagtccgtgggcttggccctgccctgctcctggttttgtatgacctgcaagctcagaatggattttacatttcctgattttggaaaaagaaaaaaatcgggaggaatatttactaacgtgaaaatataagaaattaagatttctgtgttcacacataaagttttcttggaacacagctaaccatccattactatgaatgaatggagctatccattcatttacttccaccaccaatcccggctaatttttgtatttttagtagagacagggtttcaccacgttggccaggctggtctcaaactcctgacctcaagtgatccacctgccttggcctcccaaaatgctggattacaggcgtgagccactgcatctgacctacttggctctttacagagaggatacctgatctctgctcttaggaggccatagatctgtgagcccccttttttgtccacaaaagtcgtgtgtgtgtgtgtgtgtgtgtatatgtgtatatacacacatgtgtatgtgtgtgtatatatacacacgtacgtgtgtatatatacacatatgtatgtgtgtatatgtgtatgcatgtgtatatatacgtatgtgtatatgtgtatgcatatgtgtatacttgtgtgtatgtttatacatatatgtatgtatgtgtatatatgtatctatatacacatgtacatat

SEQ ID NO: 119316 - DNA, 1801 bp, Homo sapiens
agaacccttgattttcaaaacttcgagccaacaaggttaagagctctagtccttaacccgcacgtccagttttggttggagaccacctccaatgcgatcttgctggttccctctcgtgtgttagttctttcaaaatgaactgcagccctcgccagatccacattgcgctttcaccacatgtgaaacaattcgcaacaagaaccttcattcctttatatttcttatataaggaagataataatagcttccatttaaatgaggatttagtgacttcctttctaaaaaacatccatccacacatgtggcattggttaaaccaaaagggatgtgtaagcatagaatcttaaattattttaccttgttgtgcggagttgggaggttgggttgggaatgacagtatttttccaaggccctcaccatcatttttctccaaagctatgatctctacccctctctcacttctgcctgggcgctggtcagatcagccctgacccctgtatactgctgagaatataatcactagttagaggaaaatagaagctgttagggagcatttttaggacagtggtgaatgacatcccctgcggccttgatctaaatcaggcttgcagattaacgaggaggaagtctttctggaagaaaagcaactgcaaagctggtggagcccctgacagcaggcctcctgtggatttgggagggtcagttctgtcgctgccctggtacctgtgcagagaagagctttgttatactctgctagatcgtaagctccaagaaagcattttgtttttccagactaaatcgaactgtgcccagaatggtgcctgccgtgtagtcggtgctctgcaagtacttgtggatggagtgattccagtagaatgggtgcgcatggaagacaagggttgttgtaaggagtcatttgtggcctgggtcttttgctcagagaggagggaaggagagcaggaggggagaaatgctattgaaataacaacatatatggccagaaacacagacattccagaaagccctcgttcgccctctggcacatgcttcctgaatgaggagaagccgcgctgaagctctgttaggctgttggtccacactcagacactttttaagccattgtttgtttttactttctagactaattttagagctacgtaaagaaactgatttgtttttctaaaactaattgaagtagatactggtggagtcattgggaaacgaaccatcattcaaaacattaatcatatactgaaggaatatttttgccaccaaaaaccacagatatttgaatatctgtgaacccaaagaatgaatgtttctggagtattttcacacacactcacttttatagaataaccatatatgtgtttgctttttaattattttaagtatgacgcaaaggcttaaatgaatatattatttcactcagaaatgtgagaaattctaaaatttaggtgatgcagctagctgtcttctttctctctatcaatgtttaatggtaatttcttgctcttttaattccctaatgaattaatcctacaaaagaagtaattgcttttaaaaactggattatcgtaactttgtcctttcatggattcaaacatataattcatcatcattccgtaagtatgaaatttcagaaaatgctattagcaaacttaaaacaaataggtgtaaaccttatcagtgttgtgacatagggttggcttttggatttcatattgaagccaacagacctagtaggaaaatgactgaggaaatattaataccttagcacaccttgcatttcatgagcatt

SEQ ID NO: 119317 - DNA, 1156 bp, Homo sapiens
gaagagccaaggacttttgaacatggattcattgcttggagccctctcttgtgtaaagcatgctcgtaatgtatcacttactgttaccactttggatttcttcaaagtagagcaaaacttaggtgtacttagaaatctgagtacagccctagcctttttgatttttctcattttctcacacctggttttgacaacagtttttagtctagagcctttccaaatcattcaatgtagttttctttgaaacatcagctccccttttgtaatcatcccctgttgtatgtaaaaatgaattaaatataacaagttcagctagccaaaaaagtgtaagaggaaggagagcgttccctctatcctcttaggtttgtggctggggcctgtgaattacagtggtgaaagacatattaacaggagaaaaggacatatacatttaattggtgttttaaattttatgttcccaagaggtctccacacaaaagaggaaaccccaaagaagtggttaggtttgagggctcatataccattttaacaaaggatgataaattgcggagaagttcctagacaaaagaaagtggggtttctaggcttcttgggggtggtaaaatgtggggaggtggatatacggggaaacaaatggaagacaaaggctgtttagtaaggtctgttgatgccgtctcggcccagtttcatctctctggtaatgaattgttttccttttcctggtacgggaaagtgggaatacctttacagacaggaatttaagccctttcaggcagcaatagagagttctttctgcatctgttgcttctcagttgcctttagctaaaaataatccgtattcaaaagtggcatattttagaattgcatattctgattcccgtcagaagtttagggaacgaaccctgccagctcttcagcagccatatcccgaggggaagagtcacgtgtgagctgtgtggagtcccgtgaccatctcactctggatagggaaccaaggtttctcaaggagtgttttccttcttattctgagagtccctgctgcagactttgagagttttttccctgcaaatgaagtttattgatgtcacagctccagaaatgttaacacacatcctgttgtaaacagaatgtgtaaatgtcatacatttttgcacaa

SEQ ID NO: 119318 - DNA, 1175 bp, Homo sapiens
ttaattccgtatacgtgtgtatatatatatatatatatatatatatatatatatatatatatatatatatcttgcctgtttttcttttgggtggtttaacttccaaaatgtgaacatttcgtgaatgtacctgtctttgcccagggactacactgatcttctctgcatgtttgagctgtggcgtgcatgcttgtaaagagagtgcctaaaaagaggtccatgattcagggtcctccccaccccactcaggggtgaggtaggactatctaggccctgccttaagggactagaaaacttccaattaatgtgcattaattttatggttcctgctcagttttgaatataccaaagtatatttcattactttgggcttatatgaagtacaatttaaaagaaatttagatttcttaggtcagatgacataaaaggaatatttctaactatagttcttgctccttttgaactttaactgatacaaggacaaagggggggaaatcacattttcagattaaatttgctcttgtcgctgcatgtgctactaggaattaagccctgttacaaatcctccttgtctcctctattcccgttagcattgtttttgctgcagtcaggtactggccttctggaatattcctccagtggcatgctgtaccttaaggttgggagcagctatatatacacagggtacaggctctctagcctcttccgagcatgctattctggtgcctttgttctgtcttaagttcctccaacattcatcttcctctttcagagaatccttgttttacagaagaggccgcttgtgaaagagagtgatttgatcaaatcactagcagaattggtgggaaactagactctacgttagaacctactcctgacttccatttagttctttgtactgtgtcacactgataagtgaattttttataagcgtaattgattttattaagtacacagtattactcaagactttcgcttctgtgtcaagtgagtgaaactgaacccacagtggcttaaacatacaagcaaatgaaatggcatctgttggctcatgaaactgaaatccaggcacagctggatctgtggcctgaagttaccatcattctcataccccaccccacccccagcctccactttttcagtcaggccatccttcccgcatggaagcaaggtgc

SEQ ID NO: 119319 - DNA, 1058 bp, Homo sapiens
ggcttctcttcctcctacgtttcaaggggtgaggtcaacttcatctaaactctgtaacctagaaggaaggggatgagaggataccccaggggaaagccagggctagtaacaatagaaatggcaatagaggccgggtgcagtggctcacacctgtaatcccaacactttgggaggccaaggtgagtggatcaactgaagtctggagttcgagaccggcctaaccaacatggaaaaaccctgtctctactaaaaaaaaaaaaatacaaaattagccgggcgtggtggcgcatgcctgtaaacccagctactcgggaggccaaggcaggagaatcgcttgaacccgggaggcagaggttgcagtgagccaagatcgcaccattgcactccagtctgggcaacgagtgaagctccatctcaaaaaaaaaaaaaaaaagacagtaggtactgagcaagcctggacaatcatactttgaattaatgtcatgttccagcgtttgggtggccctctgaaacagtacacagtcatcctcccaatgcagctgtgcccaagatgctgctcaccaggagactgagctgtgcccagctctgtacttcctctttttgaataggtgttcttcctccttttctagtcctatctttgggagctaggcactgcatttatctcctttttaatttgatatctcaccttttacacatcagtcacattaattacacaaatggactgtttatgaggatccccttggagaaggtgccagggagtccaattctccaaggctcttttgccttgggtgcagaaggtttaactaacgtggcttgagtacttagattggatggatgggagccgattccctagaacagtctgaaaaaataaaatcggatgtttttaaaatatccagggaaagatccagagtagatggacaaattcacttaaactttaaatggtaaaatggaagtgttgtgcagatatttcagtggtctttagaatctcctacattgcctagtccaattgtttacacacattaggggcttcattaacatttgcgtgtacatgagtgagt

SEQ ID NO: 119320 - DNA, 1041 bp, Homo sapiens
atttttcatcttgctaatgtagttttaaattatgtattccatgttcacattgtaattgtagcattttcttgcatgacactttcagcaaagtttggtagctgtttcccatgcttggcattacctctaaaggtgaagtaacataagaattgtataggaataccatgagagcataacgtgagcattatcagctaggtgagtgcggaagatcacactgtttaattgctggattgccagcttctgacccttctctgggagtgcggctgcctctgtacctgcttcatgacagtacaagcgtgaaggccacaggagaaaaagaacaggaccacacagcccagaccagccttggaaggcatgacattgcgtacagagtgtatcggttgcttctgatttccgtgatttgaaccactcttttattatggacttcaaagggaaagtaagcataagtttaacttctgtgctttggtttttcagataaaccttatctgatgggacaaaaattctaaaactatggcagctatcaaaattgtcacagctttataacagcaaaccaagaggaagagtggtgtaaaaatagactcagtctgagttttggtttggtttcgttttatctgggggagaaggaggttgccctagtaaaatttctacttgcaaagtcttccacgtgccattttttctgttaatatgttctcagtgagtggtctaaactaaatgtattgtgttctattaatcactgtttacagaaatttgccatttaggaatgtatattgtgcagtctaatgtgtgcatttcccagttttcacaaggggttttctcatgtgcatgtaataagcagttccacactgggttttcttgattatagagtctgtgtaacgctgtgacagcctggggtggcacctcgccacaatcttcagagttgcacattactgtgtaacattagaaactgctgctactctgagctcaagtgagtcaggggtgcaccccaagagctggatcactgtagggccagtgggttaccaggttgtcctcctacagaaaggggag

SEQ ID NO: 119321 - DNA, 1086 bp, Homo sapiens
tcagctctgctgctcaccattgccaccaccttgtccaagcaattgacatcagtctttattgcctttttccaatccatttctcacacaccaggaggattttttatagatgtaagtcatatattactgccctgcttaagggtgtgtcttcgctttctggtgtacttgagataaaattcatacttttttttgtttgtttttgagacggagtctccctctgttgcccaagctggagtgcagtagcaccatctcagcttgctacaagctccgcctcccgtcttcatgccattctcctgcctcagcctcccgatttagctgggactacaggctcccaccaccacgcctggctatttttttttttttatttttagtagagatggggtttcaccgtgttagccaggatgatctcgatctcctgatcttgtgatctgccttctcggcctcccaaagtgctgggattacaggcatgagccaccgcacctggccaaatttcatacttcttactgtggcctacaggaccctttggggctggcctttcattgcttactgggcttccaatatgctaggctccctccactttctggaattggccaatttctttcctcctgttttgcacatgtattcatatatatacatatacacacataccttttttttttttaatctggttgacctcttatccttctggcctcagcacagacggcacttcctgggagaagactccccgattttccccctccatctaaaacatagcgctcagccacagttctagttgcatgcttaatgtgttggtttctttacctaagctaagctgcgggaagttaggcagcacatatgtttatttactcagtctcacggcattagcacctggaacaacaccaggcagtgctcacttgctcaggtttgttaaacagtgactctgatttttgtgtctttgtcttgttgccagattaagttcttgtctgtggttttatggccagaagaggcacacataaatgaatgagtactctgcctttaactcccttcatactttctgctcttttccttctgtccaatttattaagcacactgcatactatgtgccatgtc

SEQ ID NO: 119322 - DNA, 1004 bp, Homo sapiens
ctattatctgtctcttgtgttctgccgcagttgagacagtccacatggccccagctttccttgcagcggctcatctttcctcagattgcaggctgtgtggctgccttgcaacctcagccatcctgcaagttcaagaacagttgtaattgatagtttatccagctgtaaccagcgttttagctgtgcacgggcctattcttcattctgagctattaagctggttttcatttgactttggtttgcatagaacacagggtttgcagaatgggtttgtgactggggtgggttgtgacatggtttcttagaacggggcccacacatggcccacgcatagaggtgtttcagtacagcagtaacagcccggcacggtaccacagtgttcacagttgtgggaacagggtgaagagtagactgtcctccagctgggagagtaggcagggatgagtcggtgcaagtggacgagtccaggacagagctggcttctgagcctaggaggtcgggcacgtatccttgcctttattcactgtgccctgcctgtggtttgcatgtgagaacacacatctctgtcttgtgtgctggggctggcccaacctcgtagatcatgtttaactctgtgttgttaggcataaccacagtctactttaatgacagcagatgccccactgtttagtcacactgcaaagagcatcctttcgatcacctcccagtggaaatccatgatgatgaataaattcctagattcggatttgtcaaagatttgttttgttttgtttaatatttttgatacaagttgtcaaaccatcttccaaaacacattttaccactctgctctctagccagtgaacacattttgcttggccctgatattagggttgttttgggtgtttgataaacttatgtgttttgacattagaattgtaaaccaaaaatagcattctaagccctgcagcttggaatgtgaactgcctcttggccaaggggaccctaaagaaacctacataact

SEQ ID NO: 119323 - DNA, 2788 bp, Homo sapiens
ggcctgcctccccctctttcagtgatgctgaccattcacctttatctgagtggttcattccagccaagcagctgagcctgtgaggacagaggcatctctccattctctcaacagcctgtttctctctaaaataaaatcacatatttccattttcttatgatgcttcctaattccaaggaggtgtagtgtgtagtgatcccctcatgctgggcaggtaccccggatggaggcctggccacgtgcacggcccactgccacacctccacctctgacaggtgggccctgaggctgatggggagtccagagcaccctgcccaccagagaacttcagctttgatccgttttgtttttgaggttccaagtaagatttttctttaggaaggaaaaaatagctctgtatacaggggcaatgctaggaaaactgttgcttttctgtactttgtggattctactgagtttgtaacctgccctgtcttatcaaatcgtttgctttcatggttattccttccttatggttttggggtggttgagtgtctatgtgtgtgttggcttgttttcttttaaagaacctcatggagaaatttatcttagatcttagaagtaccagattgtcttttgaagtcataggtttgtttttgtcttagaatcttcgttttaatggcgtttccatccttgctttggcctctagaaacaccagaactgagtatgtggcttgcttttaggagctaaccacaagactgactgtttctgtgtggtggttctgccgctagcttcttgttggggtttgttagactttgagtagctttgcctttgtagttttaagggaggtctataatgtatactaatactaatacattgtaaccaagcatagagcctcattatgatagcagttgagacacagttaaaattaatgtaaatgttactcaagtttaaactgtttctctaatctccgatttacagatgaagtggggggcagaagtcagaagttaattgtcctttggtgtagtctgctgttagaatactgagaaattgatagaaatggcagcactgaggaaggattaaaagtatagatggcaagttttcattcttaggctgttgctgttggcattgcagggagaaggttgaagtagacatgatgatgaatatcagcaaacaccttgaacccctccttactctgggtaattacagatgtacttccaaatgaggtgtctgaagttctgccctctgtgaggtgaactaggggtggaaaattagcacttgaacgtcttagcttagaacacattggatgcaataactataggttgtgagctaattttctttgaagtagatgtttgcctgtagctactattcatgtatctacccaagatagtatcttcctttaatatctaggttttgaaattaacggccacacactgttaatgaaatagagaaattagattgtaattgatcagttgtcttatgaaaacaatagttgcaaaagccagttggttctgagagtcaggataaacatgaagaaaagtattgatcattcaatcccatgtcaaagtagaatcatttctgcaggaaatgtagtttttgaagatgtgatcaataataagatcccactgctggagaattataccatgtcgatagctatggttatttttgtattttcatttgtcctttttaattgttgttgttattgttaattctgccttattctctgcactgaaaagaaaggttgggtgatgttctgccccccccccttttttttggcactttgaggtgacattataacataaaggttgttgcttttttctctccaatatttgatgtattttcaaaggctttaaaaaggaaataactaaatttaaagtaccacctgtcttgtttaatttgctttaggaatttatccctatatgcttagttagaatgataggattgatattgcgtagtaatttctgatgtttttgttttagtttgtcaaaagtaaaactaaatagcatgaatttgcgtctgtaattaaagattgaccgcgcttgaataaagttttccattaacttcttcaaataatggagttcacttttaaggatttccctttcctcagtgtttttaactttgattctaaaatgctggttgtagggatcgctttgaaactgctttatctctgtgtatgttttgaagaactgagtaaggatgaacacttcgatttcctttgggttactaaagactttgctgcttttctgatttaggagtccaaatccccttaaggattaatgctctcagaggagctcagcacaactcaaaatgaagattaaaattgacacaggattcttctacacatagtaatctataagtatgggcctttatactacagaaccttcagacgtgggcaaagacacttgactgtctctagttgaaacctgcgctaactgtatagttttgcatagtttatggtgatattgctaattagagtgttttgttccagaagaccggaacaaaacaagttcaagttcttttcgttatcctactgtcagtcattcagcaaaatgagtgtctttaagagtgaggctcctgcacagaaccagaggcacaagcttgatgaggcctggatcctacactgggtacatgtgtggcctgtgtgtatacattaaaactgcaaggctggctggcatacagcagttccaggatataaaaaaaaaaagaagtaagagtttgtgaaggtattgtctctaagctaagatagcctcaaaattggctagagattcttgcacaatttatcattgataatacaggttaaataaccctg

SEQ ID NO: 119324 - DNA, 1293 bp, Homo sapiens
tcgttttctctctctgcccaagtaactgaagctcaccacatggtggcccagcaccggccttctccccatttgtgaaaaccagtccacttgcccttcccgtaggttgatgccagaagtaacaagaggactctagttcgaagtccttaacatttaataaacaagaagacatattggggagttacaacagctcttgatctttttatgttttattttttctccttaagctggctcggaacacattttctgagccctggaagatctttctcagcccccacttcctaggctcagctttttgttattcctcgtaggtgggtgagctgtagacttccttgtgccctttccaatgcctccacctttgtgtcatatgctttttaacttggtatttaacccttcaaaggctggctgcagtctgtttgtttccatcctggcttttcatggtaaaccttcatcatcccctgagtatgtagtgtatttggccacctccgtttctttgctaatggcatagtacctcgacatgccatatactttttttttttaaccaattacattcaaaaaatacttattgagcaccaactgcatgcaaagcacttgagagtcagttagaatcccaactccataaagtcttcaccagcattccctgggaatattcctaacctccgtggagaggtttcttgtcagtaaccactcatttttccaccacttttcttttgctagttcgtttttcacgtaggtaccgttcctgcctctgtggtggcagctgggtatgacggaggctgcatttgtgcagcctcatgggcctgaatttggtatgagcttagcacccctcacctgctcagtgaccttgggcaggcgaggtggttaggcatcctggacctgaagttttcatcttcaggggattatggcttgggggttgggtgagacacctggtactgcccggccagcagtgatgggtccacagatgctggttgccgacccgttgcctcagtatctgtgtctctgacctcctgtgaccaccttgctctgaaaagccagtatgatcgttcactgggatttcccctcttgcttttggtgaagaataaaacaaagttggaaagagttatcaatgcatgggcaatgaatcctgaggacagatgattaattaatatgtgaacatttttatcttcctgaatgatattgttaaaaaagtataaatacaagcagtacaagaaccagcagttaaagtgtgtctacattggagaccatttcactgtgaatgggtgagcgtgtttccttgggtgcagctttaacgagcag

SEQ ID NO: 119325 - DNA, 1140 bp, Homo sapiens
tccaggacagagccagcttctgagcctaggaggtcgggcgcatatccttgcttttgttcactgtgccctgcctgtggtttgcatgtgagaacacacatctctgtgaataagaatagcccggcaggagctattcttagactgattctagctcatcgttttcccctgtactagaactatgcgcttcatgtagatttataacatacaactagttaggtagatttcattcattattcttttcaaaaatgtcttagcctatctccctgctaaatcctaaccaccgagttttttattggaagtctactagaattagactagcctttaactcggagacccctatggatagagaactggaagtgaaggagttagagcaaagacacttttacaattatttgtaaaggatttatttaacacattatgaagaaaagaggtattgatgtttaaagcctgcatttacttccatgttcatatgaaacatggttcttcaagaaaatttgcagattatgtaatctgaataaaattataaggttttgtataggtgaataggattacgttcaatatatgtaaataacaatattttgaaatattaaactccataaacggagagctattaattctgtagatgctatagtccttgctttttaacttcagaccaaagacaacagtggtcattaatatccaagatggttaaaaacagtttttgaactctttttgcagttgagacccttctgccttgaaaacattaaaacttgctaactcttgattagacaattctaaactaaaatataatcggagaaataccagttaatctttagctagtgaagaataatatcccagacatttttgtctggattttggatgctgtagtgtagtttcaagtggtttcttgattatgtcaaatatattgtaaaaattcacaaaatagcaagaggataagaattattctatgtctctctcaccaataaagagccaatattaacatttctataatttacattcctaataaactcacatggaaacattgttgatatctgtctgtccacataccccttctgttatctttcatttttatttttttcatgtatgattttggggatgggcagtggaaggacacaagcgtgggaatcagatctgcaggtacca

SEQ ID NO: 119326 - DNA, 1170 bp, Homo sapiens
tcatactgtcagttcagccatttctggcaccaaccccaagtacctctctccaaccctgacttccctcccctgatctagatgtgcactttgggctatgcacatctccacctggatgctcaccctggaggagcaagcatctctccctcgcctcctccctcagcaactccaggctgccctgtggaagcccctcttccgctcccccaggctcacatgtttagagtcatccagcatccatttctctagactcagaaggttcctggccatgtggactctgggtcccagttgaatgggttgaagaatgatggacagagggagaggtgaagacagcaagtgcaggcaggtgaggccgtgatgggactgagactggaggaacagattagagagggttcctgaggggagacgagattgtcaaacgtttttaaacaaagatgggagaaggatctggtagggtagaggatggaggttaaaagaaaaagtctttcctgagtccctcagaaggactcagcaacacctttgctgactggtaacatccgacccagtggtctccagttagaactactccaggctacaagtcctttggaagcttgtagagatttgacagcactgggatgacagaggtcaggattatgtgtcactgtgttgttggtcatatcgacaagtcactgaatagtagtgcgtattgcagtgtgaactggaaaatgaattacagtgcatccctaccttgggcctcgcctgccacgcagccttaggaaagaacaggaagctatgttctgatagaggagccattctaagatattgtggaaggaataaccatgagatgtaacaatgtgtatatcttatatatgtacaagcaagacaacaatgtataagatacagcatcttatactacatctagtgtactgccatctgtgcttttaaaagccagggtggtggagaagtctgtattgatgttttcttgtatatccatggagatactctggaggggcccctgagaacccagcccaagtggctaagagggcagggggatcctgtgtaaacaggatcaggctgtggggggctttcaccttaatatcttttatattcttaggtttttgaaccatatgtatgtattataacctctttaaatttttcaaaaatataattaaaaaaaaacctctagcaattaaaata

SEQ ID NO: 119327 - DNA, 1331 bp, Homo sapiens
agatactctccatgagacccattctgtcttgattctgtcctttaaaaaaatctctaactatgtagcttcctttcaataagtacctctccatctgtattttttaggcaaggtgaaacaaaagagtgactttcttgtcagagcttgaaagagagcaagtggctttaaaagtagactttggctttctaaaggttctaagttttaatattcttatattcgtttaatcctaagtgtgtaatgaacatctttatccaattcaaagatgacacctgggagtgaactggtggtgggacatcacagactactgtgatttcaaactctcggcaggtacatctccgttcatggatgcattaacagccaatgggacaaccaacatacagacatctgttacaggagtgactgccagcaaaaggaaatttattgacgacagaagagaccagccttttgacaagcgattgcgtttcagcgtgaggcaaacagaaagtgcctacagatacagagatattgtggtcaggaagcaggatggcttcacccacatcttgttatccacaaagtcctcagagaataactcactaaatccagaggtgagaggcgctcttgggctggcgtgggcttcgcgcttctccctgcctgatttccaggcctgcctggctgaactggctcttcctgtgctctttctaaacctccttttgggccatctcccgatgcccaccagaagggagggagcagaggggaagttgcgggctttgctccatgtcccacctccaatggccgtgaattcaggatgcttggcctgtgctgagtgtccatccccattctcccgggtgtgggtccacccaggcctctgtgcctctgtggttcacctcctgcctggaagctcttcatctggcgggcacggggctccatgaaggcacgtgggaaatgtgtgtgcacgcgctttgctttagctttcatcagatccttaaagggttctttgttcagacagaatttaagtgcccccggggatcccagtcccttcagaatatttatcatctttccagtccccagatactcctcagcggttgtagcagaacacacagcaacagggatttccacacatgctcattgctgatagtgcctagtaagtaagttttccagaactggttgttggaaaggttagaacatgaattttgtgaagtttctagaatcgggagtatttgaacctaacctatatctttccaaaattttaagtcctagtagtttgtgagtagctaggttgagttttgtccagacaagaaaacttaactacagaaagtctgtgtgttcgcccggggtcacataacaaaccagttcaa

SEQ ID NO: 119328 - DNA, 1150 bp, Homo sapiens
caagcctatagtcccagctacttgggaggctgaggcgggaggattgtttgagcccaggagttcaagaccaccctagacaacatagcaaaactccatctcttacaaaaaggttgaaaaatgagccaggcatgatagcacaagcctgtagtcccagctacttaggaggcggaggcgggaggattgtttgagcccaggagttagagagcacagtgagccttgattaaaccactgcacgccaacctgagcaacagagtgagactctctccaaaaaaaaaaatgctttaagattttaaacccaaaatattctttgccactttaacttctggtgactttcaggtaatgagagaagtccagagtgctctgagcacggccgctgccgatgacagcaagctggtactgctcagcgccgttggcagcgtcttctgttgtggacttgactttatttattttatacgacgtctgacagatgacaggaaaagagaaagcactaaaatggcagaagctatcaggtatgtaaaaatgatgttttttaaacattggttgggtgttttgtttttggtaaaccaatcctgatagaatgggcctgaccaagccttgagaataagatacacatcttctcccatggagagacacgagcagcaaaattaattaaatcatctgtctcttctatgggcctgccataaattactacttgccttgggcaaaatcttttctatgggcctgccatgaattactacttgccttgggcagataactgatttcaaggttggtttaaaccctgcaagtgttcggagaatgttctgatgattagagtagatgatcatgggtagccagagttcctattatttgtgccgtgagtatgttctgtcctcaacccctagataaagatctcttccaaatagtaagttaccatttgctcgactctgaagtaaattgtctaggctttatgatgagatagctccgtaacaccacatggagagttttgttttttggttttttttgttgttttttttttttgtttctttaaatacaagtagtgcacattcttgttcagtttcatcctaagttccaactggacagagaaccagatagtaggaaataaaaagcagaagtcctccttgtccctcactcccctcaaggtatccaacat

SEQ ID NO: 119329 - DNA, 1045 bp, Homo sapiens
gccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcccattccctgaaaagggaaggggctctttgctccagagcatgctggttcattcataccccgtccagaaagagccaccagcttcaggtgaagtcaccattccaggcaaaagtaaaaataaaatttcagttccaaaaaatgccttcagcctatcaaaatctaagtttcgacttaccaatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttccttatcattgagagacagttcagcagttttaccttttcatgagtcatcagttactgggcctaggaaatgtatttccatcttgtgtcattgaccccatatcttcaaaagatgacacaactgaaatagcttcatgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaactctgcaattcctcactctcctgttcatacacacacagacacaaccctcctcacctccctgacctgcccctgccaaaaaatatgagtcatccgtcagtgtctcg

SEQ ID NO: 119330 - DNA, 1027 bp, Homo sapiens
agcctgatctaaagcaaatcccaaaatagcatgggcttgatttattaaacctctgtcctgtgcagaggctgccccacgcctgaccccactgtcctccgaactcctgctgcagccgtaccctccagccctcagtggagcaggatgtgggtacaggcctgagccctgtgctgtttgctcttcttgtttgcaggtcgcatgtcttgagccagcctgtgacactcttgtctctgtatcccccagactgttcagtccacttccacataaactcaggaaatagcaattattgccagataatcagtgagctgtctgaaatcatgaaccaaggccagacccagatcccagggtttttgtgaaccctaatccaccaccgtacacttaacaccaggcagtcttagtatgccctgggccagatttcctctgtgacagcttcttgatttgtcttgtgaagcccagaatatgtactgggctcctgtgtcttcgagggaagacaggttggggagcaagatgtgttgtttatagagcccgagagccacctgcaaattccagtgcagctcatggctgcatgttaccctgtggccttcacgtagggcctgtagtgacagccactacatgcgtgggctccaggctgtcaccaaacctttacaacacgtagtaaataagtctagggtccacaactgctggggaaggccttaaacaaatctcaagtcttcaggatttccgtagcatttacatcttggtaaattgaattccataatagacttttcctttgctcaaatatgcaatgttttgagtaattccccatttatttttcattttagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcat

SEQ ID NO: 119331 - DNA, 1037 bp, Homo sapiens
cctactctacaagccttggcagatctttactttacgcttcccctggagatgtactggtgcctcttgagctgctgctttcaactgggcagttttcacccccgacctcacccctggggaacaatgtctggagacaacttggttgtcacacatgaggagatggccgttagcagaggctggggtactgctcggcaccctccatagcccacgggacagccctgcttagcaccctgcatgtagcccccacaggacagcccccacaccaaacaacagtccagcccagaatgtccctagtgtccagggggagaaaccctgctctaactcaagagcgaagagcctgcatttcactcggcgtgaattctacactttctgagcagagtatctgacgaagcctctctacagaaagtgaataaacgttgttcagatgacttcgacaactcttgttgaaagtgactatgcagatgatgtaaatgatgtcgttcctttcatgagcctttggtgtacttgagctttcagcagcctgaggcaagactggacaagtgtggttttccccactttgcatgtgcagagctctgccaggaggataagctaaaggaatcacattatcaagataaaaagaatatgcaaatagtgcaggctgtgtggcctctcctttcttacagcaggccctccgctgtaggcgagggctacgtaaatcagccaaggagtctcttccagtttagccttcctggtgcccagtagacattcatggagtgcatggaggatggcacggtctgacgcccacaggctcccacgtggaaatcttgcacctctcaggggcctgctggggtgtgaagctggagaatgcccagcgagtacctgagggccttaccccacgctcacaccttgagagccctctcttggggacttcagagactggcctgagggagcaggtggtaaaacctctgccacagcagtccccataaggctgaagattcctggatcccctctgctcatactgggccagtttcctcgccacccgtcctgctgtactctggcca

SEQ ID NO: 119332 - DNA, 1921 bp, Homo sapiens
atccaaccacctggaatggagaacaccgaaggtagggaaaggatctccagggatgagcaggcctggagccggcggggctgtggaggaagaccggccgcaatgagtgagtgctgagcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccactaagctggtcctgagaacatacttcatgctcaacttcagggatgtggctgtagtgtcctcactctatgctgagaatgaaagaagcacagtctatgaaaggaaaaccccgacagcacagagcacttcgtgcggcagcagcacaccgggagtcccactccctttcctgctgcgtttggatctgccgtgacaaggactatcagaaccactcacagtaaggtcgggtcgcgtttctaaatccactgtttatggaccgtcttttcactgagaagaagctcgtcagttcaggggtttctagaacttctccagactcttcaaaaactcatgactttctccaagttggtaatcccagcactttgggaggcccaggcgggcggatcacgaggtcaggagatcgagaccatcctggctaacacagtgaaaccccgtctctaccaaaaaatacaaaaaaaaattagccgggcgtggtggcgggcgcctgtagtcccagctactcacgaggctgaggcaggagaatggtgtgagcctgggaggcggagcttgcagtgagccgatattgcaccactgcactccagcctgggcgacagaaggagactccgtctcaaaaaaaaaaaaaaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaagtggaagccacctaccgaaattgtgttttaccagagccccaggagctcatagtcaaggctttgtgacatcagagttgttaggaaggttaaccgggcaagataaacgacagaccaaaaattgtcccctcaggccagtgtggagtttctttatcagacatgtgtgcaccccttcccgccttatctcggcatctgtgagcctgtcatttgaatgatgtaaaatccatacatgttgtactgagaccttaaaagtgatctagttcagtgtcatgtattaaaaaataaagtgatctagaatccaggacaaggttaaaattaatttcatatatacacatatatattcttttaaagaaaacctaatgttagctttctccactgagccgtgtgaggtgactgtagccagcccctcaagcagattacggtcatttttcgccacattcaagccctggatagttctgtcttttcgtatccaagcgatacaaggcagcctccaaggtacgctctagcagaaacggtcgctgccattagaatattttttctgtatattaaaaacaagtcaccattggcctcccagataaagaaaaggtttggtaggaattctgtgcctggttcaaatccttaaaattataaattgcctaactttgcatatgctgattttcccaggattgttttgtgtattaa

SEQ ID NO: 119333 - DNA, 1046 bp, Homo sapiens
aatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgctcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagaca

SEQ ID NO: 119334 - DNA, 1020 bp, Homo sapiens
aataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaatgtttctctgattcttgtgagatttctcatgggatgttttctctttcgtgtgtgtgtgagatatacatgtgtgtataaagcatctgtacagttcaatggaatgaaaccctgtgtgactaacacctaggtaggacctaacaatttgaccagtatcctccctggtcaccttcacccgggtgaccatttcctcactttgtgtccatcatccacttctccttcaaagaacttattcctaaaataaattacttttagttctacatgtttttaacctttatatcatatcacaaataagcttctgtgactgactgacttcattcactgttaagttttctcttacgtagagttgtaacttactccttctttacccaaacctgtcgtggctgttttcactcctgttttacagatgaggaacctgaagaattaaacacttg

SEQ ID NO: 119335 - DNA, 1060 bp, Homo sapiens
ggagaggagatctccgatgtttcgtgcaccagtttaactttacatgtgaagaaactgaggcccagaagggtcaggccacttgcccaccatcacacagcctgttggtgacctagcacctgggaagagagggctacactccactgctctatgcactcttcccttaagtgggaaggcaaggaggggaccaatggcctgtggtgtccagcccatcctggcatcccatgggcctgtgattctctgcaagtgagagtggtggggcagcatggcagaacgggtggttccagcctgcccagtggctctggatttaggctattttcaagtcaacgctaaacttaccagggaattctgatggtctacaagctttctgcatctgtaagagctggaccagcccaccgagctctctcaatactaactagcatttaaaaataaataccttcactatttggcaacaggggaatcctctcctatcacaggaatcctctccctcttccctagggaacgttctgacagcatgtctgtctgaagaagcaaacgaatgtctgctttggtgaaaatgacattgaatgatttcaaccctggtttaaaacttacttttttggcaagataagagactagcatttcaaaatttaaaatctgttttatgacctttagagtcacaagcacttaaatggctaataaatggtttaatacaggtattagaataaaagctaagatctaatgtatttaacattaattcttattttcttaaattttatatactaaaactgggtaaattatatacatatatatgtctatcacctgtatgaaacacactgcataggacaactagacagaggatcaacaaggaaatagaagactggaacaacattttaaaccacctagacgtaacacacctatacaacccttcatccaataacagcagagggcatatgcttctcaagtgcacctgggacattctcgaggatagaccatatgttaggcaataaaacaagtcttaaaagtttaaaatgattaaaatcatacaaagtatgtcctccagcctcaatggaatgcaatgaga

SEQ ID NO: 119336 - DNA, 1146 bp, Homo sapiens
aacttgtaaatcttcaaggaacaagtgtcaagaggtttctgtggagaaaaatactctacaagttacccaggcagttctcttcggtttggagcaagggaacagtaacacagcacaaaactacaccagaagccctccttttaaggagctaagattgtgctgaattctcagtgtaacctgctggatcatggggagtagagtgtccatgcaagcatattcctcagaatacaggttacggaaaatagtttctcctctgggtgaaagttattcaatattcgctttagcgaagaggtcaaattaaattagttagttggcagccagtgagatccacccaattccgaggaaatgactgaggccaaagagggtgcttttcatctcttataattagagaaataatggtctcgttttcctgtggccaacattggtgttggccccaatggcatgttgcccctaaacccaggtggcattttcaccacgaggctccttcatgaattacttgggtccattgtaacgtgcactgagcacttggcctacactccatccagttcctgtgggggctgtgaggacaggaggatgggatgaacctgctcctccctttgaggagaagacttttaaggggactgccatccctaccttgacctcatcagttcttggctcaagctgatgtgctagacggttatccccaaggaggtgcatgaacacatggaaagagacggagccttgagtcagctgggaccctttccccggggaggagagccacccgggaacttcctggtcttggagctccccctccctgacctttctcccatgcctgggccccagtgtagctgtttagaaagacattgctcaacagcacactggctggagcttcacaagcaccattttcctgtagtggtgaatggaaacttttcttagcagaatgcttgactttacagaagcaacagttttctcggataaaactccacgtgcagtgatggattagcagctcacattgtgtctatggcggctttccttgttttaggacagggagagtcatggaaaggtggctggacttggggtagagcttttttctttctcttttaatatccatgggagggggttggaggagagacatcaggggcaagctgggcgggaacgagctgcaggagc

SEQ ID NO: 119337 - DNA, 1037 bp, Homo sapiens
ttgttttgggttctttttgtcttaaagacctcccagaatgagggtgggaacagctgaggtttgtttcatgtgttgtatattagttaatccttatggagttcacagtgtgacatcaggaacttatcacacacctcttgattttcaaaaattaaagctaagatctaagctttattagaatatcagaaatactacttatcctgaataaattttttaaaatgcagacattcctaactctcttttaaaactctgtttaacaactacctttttttcagtcactactttgatgaaccgaagttagctccatgggttacactgtccgttcaaggctttgcagacagccctgtttcttgggaaaaaaatgaacatggttttcgaaaaggaggagaacatttatataactttgtgatttttaataatcaggactattggcttcagatggctgttggggcaaatgatcactgtccaccataaaaaataaaaattaaaaatcgtgtttacttacatttacgcttgctttcagatttcttaatggtaaaaggtctgtgtgtccactcaggcttgtgtgatggtgacatttctcagatcagcatttgctggcatcctgccctgcacctgagacccatctgtgatggcagcaaggcctgctgtccagtgaatagctcatagttgatttctctctgtcaacataagcacagggttgtgggttactatgtggtacactgggccaggatgtccagggaccggggatattggtccccatctcactccattggttgagatatattttgttcattacaactttttcagataataaaaagaaatctcatccttaccagggccagtccctgttgtaagtgctgtttatatattaccatgttagaatctcacaccaaccctttgaggaaactgaggcacagtgtgtaaatacactaccgaagttatagtggcagtggacctgagacttgatctcaggccagcctagttcctaagtgtgttctcacgctaatgcctctggatcagagagggatcaatggata

SEQ ID NO: 119338 - DNA, 1047 bp, Homo sapiens
ccagtgccaccgcctgttgctgctgctgctgcaggaacttggccgcctgcaagatggggtcggcgggcaaggaaaaggagcgcgcgcggcagcggcggcggcattccagcagctcctcctgctcctggggggcggcctcttccttcggggacaggggcctatcccctagctgagcgtcaggactcggggtctccgaagcgccaccgccgtcgccgccaccctgcacacaggggaccaccggggcgggcagctcctcggccggcggggcctctcggaagggcgctggtcccggcgcctccaaacttagccgcgcccctatgggctccatgacgccgttcgcccctggacttgctcgggccgaaccgggcccctctggagacttaactaactcctcgggccgtggaaggagcgcagggctgcagttcaggctcgccctccccgaggcgagtcgccccaggctcgacaagacaacgtagttccactttggagcctccggcttttagctgcggctgcccagggcgaagtgggaggaggatgcgggcctggggccggctccggggccacgccgcctcccggttgaacctgcccgcgacgggggagggccgggggcggggaggcgcggccgctgggacacctggaagccgtgttcccgagtgctccggtggaatgcggggggcgactttctgtcgttcgcgggctccctgcagccctcacccgcacccccggcggggctcgcgtctgttccgcttcttgagtgcctcgaagtgggggtgcagagctcgcgctcaaccttcagagacccccacgtgcacaaagtcttcctgcccatgaacttggcctgacggctctgcccccagagggtcactgagcgctctcctcttggctgcctcacgggctggggagtccccggtgcagcgcgcaactggggaaatcttgcctacgcagaggctggaaggaggcccattccgcgccgccggagagcggggagcgcatcccttcccttctgctcctgctttccccaaacttcagggcgccccgggttccaat

SEQ ID NO: 119339 - DNA, 1010 bp, Homo sapiens
tttcagaggggaggaatgggtgtgtggatctctgtaacttctcacagtgagggaaacgggggttggatggtgctctagtggccggctttgccccgcagtgcagttgccggaagggagcagccctgggatggccgacgtttgtattagaaatgttaggaaatgttccttctggcctttcccaggggctagagggccacggttcctgacctgtgtcctttctttgccttcaggtccacattggccaactgtattcaactgacaagctgatcattgagaatcgagacatgcccaggacctagcaagccggggaccagccaccagtggcggccagggaccaccttcagcatccactctctgtttgagatgggggctcccaaaaccagcttacaatagccttttgcgctgcctgtcctgtgggagctgataaaccaagtcacatttgcattctgttgcaggcttagtgaaaaaggactgctgtctttccttggttcaagtgttagaatggagagctggagttcgttcagaatagtgctgtgtgttaccacgtctcccctgcaccccattcctaccttgtagctcatgaccattgtgtatagcatttctacactttgtttcttggtccttggcaataaaaagaatgatctccctgagcctttgaccccagataaacccctcccaattaatgcattttcatttcctactgatacaaggcctggagagggctgttgggggccctcagggagggttcaactctgagacgagaactgccttggtgaaggcaagttcaagcaccacttgagactgggggcagcatggagtagggcagggctacggggatacacggtgcaccctgcaacttatacctgagcccagtacaacaaaggtgacgggtgtgtaggtacacacccagagatggagcactgcagatcagcaacctcagccccacctgggaatttgctggaaatgcaggctcaagcccctccccacacctggtgaatgagagagcccca

SEQ ID NO: 119340 - DNA, 1041 bp, Homo sapiens
ccccagggtcttgaagggtttgtttccattcccctgagcattatactcagttggtgctggtggcctggctctggccaggtcactagcaaagggccaaggatgtgaaggtttttcatcactgtcttccaagggagaggaagccttgtgtttgcacagctctggaagagtcattgttctgcatcagaagagcttaggatacttctatcaaaaagtaaaggaaataatcttcatatctaaagggcttaactttgtggtaaactctgcagctttctataatagggtcccaaaggtaagtgacaggaacgtattactctaattcagaaataaaccatgtgcatggtgaaaggcgatgtcttcgcaaactgcccagaaggaaggtcttgtcccaccaatgggcagtgtcctcagggttagacccagagtcagtgtccctttgtcttgatgctgagaaaagtggatcagccgccttgtttgaaccaaaacgcacatcagaaatgggtccaaaggaaagccacttactgcaggctgagtttgtgggattcagaggtcagagtgcaaacccagagcttttctcactgagcttatcatcaaagccttcaaggtttgctttgcctaaaaagagctgagtccctcagatatctcagtttcctagttcatatgagtacattagaacgtcttgtccctaaacagcatgaagaatgctcctgggaggggtgcctccctctgccaggctcagctgcaggcttgtggcaactccatgtgtggtgaccactctgggattcttgttcctcttctgccagggcttgccctgagaccttacacaggtgactccttctcttggaattcattccttcgtccagcagagtggctgaggcaccacgcgaggcactgggaacaggccagggtcactgtgctcgaggaactgacaggtgaatgggggtgtttgctcacagcctgggtcatgggctccatcccggctgcctagaccaaaggttccatgtcgaggcaaccaaagcatgtgataggccaggactagttgat

SEQ ID NO: 119341 - DNA, 1046 bp, Homo sapiens
actggctgcccaagagaagccccaggcccttctctgctggtagcatctgctccctccaggtgctggcggcatcacctagtcatgcaggtgacatggggcctcacacaaaaaaatgtaaataaaagcaagattgatgagcttggtcataccccatgtagtagttcatatccagagtcctgtgggaacatcgaagtgtggacaaagaggaaaccaaaagaacagtaagagggttcaagagacatgttcacaaaatagttatgaggagggaaaagaggagggaagcatcttctccaaatgcacgtatttgtgactgtcacttcctctcaaggggcactgaaatctccagatatgatttccttccctgaagaggaagaagttaaaggtggctcctttttatctgccatctgtcagccaggcagccttgtcactttgactttcttcaaagagatgtactccaccactatgaagcccagtagttccatttactcctgagtgaggggtgagctagggacgcaatttgtatctacgaggccacagggcattcttattttgcaactccatatcacccctgtgtacagctgggagcagggtgtgtgagcggtgatgggtgccctgcttccaggatataaatgtcatcactgcagtcctcttcactatggcagcttctataaaatatttctctgcagacagtaagaaacctaaattgggattttcacttaatttttattaatccaagcagaaccaagtttgctttatagagaaatcaacaactgtaagacaccctctcccattgcctgcccagactcttcctcgtccaggtgctgatttgtctaccaccaaaaaaattgtaaaggatggtgtaaatgtcaatttctgggtttcatactatcctataattcggcaggatgtctccattggaggaaatagggtgaagggtacagggaccctctctctactattttttgcaacttcctgtgaatgtatatttatttcaaaattaaaagcaagggttaaaaatggtaaattgtaatgtaacaatgttgttt

SEQ ID NO: 119342 - DNA, 2067 bp, Homo sapiens
taaatcacttatacaatagctgtgaagagccaccttccagcacttgagaacccggcagccagtggctcacaaaggcctctgtcgccatctgctggccgcatgctttctcatgctgttaattcttgctctggtattttttgttcccgcagcctttggcactcaggttcttctgctgtaaaatttgcctccatcagagctgtattgccttgtgtttttgaggcttgcagaagagacccttagcactccttaaaattctggcaggacagagaaaacaagatggagagagatgacaaagccgatttcttcctcctggcttttttttaaccagttctgtgcactatcaggccctctgagcttaggcctatgccagccacatctcaaggccaaggacacaatactcggtttgtctttataataggtcctgttattgtgtctgtcaacctcccgatgtctgtatcacagtcaccaatatattacgctaaggaaataggaattattcacattgccagtaaaacttgcccatgtataagcacagactcacacagttatgggcctgaagaccatccccagtggcgaaactgtgccccagaggttgccataagtcactggagccagaaggcatatttgatcccctgtgtaagattggccaccgtaccctgaatgacagtggtgtgctgactcacacagaagatccgcttgtggtgcaggcttggcctcctcaatgtggccacaggccctagagcgctaacagatgtcacttatcgggatcacccctgaggcattgtgaacaggaagtggcatcactgatctcccaccagctctgaaccaatacatgtggcatcccaacttccggagaggctggacagagcatatccggaatgcagccacgtggggagtcagagtagggcaaggatataggagtgctgatgaaaactgaaaacacaggggaccggcccgcgatgcggcctcctgggagacatctgcatgaggccagcaggccaagggtccatggctggggatggctgcgctctccttagggaaaggcattccagaaactgaagttacgaggcagcgtagggaaagcatcctgggctcttcaaatctgggcatggctgtgagtcccaaagcgttgtcagtttacaccatctcctaatgcaagggctaagtcattagggaaaaaatcatgtttcaggttttaaggggaaaaaatgaaaaggtgcatggcctttacctgtaaacagtagaagggggtggggaatggttgaatggtagaaatgaaaatcaagaaatctagcaatggctggtgatttaaggaccttgtatatcagttattgctgcacagtaagtcatcccccaaaacttagtggcttcaaagaacaatcttcatttattgccacatcccacttctataggtcaagaattcagacagggcatggcgaggggggcttgtgttgctccacagtgattgaacctcagctggaagattggaaagctgggggcaggaatcatcttttacttagctgtctggaggttgatgctagttgtgagccaggagtctggccagggtgtcagccagaacatagcacatatggcctcactgtaacctgggcttcctcacaacatggcggctgggttccaaaggcaagagtcccagcagagagagccacacagaagccatattttctctacggcatagcctcaggagttgtacagcgtcacctccactgtcaaggttatagaacctgtccaggttcacatagagagaacacaaaccccttcactcagtagaggagggtccattcattgtaatacaatcattggaaaacaccatctgccacaccggtttccttatcacctgtacccgcatcccccccgacacatgcacagaaacagggcagcctgtcacagaccctcagcgatcatggcatgggtttgtgctgggtaaataggtgcgtttgtgggtcagctctgcttctggtttgtagtttgacctggtcttaacctctctggatctcagtttcttcttctgggaaacaaaaaggctgagctccaaacccagtcattgga

SEQ ID NO: 119343 - DNA, 1221 bp, Homo sapiens
ctaggactgaatacgggaaacatgctactaaactgcccctgaactcacaggcttgtgatgtgtggtggatgagacacagcccgtgctgaggcaggcaggtctgaatccagtgccagaagcaccatgtgccatgaggtggcattcgaatatttggagcaatgaagcgatctcattgaatgtatatatatgctagaggaattgcaatcatgagaaaaattaattgcagagttgatcgtagaggcatagtgtccaggcagaaacctaatccaagcaagagatcatttgacggctgagggaagagagagccaaggggaatggagtggaatggaatggaatgcaggaactctagaggggatttaaaggctgaatatgctggtttgcgggcttgagttaggagcccacctctagcagtcaatattactagagcattggtggtgaagccgtgggtgtaaataagaccacgtgaagtgggcgtatattaaagacatattggtgacctttctgatgttttctaccatttcatattaataggcatgaggatcgaaaataggaaatgatttttcttttctcctccctggcagccttctctgctgtgatgttttttcctcataaggctggggtcctattgctttcccttctgatgaagcttttttattacttggtgggtagagggccttaggtgtggcagagaaattccgcagcctcgccctcgccgtcatagtgatgaagagcgttgactccggagtcaccaagggaaattaagcacatgttttattaatctttatgaacctcagtttcctctcctgcaaaatgagaacaatactggtgccgacttcgcagcactgtttgcagcgtgagggcgataaggcacttacacaggcgcgtgccccccacatggaaatgcctggagatgctgccggctcctccactcaccgaaactgcactttctctcctttgttctaaatgagaaaccaggtgtggggagcaaatgggagaaaggggcaggagaagcttgcctcagattccaactcatatgacctgtcagtgactaaagacggaatgccaacacatggattgtgtgtgtgaaatgccaggttggtgttttccacagggatgtgcccgttgttctctgctttctgtggaattctcttccagcgccaggcctggagatggggcctgcccttttacctctcaaatatgttcccagggaagagtgtgtcc

SEQ ID NO: 119344 - DNA, 1059 bp, Homo sapiens
ggaatccatgtataaaacaggtagtcacatgagcatatgtaaagtttggttaagcaaattcaaggactttttctacttacctagggccagtatattctgtggacattgataacccatagtttcaactgtaacctcacattgatccccagttttcagagaaagaggacaccatctacttctggtcactggcattttaggtgaaatcctgcagtgattgtttactggtagcctaattaggtacgttatccattatttaacccaaaatccaggttaaaatatgacatcagtgactttagctagaccataactacacacgtttacttcctggagtcattaaactgcttaaagaaaacaaaatcccagcacacccttgttttgttaaggtaacaaaatgagctcgtatcaaacataaatacaggtttaaattactgtaaaatttttttgtggactcaaacacaaacatcacagcaaagcttacctgtgacccaattaggatcatcatgaaaacataaatcccagttctactcaagtaataccaatggcctggtaccaatggcttccagcaggccactggggtttgactgccaactaggaaaagcccctgcctctgggggatagatgatggggaaatcattccatccatctcagtgctgagctctcacatgctcttctgcttttctgtaaattgacctaaaatggccatctttgatggtctctcactttccctctaaatccctgatgtgagaatgtattggaattatttcatgtaacagtgtgtctgcccacagaccggcctcctggctccagcttagcagtgtccaacagtaaaaatagaaaagcccctgagtcttgtcttcttttgagaggaaagaacccttttgcagaaggcccaggaaccccctcctctagccactttggccagagttgtggtatgcaattattcctaagctgttcactggacaggtagctgggccccaccacaactgcctaacgtcaagcaagattgatgcctgggggctgtgctgggaagaggcccgcttcagggggaaattggggctg

SEQ ID NO: 119345 - DNA, 2205 bp, Homo sapiens
cctgacctcatgatctgcccaccttggcctcccaaagtcctgggattacaggcttgagccaccgcgcccggccgaatccgcctttctttttaatctgtatgaggtgttgggttgtcttctgatgtttccatctgtgtcctgtgtgatcgtagatactgcatgccactctctgtccagcacgtgatgccctttgcaacctcctttctcacccaccctggggcttgggagctggagatgggggaataggggtggtcagtgaaatattaaaaatcagactcctatagacacagtttgcaggtgttatatggagttccttctactgtttcattctactgcattacatttttatgttaacttaataggctaatattttatgaacttgtaagattgaatatatggaatgaaatcaatgtttctgataattacttgatggggtggggagtttcaggagaaagtcatttaaaacctccagactgatattgattaaaattagtggcttaaagatttagaatatctaatttatagggtttttttcttggttgactctataacttaggtaaaaaaatgtttccgtagcttttatgataacatttagcaggtaattttctttactagatgtagggaagagccagcaatttacaatcagagcattccatatatccctgtttagggcgtttcagggtttattgctgcaatttagcatttttatctgggatgttcaacttctaagggacgggctctctgtttgctgttttaaaattattagagtctttcattgtatctgtctgtattcacagcatatatggtcatttcatttgagtgttcatgaacagccctcaatatatcagtgattactttatgtgtcgagcaccgtacaacagtggttgccagttctgactacacatcaggatgtatttttgaagacttacagaggtgattttgttgagcatcactgttgaaaaccacaggttttccaagagtgtccgtgtgtatttcacatggctttactcgtcaggaggtactggtgattgcctctttcacaaaagaggaaactgaggctctggaaggttctgtgagttgcccccggtcacaccgaacagcagcacttcatcaagttagtttccagatgtccagcttctctctgcccagctgggcaggcacaagagacttgctgtgttatgacctggtgtcttagttttgtttaagattagcaagggcgccaggtgtggtggttcacacttgtaatcccagcacttttggaggctgaggtgggcgggtcacttgaggtcaggagtttgacagcaacctggccaccatggcaaaacaccatctctcctaaaatataaaaattagccaggcgtgttggtgcacacctgtaatcccagctactcaggaggctgaggcaggagaattgctggaacccaggaggcgaggcagagctgagatcacacgactgcactccagcctgaacgacagaacgagaccctctctcacacaaaaaaaataataataagattaccaatggttcaacagaaacaaaaccaacagcctagtgtattgtgacagtcctgggacacagaggcagaattaggtacgtactgccttcatttaaggaacctgcaagcccagcggccttaagtatgctactaaggatatagtactagttgtcacataaataaaattctaaatcctgtcattaaataagccacccttatgcctttctcatctggcagcaagtttgtcagcacagggcagtgggtaaagagttgccgtctgctgcgtgtttccatttgccccgtgacctagcctggaattcctaccagccaacaacagaggaggcccaagaggaaggctttccccagaaacacgcagtcccatcccctggaaacagttccatgagcacattagcttagctgattatgagagtagctaggcatcagctcaggcactgagtaaagcagacctttgtaatggggctgagggaggaagcgtgtacaacagaggggaacagccaggccggagacagacacgcagctggggctgcctcacttctccgtttgcctccaccagccatgccttctgactggacattttcaccaaagaagatacgatggggtatagtttttaaaaaaatattagaaggatggcagattattaaaagccagctctcgccccctatttaatctagtacgtcatgccggcact

SEQ ID NO: 119346 - DNA, 1041 bp, Homo sapiens
cactccaaagacctggaccattagcaggcacctgtggtcccagcacctctcctaggacccaggggctctccacctgaagcacagtgccttgctggaaggagccgcctcttggccactctgcagaaaaaggggctgtgagcctcagcttcatgaacggctgccttgcatgttgagcttaggctgtatctttggaacacagtcttcctcttcagagctaacttcgtttcatcatcctggatttgataagggttattcattctagctctttgcctcctattttggcaaacactccagaagacagatgataccatcctattgaaaaaatgactgttgaataacagattataaatctgtgtgtttcctctggagaactgtgtgtgaaatgagaacattgggtttgtccagcctgcctccaaacatatctcaagatgtttctctctgcctgttgtccttagccataggagacaactaatgtgtatttcacagggaacatgtataatactttggaacatacacaattccgagaggtgtaacataccagagacctttgctttttcctttgctttgcttaatgccttaaactttcctaagtgctcctccgtacattaacatgtgagccttcaaagtagctgggagaggctatccatacgttttgctgccaagaaaaacaggcccaacactttacaacagaataatggcaggaccagtgtgagaatcctggttttctggtaggctggttccctgacatcctggttcagcaacgtatcatccttaaaagatatataaatgttggcatgactacccagcctttccaacacccacagccagtgaaacccagttactgaaaaatgatggaaagtaccagcatcagtaatttccttctgtgtatatgatctcagtggctgaggaattgcctagtagcctagtaaagacggactctgaaaactgtcctgtttctgtagtagtatttattagtaatccatctcagccgggctcagaggctcacacctgtaatcccaccacaatgggaggccaaggcag

SEQ ID NO: 119347 - DNA, 2227 bp, Homo sapiens
aggcatggtggtgcatgcctgtaacctcagctactcgggaggctgaggcaggagaatagcttgaacccaggaggcagaagttgcagtgagccaagatcgtgccactctagcctgggtgatagtgagactctatctcaaaaaaaaaaaaaaaaaattaatgcagtcctgggactagcaaattttcttttgcagaaactgagacgctcattcaaaaattcacatgaaaatgcaaatggccaagaacagccaaggaattcttaaaaaaaaaaaaaaaaagttggaatgcttctgccaccagatgccaagcctgttctaaagctctggtaatgaagggagtgtggcgttggtgcgaggctaggcaaactgatcggtgaaacagaacagcctgcagaaagaaacccacttttatacagtcacctgattatgtcaaaggtggcgtgcagtgcagtgggcatggcacggccttgtcaataaatggatttagccaatgggattgctatttgaagggaaagatgtcttgaccccttcctcataccatacatgaaatggattgtagatttaaatgggaatggtgaaacaatgaagtgttggaggaaacaaaaaacacctttgtaaacttggagcaggcaaagacttcttaaacaggacacaaaagagtgaaccataaaaggaaaaaattaatacattggaccatattaaaattatggtatcagagtaactattattgagagaatgaaaaagtagaatgaaaaggaagaaaacatatgaaaaatttatatccacaatatataaagaatcctacaaatcgatttttttaaggctgaaaaccaacttttaaaaataggtaaagacttgaatgttcactttacaaaaggccatatccagatagccaattaacatacaaggattccatcttttattgttatcagtttccctttcgtctaatgagagaatatgtatgtaattcaactattcaaatactctatactaatgacgttcttaaagagtatgtttataaagcattggcattgtgtatgattgcattaaagtacaacatcctttaaatattactgtttaggctcatgatgttttggtgccatagacatataaacatacagaatctaaaggatgcaacagcaggaaacaccagatggcttcacagatacttataaccctttggaaaaagtttttccattaccatgaaatgtgagcaaacagatctcccctgccacctgcctcctgtctttctctttctctctctctctctctctctctcgctcgctctctgtcgctccatctctgagctgtagacatcacatccctgacccagggccacatcaggctcactgtcgagggtcagtagtgtcatccttcgggaaacactgaagggacatatgaggagcaatgatgaagtaaggaggcctcttgtgtgctctgcctggagacttagtgggatttttaaaaataaggtaaatgaaatgggtgtaaaattgacacaaagaccaagttaaaacattctgctctgatacatactgattgaaatcatctagcgagctttagaaactagcagtgcctgaggccaagagtgtagccaggtgattctgcagtgcaggcagggttgacagccttggtggtgctcagtcctctcatagttaaagctgaaatgccatgctcaccctcctgagcaaccctgttaggctacatgacttgtgttgtggctgggttggggaggagttctttttacactttttttctgggggttgttgtaaatcctgggaatgagtaacagaaagtggtaagagtgtcttttcatgaagatgctcacagatttcctaaagagatagacttccctcccttcctaatcaccccttgagaacctcgctgaagataatgggcacccagtgttatctcagcagagagagctcttgcaaacaagaaaggcctagatcgttcatgtgtcccttcgtctttccttctcctcagccctactacactgatcaggagttcatgagcgtaacgcaagtatgtcaatactgtgaaagcacagggctccaacagcctcctccaatgagaaatgtagtggtaggagctgttttaatttttatttcttaaatgctattgtgaatacagatatactgtcatgaaaatacatctctgagatatttacatatttcatacagccctttgcaactgctttcttcagcagttaaaatcttactctcctctt

SEQ ID NO: 119348 - DNA, 1041 bp, Homo sapiens
atttggtttgaatggctttttggttttgacaagtttcaggtgtatatacgtgttgtttgtttctctcccttgaatataacaacttatatcgaaggaaaagaatcaaacactctgaataattcaactttcattcattcacatacaaatggtcccagttcatccaagcgagcttttgaaaaagaatatttcattcctccttgattttaagcaacttatcactttcctcctgtctccaaaagtaaccatgtgaaacccagaccaataatttgtttcatctgtgcttaagtctcacctgatgtggtgatgataatatacatcccaacgtgggttattttggggataaaatgactcggttttttctctcttctactcttggaccgatatcctagaacaaataggacaagtaggaaaaggcttcaatacaataatgttgtctgctctctttctaccctgcccccaaaatcaacagtcagtagaataccttgaaaacaaatgaagaataactgcatgatctattcagcttaaacagtgggctggagtatcacgtgacagggctttctaaaatgattgtcaaacactcagctctccgctgtttatgtcatgatatggccatgtcaggtaacttctgtgctttcttaaatgaaacctttaaatacttgatgtggtttttaaaagtttttctatgaacggctttcaaaactaccacagtctatttgtagtgatagttactgtaatgtgtttcttaaaaaattttaagtttttaatgcattaccaaagctgaggtaaatacaaacacagaacagcatattcttcaggttagctcttcacggcacttgctattctcatgtgtccgaatttatttttattgaaatatgtgttataattacagttttatataagtttataattttaaaaaaaacactaaaattatccatctagccattcagtatactcgtttgcttaaataatctaaatttcttccataattcgtagtttcatttgagaattttttagtgaattatatgtgaagctcaatcacag

SEQ ID NO: 119349 - DNA, 1048 bp, Homo sapiens
gtcactgttatgtttatggactctcttccaatggagtggtgatttacagtgttctgtcctagaaattgatgaactctgagtaggttttcccccattcataattcttcccgtatcccttcaacctaaaaatcatgataaaaaacaatttaaagatgctgtataaatctgccatgtttgataaaacaggggaaatctcatcacctacaatgacagtggtgtaaaagccctgcattttgtatacttttgcttcatgagggttttcgccacagaaagaggtgctttgtcagcacgttagactcttaaaatgtttatacggttggttaacaagcaccagcaaaatggtaacaactgcttatcgattcttatatcgagtacgggaaaaatttaaactccctgatttatttctgcttataaaaatatttcctggctttcttttagccttcactgtttctccccccaccacttcccctaacacacacaccaggaatcatttatttttgtttgatgttggtgtgtctttctcaggcaagaggtataaactggaggccagaataggtcttccaaatgttagatgctgaatggctttagtgattcacagttgtaaacataggagctggagggatggaggactctcccgaaacagtgttttagtgttgtgcctgacaggaaaggagagttagggtaggagctggagagggatgtaacgtagatggatgactaggggtttggttggcattaggaggggtggcttaagggaagtattgcttttttattacacagataatctgtggttattgtaataatatttgagggtagaaagaatattcataatctttttatcatgaaatattattttcatgtatatcctttcaaaatgttattccacagatagataaatatgaatgcatagttttccttaaatggaatcctactaatcatttataacttacttttattatttcctaatttcaaattaacatctttcatcagtaaaaaatatgcctgcatcatcagtttaaaatggacacatagggtacactcaacgcag

SEQ ID NO: 119350 - DNA, 1183 bp, Homo sapiens
cataatttagttgaatttcaaatgtgttaatgtaggatatcattcatagaaaagaaaaggattgtaattttacacatcatgtttaactttttaaagtgtggcatctttaatgcaggtatttgttcttagaactcttattgtatgactgattcagacttcgtgattcattagccctacaaatctcgagaacatacatgaatgtgctcatacagaggttagaaacttgggctagctcaagggtagcctaagagaatattggagacagaaggttctcattccttgagcagtgctcagagcatagctccatgtatagtgagcataacagcgttgatgtgtctgattggtgtgttggtattaacaaacatgtaatggcacagaggacaggaaatttcattacatctctggcaaattcatattgaaagaaagaaggacagatggttgaaaacagccataaaatattctattacatgtctgcagaagtcattagcagttaaagagatgttattaatggatcagattcacttggggagtcatgtttctataatgcacattaaagcaatgatacttccggtatttttaatgcagtcagggccaaagacaaacctgtctttctgaataattagaaaatggatttattggcagtgaagaagctgctcttcagcttgactccagatcatttggggaggttgtttttatcatctaatgtgaaagagtagaatgtaactggctgctagccctataggtcactgaaataatgccatattgctttattagtattttgggggagaaaggaaggaataaaattagtatttctgaaaatcatcaaggaataattttagtctctcaagtgccttaacgtgtctctttagaattaatgcaaacatcagggttttgactttgtgagcatgagaatgatttttggtgcgtgtttctgtctgtgtgataaacaaaacagtgtctgtgagatgctggggagccctttggaccaggtgcagtcatttgtgtggtcctccctttgcagagaggaactttcagccccacaggtccaggatgtgagaacacgagatgctcagtccctgggaggagagctttccttagggcatctcacatttcaaagcagggtagggtcggggcagcttagtgacgctagcatcaaagcaaaaggaagggaggtgctcgtgaa

SEQ ID NO: 119351 - DNA, 2023 bp, Homo sapiens
tatttttttggtcaaaggagtcacaggctcagattcaaagtgtgggaacatagacccccgattctcaatggcaggggtgtcacaaaatgtgtgaccctgttttaaaaccaccacaggccccctctccttagtattccactggccctttatcctggaaacctcaggaaatggtttttcctgattttcttctttaattctcctctcccatcccttcctcaatccagttcaaggataagggcctagaactccacctgtgtcctattccctcttgaatccacaggtcgagcaggaaagtgaaggatgaggctggcatgtgtagaagtgccagtggagggcgctgtggctgactagaaggcctctacgttttaaaggacagctgttccaaacggaggtgggaatgaagtccttgtgtttccagatttcccattttaatgtgaaattagatattgaaatattgcttcataatgttttaaaagcataccatgagatctgggtttatgctcttgtctatgcactggctctgagcccctctttgaaagacccagaactcataaaacaaggcattatttaagattgcacatttatgtttatccccagaaatttccacattggggtctggaatgccattgcttctttaaatactacttactttaaatcatatttgcaaagaattcttgtaactgagaatctaggcgctcaataaatagaccgcatccttccttcatctgcacatgaatggcagcattttgtgcattaattacgtgtgtgatgtgtctaagctgaattggctgaggagcagaactttaatgattagctgtataaaactgaaagagagcttcaattttgacgttaagccttgcttatcttttatattctcagcctttctcgacgtttgttagaatttaaacttgtcctaagcatgacaacatctgttcaaaagagaggggggataatatatgtttatatatacacaccttaatttagtattggggaccttccagttaccaattataagtgtaaagactaaataaaagttatagaaaattagacaaaataaacagtgaccaagagaagatttaagaaatctgaagctaaagatttatttttctgcctgccctccttgaagtaaccattaagtttataaatagcctccttcctctgagaagaaaggtcctagtgacaccaaacaggatgcgacgcgctgagtactctcccctttcattttgaaactcgagcttttgtgaagactatcattgtgcatccgtctgtctctcctcattaccacttctggttggagccggaagcaggacagatgcatatagtcctcatttcaaccacaggaattgactttaaaggtgacactgtccttagtaacacagctgatgccctgtaggggtaaaattagttgtgttttctctgtgcaggtgaaattttaatgaattttttgatactctgtagagcattcactgcaaaatgcgttgtaagctctaaacaccaacagctgattgtgaaagactctttattttttctttgccctaacttaaaaaaaaacagagaatgtttccagagaatctactaaggaaaacatcaggtctgacaacaaaagagaactgagagagcgaagaggaggcagctttctgcactttgcacactgggttgcagttctcacagaatcctggggctcaggacaaaatggaagcttcctccttggacctgcatttaccccaggcctcgaaacaaagccccccagtctatagtttccagtgtcacttcacagatcttttcataccacagcaacccatactgccaggaatctgcctgttgtctccagcacagcttcctattgaaagcaactctatgtctaacctgccttaaagcaggttacggctatattttaaaacccaccgcattaattcaggacatatctttttatcaaatggatttctcttctgcatacatatttaaacatgagccgtacactcagagcaatggactgttttatgaaaggtgattagcatatagt

SEQ ID NO: 119352 - DNA, 1252 bp, Homo sapiens
ctatgttgccaggtgttctgctagacaccagggatataagatgaaaagacaattttagtcactgctcttaagctggtgacactcttaggggaagacagacattctcacaagtaattaaatacttagttaaaaaaaaaatagtggcatatgtgggtatagtgagagcccagggtgagcagtggctttcagaaatgttttaaacaaagacgtcatccccagaatgcattatcccccaagttggcagtgttgaggagcgcgtgaggcctagtatgttcttggaaagaaatctttatttcctgagaatcacttctcatccctgtataaatgcatctgacctgtttgtaagagtatgaaacagacactgctatgtgtgataacttgtcctcgagcccctcaaactcttcagagaagataacaagtcacagcatcttgtgactctagttggatttttttattagtcacggaaataacctggtgccgtaaggatacatttgacagctgtagctaaaaggattaaagaaaatacataaatgaaagattcctcaagccagagcggcaggacagaaacagcatgtcctaacaaggcaacgtgggagactgggtctagaggtcaattcaacaatggtcacctgaatgatcattgtgttgacaccaagagcttgtgtctcactgaatggtgccccctagagaggcaggcagtgcctaggaaggggtcatcccggagagctgggtaggctttccagtcagatgactgagttccaagcgattaaaatgtttgggtgcagtactcctccaaggacatgcttatccctaactgttactgcattactaggaaaacttctttgttcagtctgtaagaggactgtggcatttgaggacagccttaagaagatattaagtagcagagaatcttctacgctcacctgtgatttcagcagtggtcacacctgttaagagcagagttcttttaaacacacggggaagacacaggaggccttgagagtcctctggcagctgtcgatggtgcaactgtattcgcacttttccatattttcccttcctattggcattctcaagttttgtgcacatgtatgacatttacacagtaggggatctattgagatattttcaaacagtcaacaatcctaatcaaaatgtgtgctactgaaataagttatttggagtattaaaacaagtatcttcctgtggacaacactactcatttgtaattatgtgatgggaagcttgggga

SEQ ID NO: 119353 - DNA, 4266 bp, Homo sapiens
gtttaatacctactgccttctaatggggaaaaagaaaatttcaacttcttttctcttaaagggacagctcttttgaagaaggaagagaggttatccagttataattttgaacccctttcttgtgaaactccatgccactcgccatttatatcctgctttagattgttggggtttatttatttgaatacctacaaagtggacatctcgggatcattatcgttaagaatatgtatgaaaaaaatttgtcttcaatgcaggcaagtctgaagataagaaaatggactagattaccacttagtttcttgtataaaagctttgatacacaagaaaaaaaaagtatgacttttggttcttactctttaaaaaaatggacaagtaaaaattgtatgtatttatggtgtgcaacatgatgttttgttagatgtgtacattgtgaaatgatttaatccagttaccacatccattacttcacatacttaccatttgtttatggtgagaacattcgaggtccactttcttagcagttttcaagtatgcaatacattattattaatagcctccatgttatacaatagatctgcagtggttcttactattcttaacagctcaagtggagcattaaataagattcaggcttgccttcttatttagttgtcagactgtttttctccaattttgtttatttctagtcacataattgcacagccgaaagatgagaaattaccacttctgtgccatacacttgattttgtcggtctaaagggggagaagaggggtgtgggaatagagagagaactgaggtttgatgtgaaattcaaaattggagattgtagaggcatagcagaattactcagtagtaagcttattctccagaaatttttttaccaactttattgcattggtgcaagttcattccttttgaataggaaacctttgctatactgtatatgattatggctataataataatagcagttaccatttaatgcattgcttatatgctacatgctataacctgttttcactgactaaggataaaaaaaaatgcatgccactgaaagctgcagaattctacatttaagtatttaagatgatttctcccacagcagatgaaggatgttgtgcagggatagagcacagggaacctttcatttgtgcatcataggaaaggtggaattagaacacagtacttttattttctctttcttcctccaaccatgtccccataagctctagattagccagctagaggcctcatctctgaatgtctttctaaataaatacacgttggctgtaggttagttttggtagcacatggagcctaaaccctggagagaggaaagtggggtgaagggaagaaaaagctttagtaatgaaataatataaatgtgccaggtactttcacttaaaatctaagatttatgctttcattatagtctctacaactgtatgtggcaaatgctagattataaaaatcatgcatgcagattaaatcttttacaataaaaaattctctataacataaaatattctccactctcaggcaatggcctccttcaaaactgatgcatttcagctaaaaaaatatagaaggtccatgaatgtcaagcaaaattagatttaactagtaattcaggtgttatacaggccacactgattactgtcctctctcatggctgattaaaggatgtgtctaaacagtggttctcaaacagggttacctttttaaaatacacatattcaggctcgtagttctgagcccctgggctctcctaaagtcattgttctaaaccactcttaggatgaagagagagatgtgtatgatatacaactaaagtattgatgggttttcaatatctagagggcttatgaccatgtataagtttattctcagttgaatgatcaatttattaattttacacatctaataaatgaaactttaaaatgaatttttgttaaacatttaagcattgattaaaagctaaattatatttctataaccaatttaaaaagcagttgctaatctaatatggctgtttcttttaaagtcttcaaacaccttgaagggtaactaaaacaacacaaaaatagtcattacaaaaccagttactacatttacaattccacctatttcaaaatattgacatcattggtttaattcaaatctcattctttctgcataacatcataggggttcagaaatgtcacattaattaatacctgtctcagttaaaaacaaaagaaaaaaaatagctgcagttacaggacctggaggagatatcacctgattcctggacagggcactggtcaccagtctggactgcctcattatgggcgaagttcatttgttataaagtttacttattacaaagtatgtctggggattgggggggaggtatttttttgcttggttcaacaggaatgctcttaacagcaataaggaacaaaggggatccatgtgaaggaaggagagttctcttagagacagactgagtctaagatgctagcattgtgtcttctaggtacattgagcaggcaggtgaaaatgcagacctagagctcagaggccatctgggcaggaggcctgagtttggaagtcatctggtaagaggtgaagctggactatattacctagagggagtgactagaaagagaagaggctgagaagagcagtaggaagaagagagttgtgaaatgggatgtttggcaacatctcttagagagagctcggcagggaggccagttgagcatggcccgtgggaaagaatggaatctgctcacaggggacctggagccagggcgtggtcaggaggcaggggcaccagacctagaggagcagtgtggtggtgaagaggaggagaggacacagggaccatttgaaaatctagggaatgggcagatgggcccgcgtggggtcttgttttgttttctttggattttaggttgtggtttttataaggatgtaaagattgtattgtgtgtgttgacggggaggaaaaagccaatgcaaaagaaatcattgacgacacaatacagggtagaaaaccattcatggagcctggtcccagggcaatgaggggaaagtagggtttcctacgtgagtcctcgatacatcgtggaagaaaagagggagaggacaaatgagagctatgcaggacaattctaaggcaaagaagttggagaagctcacattttcttttcccaccttgtcattcctctttcaaccaggtttgtggttttgtttttttaaaaacaaacaaacgaaaaccttgtaattgtgtaatcaaatatttcaattatttctttcatggttttgtttatttggcgtgaaaattcatcttaaatgggcgtgatcctttcaaaaaattaaatgaagaaagcaaaactctgtgcataaagtctgcattgtaggattaagatgtattgcttgagaaaagtgaaaagggttcaataataatgtagtggatgtagggagggtgagaggcactccattaacaatgggttcaaggatagctgtacagcagtgataacaaaggtgagtgacatacttcactagcaagaccagtcagtcctgttttacagtgttctggcgcacatgggagagagagattggtgccatcttccccaggctaggattggcaaggagaatgcagcaatagaagttaggtgaagcaagggtatccacgagagcatcgctgcagtgattggtcaccaggtccacgctggcagagcagctgagaggctggaggcaactctgggccaggaaaataggaggaaccaacgaaccagagatcatgttgaggaagagcaagctcaggggtgacagattgagaaaagtgggaagacaggaaactgagtcaaagtctagggctcaaatatgttctaaatggtggtgagatccaagctgcaacctacctaaggttaggtaacattagggaggcaatgaggatctacatttgaggatgctagggcctgtgtagagccaggctgtttggaagatctttagcatagatgctgagcctaaaaatgcagactgaatattgacaggaaaactgagctcggtattgacattgtcacagtaaggaaatcacgagataacagtcacacgcttaggaagatgttcaatcctgccacggtgtacacctgtgccaccatacatggtagccccggggaacggctgctgtctgtggagcagcaggaggtgtaaactgcggaagaatccacaggttctgtagagacctctaggattaccagcccttcagattt

SEQ ID NO: 119354 - DNA, 1092 bp, Homo sapiens
ttttgtggcacatgactggtttttggaattcagtgttttcagtcacatgagagatagtcaagttatcacgctctgcatgcctgcatgtgtgtgtccctcctgtgtatattacggggaaatgattttaattaaataaatatcatttaattgaatatttaatgccagagcctattagaacagatacggtgttactacagaataccaagtgaatttttttctaaatgggctttttcctaagcagagttacattgtgctaaaatacatccatccatctatctatatatcaggagagcatttagaagtcactgctacttaaaaatgttgagcattctcagtttgagccaaattggtttttaaattaaaaaaaaaagcctcaaggaaatcaaatgctttgagtctattaaggaatttactgagactccagtagtatctactctgtgtacttagcataatactttattattccaaaatcaactcagaactgattccaagaaaatcctaggaaaaaattaaagtgaggaggaaataatccctttgtgcggtgtttgaggcaaattagaaagcaggagtctctgaactcaaatctggttctgtcattaaatcactaaaggacttgggaaaattagataaattctttttgttctatctattaaatggagacaacagtatcagcctacttttctagaccaggaaaacaattctttgtgtcagatcaacctctgttatataaagatttcttgaacacagtagtactacagggaaaaccctggattggggagaacagtgattcgattcatagattaggtgaagcatgtactgatttttttagacaggtgatttagccacctttgtgtgttttacttttttgctttttgaactcttctcactctcatggctagcatcgtagacaaatttaaaagctcttaaagtcatgctcatcgacaaaatggagttattagtagctcttaattttcctgtcttaggcaccatgtggaataatgtagagcttcatggtgccttgcggctggaatttcagtcacccgaaatgcatgtcagagcaccaggactagtggcttactggccttcagacag

SEQ ID NO: 119355 - DNA, 1850 bp, Homo sapiens
tggggtggccaaaaaccactttggaaaggcctgttggaacaagtacttcttgcccaaacatctgaacagaaggccctttgctgagttaggccacatggtccatccagtgcccacatcatccttttgcagcctcttgggatggcatagaaagttcatattcctcctgtttgtatgtaaggaggttggacattgggaaatcaggctgcccctggaagttggaacatcaaaggcaagtccaggaaccacatactgcacaatgagccaggcccctctgcctgtcagtttgtctctggacttccatggaatacaggtattgtagacacacaaacccttcacacaatgcaatttactcacctttacctgtgggagaattctatgtatgtgaattcagacatgctgaaaatacagaaagatcatatatagtaatgttcttgtcagggcactttgtttacacaaattcattataaaaatttagaattgcaaagtgtaattcagttaattgagcacctgcaaaaacaagttttggtcatggttattcactgattatggaggctgaagcagttaacttttcatttatgttttatataccaggtgccgcaggcatggatcatttcatgaaagaggatgaccctgcagggcctccttattttgcagatgaggaaactgaggctcagagaagttaagaaatgagctcagagaggttaaggagcttaagactccgcagccagtaatggttgatgccaggatttgagctgaggtctccatcaccatatcatgctgcctcccaataggatcctttaattgcattttaatagaatgaattttattaaaattttaggtagatatactttcgtagccttggctaaccccttccaactgagagccagtgacttgctgaaagtcagagtgcctctctggggaaggcacccacagccccgtgattcctgactgccccgtcttggtgccctggatcttcaggagcgcacagagagaaatgaggtgcagggggtcactgccagcaggtttggaaagacagatggttccctctggagcaacaaacagattagctaagcaggtgacccagcagggcagccccagagctgagcgcagaaggctgaaaagaggatttagccagctcggtgaactgattcacccaaagaaaagtaagacagtttgtggcatgagcttgtcaacccctttaccccttgccagttgatgatgatttgatgcattggtatgtttccaggccactctcagggatctgaaattcttggctagacagggaagagcatttgagcctgcccgtgcacttgcactgccaggactagcaagcagtgccaaggtttgcctgatcacttgtccccatccttgatggggacaagaaaactaaaggaatttttcttttgatggcaaaagaaaactaaaggaagactgatacattccatatcagatacccatgttgcactctaaattactctcctcagatactttaaacccttcacagctggagttttccattatctaagcacttgtaatatttggaaagaaaaaccataaccaatctcaaaacaaccatgattcactcccccacaaaaaatgaaaaattaatcttaattttaaaatattttgttcttatacattacagtacacttggaatttcattcaactttctgttttacacggtattactgggtgaacaaaaggctttctggctctgagggtatcttcaaagacgggacttttaccttataccagtggttatcagccctgactgtacgtcagaaccacctacagtgcttgtacagaccagtctactccagaccagttgaatttgaatctctgagtgtggg

SEQ ID NO: 119356 - DNA, 1080 bp, Homo sapiens
aaaaaaaggagagagggtaagcagtgaggcaagtggttccttccttgtgaggctctgactagcgctcagtgagtctgcatttcacatgggaagagagggagggagaagtcagttacctgtttgggagcagaaggaaggcagtttttgtgtgactcacttcccaagcttccctttccctttggcatcatgagtttggggtccttcgattctgcttttctttcacaccagtgagtcctgttatccttaactaacaaacactcagactaaaactcctcctttacttgaggaagtgggcatatccctttccagaaaagaagccaaggaaactagagtattcccctgtcccccagcccacccccagagtcagttgaaaagaaaaggtgatccatgaggtaagttccagcaggatgaaaggagactgtggaactcttttattttccctggtgccccacgggaaggcatgaaggcacaggcccaggagtacaacaggagtggtttcaagtcctggctatcactcccaagctttatgagtttaggcaaatgactttctgtgggactctttctcttctgtaaaataggcataattgtctgcccttcctaggggtgtgaaggagactgacaatgtttgtgaggcacacagcacagcgctgggcccatgataagtgttcagtaagtaagagacagctgcagcctcatctatacttcaaactgctttttccttactacttttaaaaactcaagtgctaaaacaaatcctgatggagacgttcccactttggtttcagccccataagtgtgcggaaagggagcagctgtccgttcttctttcatgtgcttctgctctccagccgcttagacgcaacacgaggggccctgcccagctgcaggctctcggcatgctgttcttgttataatacacgtctgacttccccggccgcttttcagtgcattaagtggagctgtgaagactaaattccaagtgacagtttcagtgtgaaatatttattgcatgctgataaaagaatatccacctgaatagaatcaggagggccaagggaaaattgcagtccatgtaatctt

SEQ ID NO: 119357 - DNA, 1204 bp, Homo sapiens
tttgagaaaagcctggagctgcactttgtgaaagcttttgacacccagcaatggcaggagtgttgcatggatcatggtgatttctggggtactgtgacctggaaaagagaacctgccttttcctacaggtgataggttatagatatctcatttacgaatgaggtttccctccctggaactcatcagagcttctgagaaggagtgaggtggagaagggggagctggtaaaaatagcaaaaataaattttcctcttgctttgaaccaggttctattttagcagagccaaacttagtgttttgttttttaaaaaataagtatcagctattatttgaagctcactgctgtctgtatagctgttcatgttttttgtaatattaaagtatttttcctactggaaataatttttgaaactcagcctgtttttttttataagacattgaccatacttttttctctccctggcagttcagggaaccactcggaaaatggcttgctcctgtctatttctgtactgtgttcagcctgtcccccgatagtcgtattttatggccagcctctgcagtattccagttgatttgtaaccatgagtctctctccagccagattgcaggatgccggagggctgggccttccatgtccttgggacctagcacagcacgaggcacacagcacacccagtgcacttgtgtctgcattcacctcctcccctagggaaggccttcagtgaccttcctgcccctttcttcctgctgcaatctcattgttctctggaccaacaacacactttattgtgactttgcttaatagcatgatcacattgttttagaatggcattttaataagtcatcctgtccctaccctgtgagcttccagaggattagcgttgttcttattcactgtgatccccagtgccttgttgatgcagaaagcactccattaatgcctaatataataaggccaagctggcttggtaggaaaacgtagggagttccgctgaaactcagaaggatggttccagtccagactctgacttgctttctggccagaagtcttcacctaccctgtgcaccacttagcatctttgcgaatagacaaagtgagatgatgtgcactagcaccctgtggaaacagcaaagctgctgatcagtgtaaagcaaaaagtgaccgaggcagatctcaatcgatagaggtttatttggccaa

SEQ ID NO: 119358 - DNA, 2040 bp, Homo sapiens
gttttctcatctgtaaaaccaaaggattatactgtaatttctaaggctgctgccagttctaaaatcccatggttcaacattcacataaatatctgtccccttcttctctatttacagaaactactgatacatgttagactgaattactctatgcctggttttccttggccatttttcaccaagaacttaacactacagagtttaggctgcagatgaacaaagttatatgccagctatatatttatatcattatagattccaaagacttctcttcatctagcctttctgttagaaggaaacccagaaaattgaattatttcattcatattgttagcacctctgctgttagccttcttccttcctggtagaagatgtgttaccagtactagaatatatctctgatcagacagttttcttccaaagaaaatgaaataatagttgaagaacaataatgtaataactgataggcaaagagagatttaaatgcttttcccaagccccatcttaatgtttatactagtgtcttggtttgatttctccctgttccctggttggcttctcagctatgttccacatcatctgctggataagtaacacacactgtgtcgtttacaattccattgcccaaggtttcttttcctagatatttactgagcacccattctatgccgtataattatgaaatggggagttaccatggaattatgaggtccttccggccttgtagaagttctttctcattttgactcttcagggacctagcactcttcccacttctaatgtcccatctgttcgctcatttaatagaacagggataaagtttaaaagcatacgccagcagcactttcccctatacctttataaatcaactacgattaaatcaaaggatcaatctacatatttaaaaagtaataataggctgggtgcaataaaaatgtaataataggctattgtaataaaaaagtaataatagattcacacctgtaatctcagcactttggggggccaaggtgggtggatcacttgaggtcaggagttccagatcagcctggcgaacatggtgaaaccccatctctactaaaaatacaaaaaaaattagccaggtttggttgcaggcacctgtaatcctagctacttgggagactgaggcagcagaattgtttaaacctgggagatggaagttgcagtgagccaaaatcgcgtcactgcactccagcctgggcgacagagtgagactccatctcaaaaataatagtaataaaataaaaagtaataataaacccatcagaggcaaaggagatttaaatactctgtcttggacttcaataaaaatcctcaggaaagcaacatgaatttatatacaatgaccagaactgccccctaagtgaaccctatatcttttggatataagaagtttttccagatgagtggaaaattccccagccccctgtcgaagtttaagaaagcaaggcaatgagacagtttgtttagttttatagcttggcccctgtatgacattcatttgttcagtctatttaatatataattcctctgcagctataaaaagatgtcttcaaataggaatttgaactaatttcctccctgctttttctagaaattccagtaaatcctcgagtctggggcaacagcattcccatagttggcgttcctgtggaaggaatgtctctcatttggttggagattgcctgttagttttgcttgattcctccgaggatgatgtgcataaaacaagattccatttcctttctaaaagaagcctgtccctatgcgtctttcatatacaacagttttcctttagtgtatttccatgtgctggagtgctcccataaaaggcagcagtaatgctgtgtatagaaaacttttgcaagagtttcatttgggaatttttattatgatatccatccttctcccatttagtcctcatatcattcactgtggaattccttaaagaactgttttgatgctgaagcagatattattaactctggcagagaaagcacattggtctcacaggcaaga

SEQ ID NO: 119359 - DNA, 1106 bp, Homo sapiens
acctgggtggtttgtaggcttgggcaaatagctctcaaacagtctgagcagcaaagaagcaccaaaggatttctaccccagacaattaacaaggcttcgtaggtgttttacatcaggaacagcaaaaaggcagccagattttgcttttgtctttgtactttgctccattttgctgttctaaataaagatactcctctggaccctatttgcaaggcgttagttagaataactatcagtaaactgccctggcttattgtagctctgcagtttgccacacccctttggtttttaaacaactctagtgtaccttgttttgtgtcactatttcctgtctgttagcacctgctcttcgagcatcttctagagacctgcagcatcagcatcactgaggcaccttccttccctgtgtagttcatagagatttagtgttcaccaaagagaaaatattttctaagcattttgaaatagagttgtaatctttgttatagagctagcttcatagcctcatgtctagagaaaacagtaaaatagagtgttgggaatgggaaacaggaatgggaatgcagcaccacagaagttgccagaactgggtttctggattctaatgagattcccctgaacaaatgaattaagatcatgatttcaggaatattcagcaaaatctaagtatttggatgaaaaaatatattgttactatagtacataattgtgcagtaagaagataaactggatgtgttctaattctagataatggtagggttttggagtcatgcccatcttcccatcagcttttcaggggtcactgttttctaccacagcagctgttcttaagcttgtgcttttttagttaaggaactcaaaatagtggatgtattacacccaagttcagaatctgcagttgtaagaaattaagagcagacactatgtacagccattaaagatcattggaaaggggttaacattacacgtagcatccatttttgttaatgtaagtgtgagatgaagcattttcagtgtttcttagcttacactttttttttccttttgtagatcgctaagcaaagtaatttgctgaatttattgatgtttggggtagtggtagttga

SEQ ID NO: 119360 - DNA, 2989 bp, Homo sapiens
acaaggactggaaagcataggtcactatctgggtacatgcaaatacgatcgtcatgtaacctctgaattttttcttcctttcttttaagacagggtctcgcattgtcgcccaggctgaagtgcagtagcaccatcatggttcactgccgctaacctctgagttcttgatttgtctctgtacactaaaggttcaattatccatgtaaatggaatgaagccagatgtgaataaggctaaagaaccaataatctaaggaacacttcagtagcagtttgccatttgtatgtgacttgttgagtagatttattttcctaaatctgtttgcttagtcatcccagaatggtagtggatcagcctgcgccacgagcaaagatcaaagtggattatccgtaggggaagattaaacagttaattctaaaggaaaaactttaaaattcatttgaaagcatagcctcagacacgctgacaccttttcttttttttcctctgaattcatttagaacatatgctgtcaggaggataagagatgccttcagagaaaataaaaatgtaaaggatcctgtagaaattcaaaccctagtgaataaagccaagagagaccttggagtaattcgtcgacaggtaagatggttcaatgatgtactgtttttcattaagagctttaaacttcgacatattccccttgattagacagccgtgcttttggtgttggtgatttacagagcaggatcatgaaactctgttccttgtactaatacagacatgtaaaggtgaactctcatattttcagattcaagttgaacttaaaataccagctttccggaatttccagggagtgtatccttctggaaagctgatacttttaagtatgagaaacttctgcattaatttttttgaaagctaagtttttgtaagatgtatcgcacatgtgtacttggatatatttcagagtataaatatattctccctttcctagtatttttaatcataattcaggataaacagaacgtggcccttttcttgaagacaccattgtgggtggtgaacctgaattacgttgccacatgggaggtgcatctgcaggtgcagatggtgtaaagtacagctgcttgggtgctgaccccataaaggaacctggagggtgtgttagttttcgttttgtggaagtgccaaggatcaccttgacttgtgcttccttttctcattctcatgaggtgggtggagcatgtgcagcggcatgatctcctgcgtggtctgataacatccgcaagagtaattagaacgtcagaggttaaagtcaccgtccactgatgggttttcttgctctctaaaaaacacccttttcactgtttttctttgacttagcagcaatcacgcaataaactccatttctgcttccattcgtgtttcccttttacttgcaggaaatttgcttataaagtgtggagggggaaactctttaccatttttgtaagttatgctgtgctgttttgaaagggcttctttagcatcaagagatgccagcttggctgacattaaattagataataatctttccctgacccttcttcatgcttgactctaaaaagaattcaaaaaagaagcaatatttgaaactataatttgcagtttatgtcaagattaaaggtcttgttatattgcctacataatgtaacagttctttctagaatagcatttcggattctcctaaccatccttgagttctacagctatttagtaatacagtaactgccacactcagacaggcctaggaaatgatctctaactaaagccatgaggatagtaaggtactcagaaaagaaactgatctgcacatttatgtatactttgagagtggcatttatatgagtcagcattttgaaaactctagaacaatggcatttccagtcaccagtagttgaattttatgaggtcctttagcagtggagcatagaagaacaagcagctgagttcttactttgcataaactcagaaagattttgttctttggcacttactctgtgtagaggttggcaaaacaggcaggttttatctttagcgtaaaattatccagagtataaactgcctagaaaagggggattgtaaataatctgtgccatcatttctcccgctatatctaattgtctgtgtcacttcttggtttgaaatgctcaaactacccttgcaaaaaaaaaaaaatactaaactggccctcatctgacatcccagtgagttcccctcccaggacagacgcactggagcagtggcatgtgcagggcaagggcgccctccccagggcagcctggccactgcacgttcccgatggagaatacacacggcgaccttgcagaacagcttgctgtcaccacctcagggatgaaagcattctcatcccttcagagaaccagttagacagcagcagctgggaagtttctactcacttccctttcatgtcaagactcttcctgaatccacatgcagcctttacagtagttagggcgtaaggcacagtggctcccccggccatctggctgcaagctggcgtaagttgcctttggactaacagcctatggcaaggtggagagtctgtattcttgcacactgttctctgtaactggctgctgtagcagccttctgacctgtcctccgggtgcccctgcccctactccaccccacacatggtctgttctccacacaccaccaccacagtgatctttttcaaaagaaagatcgggccactgccccgttcaaccccttcaaggctcttgcttcgtgacaccctaacataaaacctgaagccagtgtgaggtccccagaggccctccattgcactcctctccctcacactccctatttccttgaacttcttgctcccatctcaatgcttgtgcaccacctgcctggaggagtccctccaaatgttcctgtagctccctcccccttccacccaggcctgtgctcagatttcaccttcccataggggcccccc

SEQ ID NO: 119361 - DNA, 1037 bp, Homo sapiens
cagggtgtacctgtccctttgtcttttcaaaaactgcaggtaatttgatggacacaaaatgatgcctcatttaaattttcatttgtttgattgtgactgaggctgaacattcacacatctatatctgtctgtttcatcactctgtggtctcttgtgagttattgttttatgccactaatttatttactgtggtcttattgtcttctcaatttatatgtgctatttgtattctaaggatattaatattttgtgatatttgtttctaactgtcttaggtctttaaagatgaataggagttagccaagaatccagctggaaaaggacgctccatgtgtggagaaatagcaggcctccaggagagaaaaccagggagactgcaagtcttccaggatggccggagttggtggtccttgctggaagctgctaggtggagtgggagagatgagcaggaatccagagagtcctgtaggccatccatgccgatgcagttgaccgttatctcaagataatggaaaaccattaggcatttttaaacagggaagtgtgtaataggttttattcacaactacccaaaaacccgaagctttgatctccaaaatggattttctcatggtaatttcacctgccactccacgagcctccattggttgccctcttcctttttaaaacaattaaactcaattatttcacttagtccttttattaatagctctttcccttgaaatgctctcgtccatttgtcttttcttaagacatgtttggcgctgaactatttataggaacacttgaagcagagttgaaaagttagatgacctttttaagctttgtgatgccagagacaattttttttaatgcctgttcaaatggacaaccactcggctttataccaagtacttaacaaagattggatagggcttatcgacctgtggaggaggaatagcctagggttgaaaatcacaggctctagagtcaactgggttcagaacccagctctgccacttacgagacatgcgatcttggcctacatttttgaaatc

SEQ ID NO: 119362 - DNA, 1009 bp, Homo sapiens
tatgtctcacgagttgattgctttttgttggttcatcagtttctgtctgcattttgtacagccccctccgggtctatctacctcctgttctttgctctgccaggcatcctgcctattgccaccggaaagaatatctttctaaattccaaatctgattctgctgcttgcttaacacatgcgtgtaaaagtagcataatgggttatcagaagcagaattcttcctttagaggctaacattttgtcaagaaaatttgactaggtagatttcaaatgcataaatgctgaatgagagcccagttaatagtctcggactatgaataactgtgtccaagaccttattatgtttatatgaaataggttggatttgcttataaaattcaggtatcctagtagattcattttctgctgctggaaatagtaaggactgaccctgggtcaaaatttgcatttgtttcctatcatgtagaaacttcagcaaaataaacaggatcataaaattaacattttattgttcttcacagatctgtattcacttcaccactctcactgaattaaatcaccctgttacttgtttatgtaaggaaaaaagaacaagtcaactgactgaataaactatgggttatttacaaggcccctggacttactcctatttaaatgcttatgatttgttagttgacttaatatatccagtgcctatacaaattcagataatcaatgatgtctctttaaacacaaatcctctaataagaatttcttttttaacatgagtatagaattacgctgggagtgacttctcttaacactgtcattttgctgcagcatggttaaattaaatttacttggactgccctgtgaaccttaccatcatttaacattgttgttccaaattctcagtaagaaattttagaaccctatcatgtctctcagtatatagtttatactcccatagtttatttgaaaacaagttgcatttaattttattctgaatttcgatatatttttaaccaca

SEQ ID NO: 119363 - DNA, 1048 bp, Homo sapiens
agccctctatatctgcttatttctctctttttcatccagtttttatgtatattttctatattaatgttaataatttgccgattaattataactatagtaaataactataactgtaaactattaatgttcatcattgctcaattagttgattatgtctgctctcagagtaatttttttttatttaatggatggctgctgccctcattagacatcactgatgcatctattaagctgtatgtatttattcttttgttcctggtgtgatgttctgaaagggtttaccaccctctccctttggcctagtttattccaagttaacttacgtgatcaattcattgtaattatgaatattactctgtagcataattactgacttaaggattttatacatgttttctgcatattcactcagatattttccctatacagttaactctcctccacatctgattcctaagagtgatattgttttaaccagatatcacttctataggcaaaagtgtctcttaactaaaatctcctttacgcttgactaaacaaaaagctaaattaaatgagaaagcaattccttgcagacagattggagccagaaaggatcatggattctcctgtcttagtccagttgtcttttattcatccagcaaatcttgtttgagcactcactgcatccggtagtctagtgttctgtttctctcctcctcagactaagaatcaaaagcttccagcactgtgggggcctctggacttggggggacattaacatagtgagcatagcatgcttttgcctcaaacttgaaacttgaggtaaattcccaatgggggtataaccaaaccagagcagaccctgatcaggcacccttctggaatgggcattgctcacaagctctgcccgctgtgggccgcagaatcctgaccgtgaccatcagtctcagcacccggattagacacatctcctttcctgtgtctcaaggactgttttcacttgaggctctgacgtataaaagtatgtccagacacctcagatctctgtgggtggtccttcacccat

SEQ ID NO: 119364 - DNA, 1067 bp, Homo sapiens
cacaaatgtctccgccaagaccccagacggttcccaaaggctctccgtgatgcaactgcacgtccctcgaatgcctgggcctccgatatccgtccgccaggagcttggctggatgcacgggcggccagtcctcttatttccccgccctcccgccgcgtggagcggctgctgggtcccgagcctccgggcgggggcgggatcggggcggggcggaggcatctccctcccagcaccgcccccttagctgccccgagccctgcctgcgcccgcccccgaagcggcgcgggacgcctggcgccgtccgcgatccgcagggctgcccgcttaggcttaggcccggcccgctggcaaagccgagccgcagcattttatttcgttcgtggtttccgcacaggctggagtttcgtgggttgggtcgtacttgggacctcggcgaagaggacccgtttatttttttttctttccaaaatggcagcctccagtcgcgcacaagtgttatctctgtaccgggcgatgctgagagagagcaagcgtttcagcgcctacaattacaggtgacccagcgggcaccgggggccgggggcggggggccaggggccggggaccgggggtgcgggctgacgcggaatatccccggggactgggagccaccgtggtttgccggcggctgcgaggcaaggaccgggctccgccatcgaaaagcgtgctcctgcctacaggtgtggcctctgagacctcggggaggagcctttctttctaccaggggagacgttcatgtcttgtgacgttttccccctaaaggctatcttggtagttattctaggagcatgattagtgttatgtttctgcagaagagaaaaaagggatggaaatcagtcatttgtgaagttaaggccagtgtgttgcatatgtaaaacttcccttgagcactggaagagttgagagtggaagtggccagtgagtagtacactgcgacaaagctgaaggcacactctagcacctccctaaaatttcctaggtgtcgtaatgagttcttttggttgcaagaatccattctatttagggta

SEQ ID NO: 119365 - DNA, 1043 bp, Homo sapiens
tgcaaagggaaagtaaaatgaagcagtcatgaaatagaaaaagcttagcaggcagcatactttctttcctgtttcttgacgttctgagataagcacattgttatttatttcaagtcttggagcactttgagacaagcacatgtgcctgggcattcataacattaagccctgttaggaatcccacttacacccttggcttctgcgtactgtgagagctgggctggatgataattacagtcagctttcatttgtagagcccaggtcttcaaataatttccaagtaaactatcccagattaatacgtttcaggacataagtgtggttcgctagagctgtcaagctgtctggatgcccttctgttaactttgtagaagagattccacgtgtgtcaagttacagtgtttgctgaaatttttctgttgtcttgaaagctatttgaaaatgaaatgttcattatagtactggtggtcaggtatgttccttagatatatatgaattaatgtcaccacactatagacagtaatttttatatcaccttctctccaaaaacctgcagcacttttaggatgaagtctaattccttaacacagcctatgagaccctgacgactatggcgcttacccacttctccagtcccatgtcatacctttttatttttcgcttgctgcttttcattctttagtactcacctctttcccctctaccctggggacctttgcaaatgctgatccagctgcctggagtgcccttccttcccttgctaattattcttctgatctcagtttaagagatgcttactcaaagctaccttctctaacttgagtacatcttcctctgttaagctcccttagtatggtgaattgctcttcagcttagagtgactgccattgcaagtaactgaagtcaaattgttttaaacaaacctagtggctttattgtctcctgtgtcttgagggttcagaagccagatgggctttagggttgattggtttgagtgatgttgccaaagattcaattttgtgcttttctctactttgtcttct

SEQ ID NO: 119366 - DNA, 3198 bp, Homo sapiens
tgttgggctgtccagacactcccaaggacttggctgaccccaaagatttctctctgcctgtctcttcccatctctataaatcaggcagcacaggaggaacaaacacatgttattgttttaccttgaagtgaaatccacctattcctcctcagtgcaggctcagtatctcctgagccagcctcagtgcattgtggtgtaaagagaaataattttttctccctgtggtgtttaagcctaattcaaatagaagctgctctgtgattaacttacctttctgtcattcattgatcaaatggtgactgaagaagaagctgaatgaaggcacagatagcgagtgcagcgtcatgtcacacaaagcttttgcatttgtcagcaggggctggttcacagttttgttttttttttttcttttcttttcccagattaattgttacttgtcacatgtagatatttgacttcttgaaagacttaaaccaaaacattaaataaagtagcagcttagaatggcaaaatggttggttttttaaacaaactaaattgacccaagagattttagaatgactatatttttcagttacatttttgaggaaaagaaaatggatatcaattacaaatgggtggttgcagatacatttttttaatagttccaataatacacattttttttatttaccagaaaagtacaagttcagctgcaaagaaaatgcagtaaaacttggtaaagttaaggaatgccaccttctgaatactcgatacatttgtttgtaaagagacgatatatcgtatcatctctgtagggcataaagggtgctggcaatttcaaaactaaaatctgtttctgtgttatagcatattatcagcagtaccagatttacagtgaatacatttaagatttgaaagatattttggggacttttggttctttattaaatctttatatatcatgattgataatatgcaagaacattggctttttttccttgctcagcattattcaaaaatgttttgcaataaaatcctaacaccatgttgtccattttcactgcccccgacccctcattttaaggaatatcactgtacccagtccattttgggtatcctgacttcataaatgagggaagtgttagcagagtggatacttaggagtttgatgtcttatatcctgctccgtttggactagaaccttaatcttttcaatattttctccttaaagtatacttcatctgtcattaatctaaattatcatctcacataaagcagctgactgttgacgttttcagttatcacagtgtgatcctgaaatggggaaggactgaacagagccctgaaagatgagagttcggctctggctgtaccctagcttgtgtgatctgtgagtaaatgaccttttcctcctttactttcttcagtctaaagcagaactgaaataacctattctctcctcacccctagggacattgcaaagattcagaacatattctcattagtgcgctttggttttctgcaataaggagggtgtgtagacagagcttggtattgttgccacgagtgctggggtctaataggaacgctggtttttggttggttgtttttttaacttgcatggtgttttaatagcagaagattatggtttcttcaaaatatggtaaaacgaagggatttttacacaaagttttttactaaaaatgacgatgttaatggcgtactttatttgaaagaagccttatttttattagtaaaatacttgatgtatgttttaatgtgtgtagatttaaaatacattctttaacattattctccataactattcaacctcactaggttttcctgtttagttagcaatggtcttttctttattaggctaaaaaagaaacccatcaaaccctgacatgagtcacatgatttccacatttgactctgaattaattgggtatgagatgcagccttccccctctccaccccgtgtgatacacttcagctcttcccagcaagagaggttctgttttctctctctgaaagaaatgcagagagaaaggaaatgcctagatggtttggcttccactaagtagagaggaggatagagtcttcaggcatcctcaggaggccttgagtgcacaacaagacaggtggcttcagcgcttgcttgtggccctactgtccatactgttcagaggtcttggtgatgtgtcttgcagatgctttgtgtaggtctttgaaagagaacttgaactgaggatggtgtgctgtgatgaacacagccagggatgtgagattagaaaatcttgaggccgggcacagtggctgatgcctgtaaccccagcattttgggaggcctaggcgggcggatcatgaggtcaggaaatcgagaacaccctggctaacacggtgaaaccccgtctctactaaaaatacaaaaaattagccgggcatggtggcatgagcttgtagtctcagctactcgggaggctgaggcaggagaatcacttgaacccgggaggcggaggttgcagtgagccgattgcaccactgcactccagcctaggtgacagagcaagactccctctcaaaaaaaaaaaaagaaaaagaaaaagaaaaaaagaaagcaatcttgagttgaaaatgcagtgagaagattgaaagataacagaatgacaagtgtatataaatggagttgagtgagttgctgagtgtattcgtttggctagtttctctctataaataaatatagaaaaaataaaaaatataaatgtgtgtgtgtgtgtgtgtatatatatatattttatatatatataaaataaggaagacgagatctgtagttggcaacctggagacccaggagagcacatggcataagtttcagttcagtaccgaagacctgagaaccaggagagtggatggtgtaagttctagtccaggtccaagttcaaaggcaggagaaggccagtgtcccagcttgaaagacaggcaaagagagaattctttcttactcagccatttttctattcaggacctcagtgaattggatgaggaccaccacattggagagggcaatccgttatacttaagtctgctgattcaagtgttaatctcatccagaaacatgctcatagacacaccacataatgtttaaccaaatatctgggcaccccaaggcccagtcatgttgacgtaagactaaccgttacactaggcaaaggc

SEQ ID NO: 119367 - DNA, 1033 bp, Homo sapiens
attactcatatgaatagtggcatggaagaacacagctagttaaaattcacagtaattcagaaactcatttaagcctattctcttctaagaagtaacaaaattaattgctctttctgtacatgcccactcagaagttggtgcttcaagagatgcgaaatgacaggcaggtgatttagagggagaaggagaactgccttggataatatatggactgttgtctaacttcgccattggaatagatttgggtgtcagttaaatgctttgcttggtgtttcaagtttaatgagacagctgtagaataaactaaaatcattttctagaacatactaagcctttcccatctgactaccttgatacttcagtttctttatctggaaactgtctttttgaatggcttatctttttaatcttgatttaaagtttacttcctcagataggccttccccagccattctttttttttttaatcaaaaaataacgtctcctgtcctatttttaggtttctaatgattcctacttgagttgttaggccttcgcagcctcagaaagtatgtaggtttacagtaaattatacactgtgtataattcatttttcaatatattgtaggtatattttaaggtttagttaagaagtatgtaggggtagaagatcttatgtttttagtgacattttatgatttactattggcattgtattttccttccatttttaatttttgatttatattattttaattgtattctgtcagattggctggagctatcctggactttagtttgagggatgacactttggggagtaaagattgggtttactttgtactcgagtcttccacaatttcctttgtagggctaaccgttgtcagcaagtatttatgcaactgttgtcttatgactacatagcatgtattggtcatagagtctaaaagcttcttaaacaaagcatgggatttaagaaagaagaattagcagattaagccttaataatatataaatactttacaagtgaaggtaagacttaaaaagatttaat

SEQ ID NO: 119368 - DNA, 1338 bp, Homo sapiens
aggtggtaaaatggactgtcttgagtatgtgcttgatactccaaactttaccagtctgcactgagaaggcaaaaagaatcagtaactgttatgtaatatttttaatacttcctagcttgtcagtataatgccattgtgaatgctgtgcaaccatgcaaaataagtacattgaaatgtagggattcagatggctttttagtcatttaatgagcaataggaatttttggaatttcaaggaaagtgttaccttgccagaggacttgctctgtattgctagggagtctcactgctcaggagactgaggaacagagcagggcatgcagcctatcattgccgtggctgcttagaaggaagcagcagcaagcaggcatgagaggcagcctatttcaggggttgcaaaagaaacacatggtccatggcgcttaggggagggagcattcacatcccaggcggacaccaggggaagcgcctgaggttggtggtggtttcagtaggtgctgaaggccacgagccattttagccggtgcatatggggaagggagacaatcatgacatgggcattcctgataaaggaggccaccggagttgagggttagtggtagggaaaaaaagagcagctgttcgagttttgatcagctggagtgtgcgatttagtccctggaagagaaaggggcttgggcccgtgtggagcactttgataggctaagtggaaccctgattttgtgaaacttaataaactggtgctttagaaaggtgggtccaggaatggtgcctagcgtcaatcagagaagataagttatttaaaagggaaagtggttaaaggctgttttaattctccaggaggaagatgctgagggtctctacattatgtccattgtgatgagggtggaaaggagggccaaatggcagagatattgtccagacagaggctggctgaacagcagggataaaggagagagtggccataaagcctagtggcttgcaatgcatatagtataacattcaagggccaggcacggtggcttacacctgtaatcccagcagtttgggaggctgaggcaggtggatcatttgaggtcaggagttcaagaccagactggctgacatggtgaaaccctgtctcgactaaaaattcaaaaaaaatgcaggatatggtggcccacacctgtaatcccagcattttgggaggctgagacaggcagatcacctaaggtcagaagtttgagaccagcctgaccaatatgaagaaaccccatctctactaaaaatacaaaaattagctgggcatgttggcatgcgcctgtaatcccagctactcaggaggctgagataggagaa

SEQ ID NO: 119369 - DNA, 1191 bp, Homo sapiens
ccacataggatgtgagcaggaaagatggatgctgatgcaattaaggttgcatgcatgctaggaggggaggaggtggggatggagggattattacttgaccattctgtatatctacattataaaagatggcatttaaaaccacaacactgggccatgtgatttttgtggtgaagagactagcttcactacaagaaatttggatgatttataaatctctaaaccccaatgggagaaaagttattatttaataatatcatagatattcacttttatttaaagagtcttgttagaaaacaaattagaaactccatgtacgattttttttgttgtcgttgttcatcaatgagaaggtttgtttaaattatatccctgtcattggcattttggaacttgaggacaacagaactgttacaacaggaattttagagccaattttgaccacagtgaagtggctgtgaaggctgaaggccaagagcatgattgattgggtgattagaattctttttaaagcaaattagaggtggcaggtctgccacaggtgagaagtactgcaaagaaatgaatctcattatcagataaaacttcttagatcatcaaaaaagaagtttaatgtttaaacttaaacacacacacacatacacacacagcacgaatgacctgcatgtgaattcctgtttgtgattattatacaacctagcatctagcctgatgttctgtatagttataaataataaagaggtatgttttatagttaattcaggaacaggtgccctatttgtgaaatacatttatcagttcagtttagccacttattgtatttggggtcttcttgatgatttaatttgtgactaggcatttgagtttcggatccttggtgtaaaaggaggtggaggggaaggaaggaagccaggaccagtgtttagaaagggaaaagaggagtagaggacaaagaatggagaatgatgtgtatgtggtggtgtgtaggggaaactctctaactgcgtttttcctctactcttcacactacaacaatcatcaacacagaagaaggcttctgtggccaaatgtgtgggttttttccccatacaccaagtggcaggcaccggttggatgtcctctaattcagttctgacactctctacccagagatagtgtcagatcccacaggttgagggcccagtccccatgact

SEQ ID NO: 119370 - DNA, 1030 bp, Homo sapiens
cgcactgcagcctgggcaacagagcaaaactccatctcaaaaaaaaaaaaaaaaaaaaagatacaaaaatgtcttgtcttttcttagggtgtccttattagctgagattgctgaaatttattcctcacatatgaagggaatttcttctattttgttaatttgtggtggaagatcatttttatgtctttatagagtatgtttttatattgaaatgatatagtgtgggttgctaaaatatagatctagtttattctgcagagccttgcgttttggaagataaagagcaactgtttgcttgcctagatttcagtacaagctttagctcactttgggttttgatggcagtttcattttataaactgaagactatactatgtagacatctgtgctgatatttctgatagttcctgaaggtttctcatttagactgtcatctcctctggcgaacatagttataatgcttcctacactcctgtgtatttaaacacttacccttattattaaattagaaaatctaggtgtatctttgaaccatacagtcaatctgagggttttttggtttcaaggaatgctttgtctgagccccttctgggcccctgggatttgtttaaaattacagagctgtatcggtataatcttttcttctataacagcaatggctgtcttggactgtggctttaagcttattcggttgaaagttcatcaaagtttggagatgacacttggggttcaggggaaacaagtattctcttggccttgcttttgtttaaaagatgagtttagatgtgccatgttggtttgctgcactcatcaactcgtcatttacattgtgtatgtctcctaatgctatccctcccccagccccccaccctccaagaagccctgttgtgtgatgttccccaccctgtatccaagtgatctcattgttcatttcccacctatgagtgagaacatgcggtgtttggttttctgtccttgtgatagtttgctgagaatgatggtttccagctaaaggacatgaactcatcct

SEQ ID NO: 119371 - DNA, 1011 bp, Homo sapiens
tgtaaaaaacttgttggcgcgtttgtgtattgatttaagcccagggacaccatgcattgcctttgttaataggaatgtactaggtgtctaaggataacataatggtcatccattagtatttaaaatagatgtgtgcttgatatggattaaagcaagggtataggtgtttcctctttccctagaattcggacttttaaaaagattggcaaaggtgagttgacaagagtgttcagccagtgtgactaggttcttagtggctcccttctttttgggaatacctagtgatttggaggcgaaggtggaagtcaaaggagcttggtaggagcagtagtgggagggcactggaagtagctgggcatgcgctcagaagagtgcctattgtggactgcacaaagcacctcacctcacctggtgaggacagtcttttgggtgctgaatggagtgcttgtgtggagaaggattttgaggtcacacctaggctcagtgggaaagatactgtgattaattagcaatttgttctagatctttgtcattgcagttttcttcaatttgttatccagttggattataaacattacatgccttcatgtaggaactgtaccttttaaaattacaattttctacccatttcctaaaatgtctagcacattgtattgtatatgatgtacgtgtatggtagttttgtgtctgctgattgaatgaatgagggaaaatactactttatcctcatagtcccaggcattttatcaaagccttgtgttgaagtagtgggatcccacagtttgcctgcccacatgtgaaacctccagcagacctcacagggataaaggaaaggaaatttcaactgagaaacttagggaaagtaatgccagcagagacctttgactcatttatataaccacccaaaacattgaatgagacctccttgttttatagaggaatcaattcagacaaagaagagcaaatagcttccccacgatcacacagatggtgggtgactggggaccccaa

SEQ ID NO: 119372 - DNA, 1054 bp, Homo sapiens
ctgccatttagaccacagcaggaagctggctgaattttgcaagagaaagttacataagattcatctctcaactatattggaaatgtcagggttaccaatgagggcaggtcatttagaaaggatctgaccttctcttagacatcgaagcaataaaaaaagttatagatttctccaattccataaaggctttgttcttgggtcacttgtacaaagtgatcattgccccagttactctcctgatgtcactatgtaccttccaggtgttaatttcagtaagtatttgacttgtgtttttcatgatgcttagacttctaaaatcctatgggtaaaaagatctttacacatgatggcagatggtgcattgggcttgatgtgttcttgcactgtttgtagacgtagcctttaaggtagatctagaaggatgggtggggcttctgcatgaagaggggaggaaacagtgtgagcagaggatggagtgtcgcctgtgggatgtgttgggggaaacctgcctgtgtttatttatctttccctcttgtcataatttgagtgtggcctctgtgccttgtaggagacaaggttaggactgtgcaggggtgaagaggtaagagtgttcagacagggatatttgcactaagctttgttgtatctacttcatccccattcggtaggtgtcttctatgttttaattcatatcctagcgtcatttttcatccatatagaaatgtaccatataaagtgcttaaaagattgtctctacaatcaaatctggttaaatgtgggaacctccagatgctaccttttccttcttcatccactaaatctgccttatatattgattgcttttaggaagtcaagtagccgtttcccggaatctttagtaaagattaactagatacttgatcacctgctttcatatgggtgttatgacacacacagagtagagctattcacaatttatggtgtggtgggacataagttatgtcttacattattttcaaccagctcttggtgctaaaaccttttgtagatgaggctggtttgaagcaagaattga

SEQ ID NO: 119373 - DNA, 1404 bp, Homo sapiens
tatatcgtagggcccagtaatcttcctacagctgaagcagcaggctcctaaacaagtctcaggtagaattacttgcatccattatcaagctagccatgaaaaaatggtgtacttgtttatgaacatgcttcaatttatcctttttgatgaaaattttaaatgatttttttctattattaagtttcataaggaagcatgaaagagaaattaccaaatatttgcaatatatatgatggataaattgataagaaaacaacatggtagtagtaaaatgtcaaggataggctgttaacaaaaagtaagtaccaaagttgaataaaaaaattttaagcatcactaatattataaataaatatgaaagcatacatttttaagcatcagattggcagagatggaaaatctcacaatataccatgtcaggaaggaactgggaaaagtaccttctcatatattgttaatgggggcatttatagggacaatgtttatgacaatgtttggcaatgtgtgatgacagtttagaatatgcacactcaatttctgacgtaagaatttcttcttaactcatcctaagataaatggacaaaccccaaaggagactggcccaatatggctgaatgcagcgttatttatttcctgtgctgtcagtggagagcctgctttgcctcctgttccctctgatgtgcaactcactggatttagggcttattcatagccccagagcaagctcaaggtacctggctagtgactgaaaggacatttcttctgttctgagtagaacagtcacagattctagtgcaggggccctgacacttggtgaggaacatccactttgtctttccctgaagcaaatcattaacgtccagcacacagcagttgtgtcagctctgcagacagaggctggcccatgtggctgctgtccccagggcttggtgtgcctgctccgagatccacctacaggtatttagccagggcaggtctggtctcccgccctgactggcaccagccaggattagagactgagtggcctggggctccctcctgtgtcaccttcgttaaagcttcgagttccaggagcagcagccttctccttccacccccttcaggaacaccactggagcctggtggccatctgggtgacctgatgccctcagagcagcagggtttgctccgtcatcatgaatggcatctccatgtgccagtgtcatcagatggtcatcacagtgggttgtggggagcatgaggtagttgtgctgtggatttttttttctagaggcaatatttggaattagaaacctatttacatacacttagcattaatttacatataatcctcaaataacttcaaatactcttctattcaactaattagtgcagctaaccagtgttgtagcccacctcagcatt

SEQ ID NO: 119374 - DNA, 1040 bp, Homo sapiens
ccttcataggttttttggagagtaggaagaccggttgtcaaacagtaaaagagtacctgcaattcatgtcattctttgcattcaccttaaaatactgatcttaatagatttttgataactaaatgtataccttttgtttttgttgcttttaagtcatttattcatttagaatctacatgttagctttggtttatttttaaggaattaggaaaatattttaattttagcaagagaatgctcagtctccctccttgtttacccttacccccaaagcactattgcccctgttggttgagaatgttggtctagggaataattttatattctttataattttacggttatgctctcccatgagttttaagcatgagtgatacaaagttagggggttttgtttgtttttttgtttttaacactaagaccttgaaataggctcctcattagcagtgtcatgtcatgaaagatgaacagcttgagattcagaagacgcaggttctggctgagctctgtgcccctgagctcccatatgatgggggccaatctctgcctctgtttcctaagctgatccctctggtccatcatgtctccgacatccactaaggctacatcttttcattggtgttactgtatggtttgaaggaggactgatggcagcgtatttatggtatctcggtgactcctaccttaaccctgttgacttttaagatttcaaggcaaattgagttaggaatctcttcctagcaagaaggccttgtaagtaagaggtccttaaaaataaaagaaaaaaacctaacatgtagactttttctctgcagccccatgtcctggaaccttctgcttttaacctgttaataatggagttatttcgtattgcagtttgcccagttttgtgccaaagagctcgtttttcatactccttccccagacatgaccttgtaaatctttgccggaggtaaaggattagcgtggctgagcagttcgagggagtgaagtgtcttatctctataactttccaaagtggtcctcttctgtgtggtggg

SEQ ID NO: 119375 - DNA, 1051 bp, Homo sapiens
ttaaaaaaaaaaaaaaaaaaagattgatggtcttattctacatatttttttgagtctatttctatgatattttcagtattttacttagatgggctttaacagatttaattttctcttttattttgcttggctgtcttaatcatggcctttttcattttaatgttacctcattcaaagagtttttgcctgactaatgagttgtagttttaaagtgctatgtgtttagatcttcataatgagagattaaccggagccgtggatcacatctctgggagcattcacatgtcccatgtccagcctgccaagttataccccttgggattccctggccacagggagggatttgaatcacagtgttctggtggctgggattttctcctatctgatcacataagttaacttacctggtgtcttgttcacatttgtctctagttcccctggtgctattattgccaatagtgcaataacaaaggtttgatatgaagatggacatgtgtaagggagagctggggattagccagcccagtttcacctcagctggtattgttactgggtcagagtggggttgagtctgaaaggcagagcgaggtcaacactgacagaatgggactaaaaacaatgtgtgggaaataattcagcattatcaaagtgaatttcagagagcatcagctgctgcttggggcctggggtcacacctctatagtcgctggtcttggagagagggttttacccctgaacctactgccctactctgaacctattgcccgacattgctgagatcatttatgatttccaagagaacttgagtgaggatatgtgcatggtttagtgaattggctcccatttcctgagccctaatatgccatggcacagctgctctagtagtcacggtaaatatgttatttcattgagttttcacagaaagtcaatgaaatagatattcctgatcccctttagtttcagacaggaaactaaatccctgagaggtcacatgatttgcccaagcctcaggttaaatttgggaagtaccagcgctgagattcagacccag

SEQ ID NO: 119376 - DNA, 1058 bp, Homo sapiens
acttcaccccgaggtacagtaaattaagagcagcatcttgattacagcaaaagttcagttctaggtctcctttacggggcactttacccacagcttctcaggcgcatgtgtaaaacgaagtccacgtgctgtctgttcagaatagaacggagatgagtggtaagagatttagagagcagagtaatttcaggttagtgtttgaatttggtgtttgagagtagcccacaattaaatgctgtaaagtggcacaggaaagtggcttgaactttaagaatgttccctttccaccattctcccattttatcctgagattttccatttgtattaattatctccacagctcctgttgggttatacagtagaatttgaatttctaataaatgtcaaaatcagaaaataggcctataatctttcacaggcagttatgaagagaatggactttttgtttctgaagcattttgtcctataaagcacagaccttatttttcaaatgccttgtcaccagaaaccacgagccattctcattaaaagactctggaggagtactggggatggtggcagggcatggcggtgtgggagagcaggcctggagcagcagtgctcactggccggggcgtcctgtccacctcaccctgactatcagggacgtgcagtcacctagaagtctcttccctcgcaggacccaactttctcatccgtaaagtcaagatattaaaccagctgatctttaatgttctttcctgagttccatttctttgggcatatcatatgaaaaaccactctgcatattataatcaaccattcttgaagaagacatgagtacgtttttattcactgaggcccatagtacttgggtgaataaaattcatcatcacctccagcggtgattttctgtgtatttgggtgtaattgcatcattggagtcattaaaattattttatatgaagggccagtttatacaataaataaagtagaattgctgtggtttcctcagggactgagccctatgtgcctgtttcactttcagcccctgagcatcccctgaggtatccatagag

SEQ ID NO: 119377 - DNA, 1015 bp, Homo sapiens
tcgatctcctgacctcgtgatccacctgcctcggcctcccaaagtgctgggattacaggtgtgagccaccgcgcccggcctatgctagtggttttcaagccgtagctggcatgagaatcaccctgaagggttattaaggtacagactgatgtgccctgccccagagttcctattttttgggtctagggtagggcttgagaatctaacatcttctctggtgatgtcaatgtcactggtcttgggactgtattttgagaactactgttgtattcaaaattattttaaatgttatttaaaataagtttaaatttcctgggaaacataacttgtgtgtaaaacgtagtccttactaagtaattatttttaaaatattttaattttgtatcctacttcctgtagctcccacctcctttggtgtgaattgagagtcatgggattctttgcttttaaataattctctgtgtgattcttccaccatgggagtctgccctcggtttcctcaatttagagactgtaaatatttgtgatttttccatttttgaatttacttctttctattttcatatttttaattttattttgcttcccttttactgtttgaacccaaaggataattttactttttttaggttttcctttttgttttttttttttttttgagacagtctcactctgtcacccaggcgtgatctcaactcactgcaacctctgcctgctgggttcaagcagttctcctgcctcagcctcctgagtagctaggactacaggtgcgtgccaccatgcccggctaatttttttgtaattttagtagagatggggtttcaccatgctggccaggctggtcttgaactcctgaccttgtgatccgtacgcctcggcctcccaaagtgctgggattacaggtgtgagccaccatgcccagcctttttagatttataatgctgttttctgagcagtggtcataatattcacatacacacacacacacagacacacatgcacacacacggtataa

SEQ ID NO: 119378 - DNA, 1079 bp, Homo sapiens
tcacttacttgctccagaatcaatcagaaaaacataccctgatgaaccaccacagaaaagaggttattcacttcttcaaggctgttaaagtgcctagtctagaagcaacgtcattgtatcagggcctgcaatcagttctagaaattaggtacaccaaattctctaaaaattaataattgagtctaaatggatgaaactcaggaaaagggtgtgagatgctctcggtacaactgtatattaacattttctcccaggcatttcatgttacttcaaattaacgatttcaaaatgcactgttcatttgtccttgtattggttgaatggtactatgcaacttgttttttcttgagctcactagaaacaattgtagcagtgtggtaagggagccattcattcatttttttcattcattcattcatggaagaagcagtttctttgggcacttacttcctgtgcctgaccatcttatagaaacaatcaaatgaatggctcctgccctcaaagtcttattttctagtgggagaggtatacatgtctacaggtaattactgcctgggtcatttggcatgaaaaatgtatttctattttaaacatccagcttatttatattgatttcaacaaagctaatgggagataggtttgcccggtgcagagttagttccagaatttgtagacccagcatattctgttcttctgtgcatccaagctggcttcctggtgatcttattatttgcgtattacacaaagtccctgtaagaataacccccaagtattctccaaggtagatatctagataatgtgtgaccttgtccctgataattgatttcatttgcccatgaactttaaaaaattttatcctccctctcagaaagaaggtctggataggataaccaggatcaggagctgagcttgtacagtttaaaatttatgatgttatgttagtagaaggagaatgttctgaatttagaaaaattgatgtcagtattcaagacatttttagtgaaacagagaagatcaggctagagaatgcttatattacctgaaccaaagaagccacagaaactaagcacagttgaaac

SEQ ID NO: 119379 - DNA, 1039 bp, Homo sapiens
gtctgcacaccagtgggacttgctgcacgcgggactggatgccttcctggtggtgggtgatgtctacaggcgtgaccagatcgactcccagcactaccctattttccaccagctggaggccgtgcggctcttctccaagcatgaggtgagtcttgagatgtttctcatcgctgaaggatgtcatagacattttatgttgaggtcactaacatttagctcgatgagaccagcatagtcatccttgcttgccttattttgccttagtgaatcatccatacttaatgacatcttgtgtataggtgtgccccagtactttttgaccgctttgttgtgttagtaactacagaaattggtaagccttagtttccagttgtctgtccttatcctttctctcaatactgacccgccattctctgggttacttcttatgaatggagaatagtctgtggctcaaattcacctttaatccaggatggctgaaggtgcaacatggaaacctgtggtcaggtcattcttaattctgttaggagaagtaaattatattttcttgctgttagagagaaatgaatttcttaggtaccttaggggcctgatgatttattggcttgggctgtaaactgtgtcttgtccccaggcactttcctcaccctccctggctttgcatgttgctgtgagatgtcttaattgctgtgggatgtcttaattgctgctattcttgaagcatgtgttaggatgatgcatggagccttttcccaactccttgcgtctgttagatgttatcctaatatgttgtgtgcatctgttagatgttatcctaatacgttgtgtgcatctttttttgttgtttttttttttgcaaattctgaaatccctaaaagcttgattccatttcctaaaaacttgccataccacttgtccctcactcatgttttaaaaaccatctctgtttttatataagaaacaaatgcgttaaactaagcacagggtgtatttcattttacttccttagcaatgtcccttccagacatgttcactggaa

SEQ ID NO: 119380 - DNA, 1351 bp, Homo sapiens
tcttcaaaacaatgtgggaaggtggattaggcatttggagatggatgtaagaggattaataattgttaattattgaaactgggtgttggatgcagagaaatcatcatcctttctattcgtgcatacgtttgaaaatttccaaataaaaggctaagggaaaagactgaaggaaaacactgggatccgtcagtcagtcaaaaacattggctgaatatgtactgggattcaagactgtaagaagatatcagacagtcatgagatggtccctgctttcatggggaagacaactattaatataaaaaaagagtgcaggataaattaaagataaaagcattcattacatgtaatagaaaactgaaagcaattaactctaaaattaatagcctttcctccatcagcctcagatgattttacacaagtttttaccaaatcatgaattacttgtacaatctgtttcagaacatagaaaagagagtcctaccaagctcattttatgaggttagacatgttaatatcccaactagataagaaagaaaacttttgaagtttcatcattatgaacatagattattcctttttaatgaacagatatagaattattaaatgaaatatttgaaaattcaattcattgatttattgtgtcctaccacattattattgcatatacattacattgtactgtattaactgatataaggagaaaaagcatgtgatcatctcaatagatatagaaaaatgattgcatttaatgtctcatgacattaaaaaagcatttgatgacattaatgactcatgataaaaacttttagcaaattagaaatagagggaaacttccttgactttacaaatgaaatccatgaagctcttacagcaaacataattaatggtgcatcattctaaatatttctatccaaattagccacaattcaggattccttcctatcactgttcatcattatgtggtaaattctagcttatgcagtaagccagaaagagaaatagaaggcataagcattggaaaacatagataaaactgctttatttgtagaggatttgatgctttacctagaaaaagaatatacagatcaactattagaacttacaagacaattcaacaaagttgttggattcagggacaatatagaaaaattaatgtttttatccataagtaagaaccaattaccaaatataataacacattttatttgtagtatcaactaaaatatttcagtacctaggtataaatcttgcatcagatatttgagatatttatggataaaattattaaatattattaaaagacatagaagaacataaggagagatttaccatatttgtagattcatagata

SEQ ID NO: 119381 - DNA, 1045 bp, Homo sapiens
ataatttacaaatattcacacagaaataaagggaaatcttttcggaaaagaggatgagtgaaggtgtacagagaagtaagctttttgtataattttgaccacaacccattactggaatggcccttcatcaagaggtgtgtgttcagttcatataccacccacccctttaaacataatcatgctcattcgccatttcctcatggagggattttaggagcgtagaaggatgttgagacttacacgtttgagaaccactgtcctcaaaccactgtcctcaaccactgtgggtgaggggctccttccacggaggctgctcctgccctcacgattccttcccgctggagtgaggcgcttctttttgaacacccctttggcatcctttgtggttcatccttgtcagaaaaaaccgctgtcatttatcattagaaaatctcacttttgctgcctttgatattctctcccactttccagatggttcactggaaccctcctgttcttgggcttctctttccaagcttccccgctgttactcttgtagtgagcccatggttgtctctttattcctgctttctgctctgaatcacttttctgtctttcagtgagtgacagggttttattctccaccgtgtggttattgggtttccttaatagcctcatgtggaggggctttgttgaaggcatttttattcggctttgacagattatagtccccatgtttccctaatctcttctttaaaatattttaggaagcattgtccctgtcaaagacacacttaaattcaaacagcttttcctttttaaaattatttttctctgttcacatgtttacgtagtcctctgtcttgacagttaagtgagaggcaactggtcatagtgaggagtccatggatttgggaaataccccattattggagggcaaagcatgatttggaggaccgtttggagagagacccctttttctgtggcacagggcttttgcagataattagtctttggctacgacaagatggaaactattaggctcttagtctgagactcatcactg

SEQ ID NO: 119382 - DNA, 1041 bp, Homo sapiens
cctaaagcagtagaagtgtgtggagctattgcagctcagctctgttcatgagtgttttatgtccagttctaaatcctattcatctgaccctattgccccttttaatactgaagctgaagagagtgatagtatatattccatcacggaaataaccacagagcctggaagatggggtcatgacttggagattttgggttgaattcaggctccaccatttactatgtcatggtacatgttattgaacctcactaagcctcagggttcttagttgagaaatggggaaataataaggattgtgaagattaaagaaaaccatatagtatgtaagataagcactcagcaaggtagcaaaggtactaaacggtgtgtaactattaaccgttagtactgcaagtggcagtgaagtgtgttataggatcatgttatcagtcacaggaactcagagtcaggatagataagtgtttagcattaatttgtaaggcagattgtatagatgaaactggtggtcaatagttattttttttttaatggctggtataaaaatgactactttgggagccacagaccagtcctcaatatctccttgaaaatctactatcatccaagcctcattttcactttgccacttgtaggattttgcaaagaagcaaattcttcttctgtccgttttcttttttctgtgccctttaaatgtgtgtttaaaatctagaccttttgggaaaatcttgttggctttctaaattttaaatttaattggcttttgcaatctacttttattcttaaatctgattagaagtaattccttgctcagtaattcctcagtagttctgaactactttctgtggcttttgtaagcagttgtagttggggttgaatttgtattctgggtcatttggatttgcacaaggacagttaggaaaatgtcagagaaatagaagcagtcctagtggaaaataaattatacaaactgttgggtgcgattaatggaaattaatttaatttcaatactgtggtatctcccaaacataaaggtaagtgaga

SEQ ID NO: 119383 - DNA, 1108 bp, Homo sapiens
acacgtgttgattcccttcagataacgtgcttgccagcccaacctgcatagggacctatacatggtcccatccagcagaaacattctagggccctgtgttgtgagtgatgtcctggtcaggagtgaaatcacttgatcatgtgtaataaggaatcacgtcttccataccttttcatatttttttatccatgaggctctattagtataaatgaagtgaaagggatcaagagtaagaattagatttataattaattgttagtgctacattcttcctaaatggaatcacatcaaaaattgtaagtgtgtatcactttattaatttttaaatcagctcttttgggctggctgctgttgcctggcttggggagtgttatccttctcagagtactcctagacagcgaagtagccaaggcagttgttgcattcaagcaattttgacttgtctgtactcgcctcgccgtagcttagatgtagtctagagcaggttgctctttccgataaaaacgggccaacaccttcaacctctgagacttgggatcattaactgtgaaaagtgaagtgcctcgctttaagccagtggagggactcagtggaaataagacaccaccctaggaatcaggtggagagaggcctaagacacacttttccttagatgtctagtgaagtgggaaaatatatactagggttgatctgttggggctaaggaattggtacaagggaacctctttagagaaaggttgagatagcaatagttgagctgaactataatacttttaaggagcccagaaaccttcctgattctatggcagttgggcagaggataacagagaggttcactaatctagggaaataataaattgaaattgtttggggttttatgttaattaaaataaaattattggatcttaaggtacagagaaaaaggcactgaaaattttagggctgctgtaatgaaaaccatcagtgtgcctggaactacacccattgcaaactatttttactggtactaataactctcaggtggttggtatacaggtgacctagaaaccattaagatttagggagagagggaagattctccttctactctttaggttcatagaaagct

SEQ ID NO: 119384 - DNA, 1085 bp, Homo sapiens
tgctcccttagaaggacatttgctgcttggccttggagggcagctctgagtcagggttcaccgcccagcctcctgtagcagaatgaagagaggtccttcttggtaactaagaaatgtgaatagaccatgggtaaggatatgatatctggtcatgggcttggaaaatgaggatgagcagagagtgacgagacagggtgcatgaagtgcaggagcttgtgttacctcggctgggagactggaggcctggccttcccttcttacttttaggtactctccatctgcaggggcctggactccacaagctcccagattcttcttcatcctgctgaggaagcctcaggagaaagcccagcacagggctggaagcttcgtgggcagttttaaaataggtgaagagctgtcctagaggagagggagcacagaggttgacatcaggacctgggaggagaagttgtgaggcctgggcttgggtgtctggaaacccagggtttctgttaattaacagctgtgtctctttaggcagggttcatcaccccacgagccttggctttctcatgcttaagatgggtgcaaggatacaccctcagagttccattatggggatagattgaggggattcctctcaagtgcttagcaaagggtctggcacacagcaagcattcagtaaaaattaactgctgatgttgttgtacttaaaatttttctaatggctagagccatgtgtcaacagagggtccccttagtaggaaatatttaaacagaagttgttcctgcctgtgatagaaacaatttctaaccaagtgtaatttgttacctctttgacctgtagtcatgtctgtgtctgccattttatgctgagtgagtgattttacagggaaaaagaaaagtaagagtaataaacaggaagaaaaggaaaatcagcctaacagttgtatgtgcatctcaacagaaaacataaaatactgggcgtgaatatgaaagatttaatctctccttgagtaggagctgacttcaaatacctctgtgatgatttgatagttttgttttttagaaaaagacttcaatgactactaggcttcctccca

SEQ ID NO: 119385 - DNA, 1114 bp, Homo sapiens
ggttgcctttccaagtgttgactctcctgtataatttttctgtttttttacttttcagagtcctctgttagttgtttagagattttggtcgtaatcagagagagggatagactggtgggctcatgcccccatagtggacctgaactgtagtttgggttgtgaatgcactccaggtgaaaggataattgcgtgacacacatatgtggtactggaaacgtggtggtattggctccacttgtctatttactctgtcaactttattaatcagaattaagcctggtacatttttgaggccagttagttgagattgtctaagatctgtgaaactctggctcgcttccttcctcctgccctcccttccttctccgttcctttctttcaccttcttaactttcctctcttcctttaagtcagtcttgccccttttagtgcccattcagaaaagcaaacaaatacacgtcagccttatgtgtaggttttgcctcaagttcctcctagtgacatattttcaagctgccagaatggagatgtctgttcaaatatttacttagcctttttcccttttcaaaacagctaagatggtgagactttttttctgatataaaagcaatctgtaatcattgaaaaattaagaaaataaaatataaaaatgaaaatgaaagtaattccatgatcctacataaaatagattctttataaaatttaattcctatataaaactgtaaatctttatgcatatttataattgtcagatatacctacatatagaagttatatatatattttataaaaagtagaatcatactttgaatattttttgtattaattttttctgcaagaaatgtgacacaagtgtcctttgatgttaccaaatatttatctacatcatcattgtcagtggctgcacagccactgtggatggatctttctggccacccccatgttgatgggttgttgacaataacatttttatccatgtgtcctgtgcacttgtcttaatattttcctgggataagtttataaaagtggaattactggttttttcctccctaggtttatgatgcatattcataggcacactggaaaaaaagtacctgcagtatttgaaagagtt

SEQ ID NO: 119386 - DNA, 1487 bp, Homo sapiens
tctttgttgaagtcctctgtgtatccctccctgtcagtttcttcactccttccctctctccctcccttctataagcaatcacattctgaattttgtattattaccttgattttcattagagttttactatttatattgtaaaacaagttgactttcatgtgcttttatgttttaacaaatgaaatcacagtatagctcctttcatgactttaggttttcatgcattagtgtgaagttcatctgtgttgtcataagtagagttttagttcttttgttttttgcagcttatattctactggatgaatgttccatagttcattcatccattctttaatgaatatttgcttggttacgattttctttttgctattacaaatgctactgctgaacattcttgcacctctgaatgtataggtgtaagagtctcactgagctatgttttacctagcggtagaattgctaaaagtcagcacttacgagcatctttgggtatcatcaaattgtttcccaaagtggttggcccaatttatattgtcttgagcctttctaaagttccctggtgttttacatcctctttaacacttgacgttgttcaacttattttggcagtctgatacgtttaaaatagtatctctagctgagcttggtggtgcacctgtagtcctagcctagaggctgaagtgggaggatcacttgagcccaggagatcagggctgcactgagccatagagtagccgccactccactccagcctgggtggtagagtgagaccctctctcaaaaattaaataaataaataataaattaaatcaaatggtatattgtggtttttatttgaatttacctggttattactgttaagtttgaacacaattttatatatttatttaacatttattgtttttcttttgttcatttttgggtgaggctcatttctgtcttctaaaactggcaggaattctacatttatatcggttactaatcatttgtcatttctatgtattgcaattatattcttcaggtttgtggcttttctttttctgttctttttttaagttgctctttcataaatggaatgtgtatatatatatatatacacacacacacacatttcttttttttgagtagctttaggtttctttatataacatcattctccaaaaaagtcacttcaccggggattgtgtgtgggtgtaagttggcaagtttcatgaagataacccttttgcttgtcatgcttgattctgtagtttaagtctctcatgttactgccttatcattcatattttcagcattgggattctaaatatttaatgactttcaagcatttaccctctctttcctagtgttctgtcagatttagtcccaccctcggtgacagtttcccttggctgggaagtcgtactctaggatgtgcttctttgactaggaaatgtagctcagagcttgcctgggagccccagtgatgcccttttcactgaattgga

SEQ ID NO: 119387 - DNA, 1395 bp, Homo sapiens
gcttctctgagaacctcttcttaggggtctccttgcctccagggtttccctcctccagtctgccctgcttggaatccctggatacatgccttgggctgtctctttcattattgccgtgcctctctggaaaatcttccgtgattctccatgaaggtattcagggtcctcccctcatcttctgctttgtttgcctcagcctcctttcatgaagatttgggaaaaatcctgctccactgacaggaatctagtattttagatacgattggaggtgctgtaaacacttcagggttttctaggccactgctcattcctatgtatgcacacatagtttgctttcattctgaactttttgtatatttcctggaaaagttactttgggattaatttacatataaaagtcctatattttcatcttatttttatcctgccacttcaggtatagggaaataaatgaaaaagtcttcaaatgttgacttctaaggctttattacctcagacagcttcattaggtttgtggaaatctagtgtgctttgaaggaattaatctagccttacttgcaatctgtatgtgtttacatagaatgaacaaacattgcattacgtttcatgaaaattcaattattcttgtctccaggaaacatgttctgcttagtatttaattctcaagtatgtcaaggtgatggttcttgaactgtcgtaagaattggggagctggggctcactgctcatttccataatcaatggagaaatagccagtggagactttttaatcactaaggtcctcatgtaacccatgtctgaggttacaggggacattggggacatcagtctcagtggcataaggctaatataaaatcctctctagatttttgttagaatgaagagaagtaacattaaggatgatactctacataattaatactttcttttggagtttattatgcatatgtatggtttattcagcaggcattttttgagattctattgttaacgaggtacagcaagagatggaaaggtaacaatcagctggtattagtgtctgttgtgattggttggaccctatttaactggcaaggatcagtttaaatgcttttattcttgaaacattccttgcaaagtccgacaactcatttcccactgtattgttactacagtgaagtgattttttggaaacacctatcacatatcatcaccatgtcttttatagttacacgatagttaactaaacttatccttttcttccacaagagtctaacctccttgaaggtaggaccatgcttaattcctactggttagtggctgcagtattatactgaagaaacggtaagtccggtttcagcaggccgagatgtggaggagacggtttggggtccagagtggcctaagggaattatt

SEQ ID NO: 119388 - DNA, 1033 bp, Homo sapiens
tgccatttggggttactaagttctccctccatttttttttttttagacccatggacatgcctttctgctgtcacttgtgaatgctgtcaaataatccttacatcctaatttacatttgcttatttcaaactgtttgtactgttctgaaaatatcaacacttgtttttttaaaatttatttatttatttatttagagatggagtctcactctgtcgcccaggctggagtgcagtggcgtgatctcggctcactgcaacctccacctcccaggttcaagcgattctcctgcctcagcctccccccgagtagctgggattacaggtgcatgctaccatgcccggctaattttttgtatttttagtagatatggggtttcaccgtgttagccaggatggtctcaatctcctgaccttgtgacccacccacctcagcctctcaaagtgctgggattgcaggcgtgagccactgagcctggccttgttttttaaggaataatcttttaacagttaactctcggtcccgataatctccgtataatctttggattctcattgctctgagggtaaaggtccaaatctgtagtgaatgtgtcctccaaggcaatgcctactctgctttgctctgaccagctctctggccatgcggacccgccttcaccgtcattccagctgagcaagcctttcggttctcccttcctttgctgggactgcctgggcacatctgatgaccctgtgacccactccagtagcacctgcatgtcttgttcacagcaggcatcaccactgtagtaaaccaattgtgattatgtctttatttaatgtcattgattctagcttccccttcccaagactgcaagtgccctgaggacaaggaccttgttggtcatagactgctgacccaccagcatctagcacgatacctggcacagagcgggtggtcacgtgtacttgtttttgatgtcattgtgaggagatttccttttccggttttcattcaaaaccgtcttggttattgcttatttgtttcttaccct

SEQ ID NO: 119389 - DNA, 1020 bp, Homo sapiens
agccgagatggcattattgcactccagcctgggcaacacagcgagactccatctcaaaaaaaaaaaaaaaaaagagatgggcagggtcattagcaggcaggattgaaaagattggaaagtgaggctccatcttaccttggctggtgaaaatggctccctcagggcattgctcatgacccccaaaccgtccacagaaggaaaggatattcctgtccctagccctgtccagctaccaaaacaacagcagggaaagggaggccgagggtagcccacttacctcgccttggtaagggtctcccctgctgttggatttagcttccagttgtgtcatttcaaatgcccgtgatcctctactgtgtgcaagacaaaagtacgaatacttgcttgtccagccaggccccgagccaccctcctccctttcccctacatatgtccacgtcagtgggcaagctggcagcccggtgtctccagcacatggggtgcaccctgtctcatctgcaggccattgtgtgtgtgttcacagttcagaagctgactcactatctctgcctgccaacatcctccaccacacccacctcccacccctatggtcagggggcatgggtattgaatggcagtgccatcagagcttgccagcaccctgtcacccaattctcggccactgggatcagagattatttcttcctccctgaatctctcagtccctgctgcaccatccacagctgcgggggaagggctggccgacgtttttgatcttgttttccgtgcctatcacaatgcctgtcacataccagatcccctgaaattgtttgttgagcagactgttatcataatctcctgtgatatttaccacattttaccttttgacatggttatttgagaatatttttaaactttctaggtctgagctctttgatagcagggcctgtgttttatttattttttaatctcctaaagcacctggttcttggactccatgaatatttaatagcctgaaataaacagaatttaattcctgga

SEQ ID NO: 119390 - DNA, 1049 bp, Homo sapiens
agaaaaataagtaactcacaagctgatgtgtcaaccaaggctataaatccagggagaaattcagcaatagaagagcattgtaatattagaaagcttccagatctccccactcaggagtatttcctacctgtaacacacagatccgtcgtacaaattatgctttgtttgctgaaaagcctcctgaagctgaatgggtttactttggcatcagcggaggccatgattgagggcggagatgagacattggatcgctcttgtgtggcttccgcatggccgtcgtggttcctctgcccagccctctcctgcgagggactcgatcagctccagggcgcagcttgtgtgtctgctcccatggccaagtccccttggctcccttccccttggctctggtttggcttgactctgccttctgctcctcaggtctgtctaggtttagtcctgtgtaatcatttgcagcaaagcctgcccatgactggaaatgcagtcctggcttggcaggaaaggggtttgtgcaagagctggctgtacctgtgtctgaaacacctgaggcccttccagggctagggatgcaagaagcctaggctggcaaagctggccttcctgccagggctgaggagcactggagccctagaaggggactgctgtccagccccttggccagccagagcaagggccactgtagtcaaacatgaattcacaaatgggaagagcaggaggtgactcagatccacctcccccataactgctaatcatagtgaattattaagagcataaaatcaggatcttgtttcccacatagagatcaggcccatcagccctgagcagttatataatccacctcatacacgtggataatattgagactggcacttccaagcagaagcctgctaaataaggacatgtttgttgtttcttctacctcatcaaaatgtctgtttcttattcctaagaatggcagggagtaaaggattatttatttcccttgatatttttcatttcaagaatcaacatgggcaggtttacagtgttcacaaacatgctggtagcaa

SEQ ID NO: 119391 - DNA, 1131 bp, Homo sapiens
tgttggctcagtgacccagccacctttgtgggcggtggtggaatgtgctccggttgcctgctgcccatgtcggtgtgcccagagcgggagggacatcattttgaccacagcactttggccttagaatgatgcagagactccatgtcactgcctgttcctcttgctttactctttttaaaaaaagacttctattctttccattaaagtttactccctttctagcttaaggagtcaaatcattctgcaaagtttagtgccaagccccagcagtctcctgtatgcctttcccttttccccacctccctccaccttcctatttcttcctccttagaggctgccagtttcaactgtttgacatctgagtctttggaatcattctctgtatctctaagtaacatgttcgtattgctgctccttgatttctttccgctttaaatattctcctttgaccatgcaacgtgaaatatgaggacttagccatgtcttccctaccctaacaccaaaccaaccaaaaggcagccttttcattcatctaacttctctgcagttagagcgtgttttgggatagatcggtgctctgcattaggttattttgactgatgctatccacaggtaaaatatttagtaaactgtaattaccttttctctttcacataactttttcttcagtctttttttgtctgcttagttttctgtatgcttttcaataatgcaaacacatactctctgcaaattgcctgaactgactctcaatacattcacatacatcgctctttttgtttgatcttttggagatgtctgtcccagagcctctgacctgcccctgcctaggcaggctgttcttttatcgtataggtatactgcttcctgtgtcttcctgtgtattatgtttttcaggcgttcagttggagggccagaaaccacactagctattttaaacagaaagagacttaaaacagatattaggtgctttctaaattattggaagggctggaggagtgggcttgagactaggtttccagcaatgctccagaaccacacagctgccctggcctgccaggggtgttgctttatctgccactttgggatgggagggagtcaggaggccgcctctgtgactattcacttcaa

SEQ ID NO: 119392 - DNA, 1028 bp, Homo sapiens
ttctgaaagggctaggtagtgaagaattatttttgtaagccctgcagtctctgccacagctattcaactcggctattgtggtgagaaagtagtgtggacaatgggctgtgttccagtaactatttacgaaagctggaggccggaccctgggcctctgacttgatcatctttaattcctttcagcagtgttttatagtttttagagtacaagtcttgcacttctttaatgaaatttatttctaagtattttattcttcttaacgatattgtgaatgggattgctttttaaatttcattttcagattgtttattcctagtacatataaatatgattgattttcatatgacgatcttgtatcttgtggccttgctaaagttgtttattagttctagaaggctttcaggaacctttcctttgtccttgtgcgttctgaaacctcacattgtgtaccttggtgtggatctactttcatccattgcatgggctgactttcttgtcatctgtaaaaaaactaacagtaaaattcctttcttgagtttagggcatttgttttgtggcctcgtctttgtaaggaaggagaaagagcattgttatgttattatacctgtattgaaactatcataggaaaaattttcaacaataataggtgtgttaaaactttaataatacaaattatctgtggatttcatttcttatgcctgtggcataaatatatcaacagcattatgagcagatttgttttcttaaaaaaaaaaaagtgggattaaagcacatagcacatgtcatttttctgttgccctgtgcatgaaaattgcttggtggattctgcatagtgagtcccttaacagcatgtttcaaccctgcatttctttcattttccttctggtttacattactgatttcctctctccccttctcccagtaatagccagctgggaaaggccttgttaaagtgaaggaatggaagagtctttagtaaggtaatgtagtcgtgctaataacttcaggcacagcaggtttcataagg

SEQ ID NO: 119393 - DNA, 1050 bp, Homo sapiens
taacaacattttactgcagttggagaatgactttcaaagcttcagaagccctaatctaggggccatttcatttctaaggaggttcatgatcattgcccaagtaatttctcattgtaatatctagagtcctacaagcttatgagctaacaacatttgcccatgaggttttagatgctgaaataagatacaataggtctgaaatgttaataaaatattcttcagtgatctcctttcttagtcaacgttgctatatcctcttcctgtgtcaactcctcagaatgtgggctttccatactgacagtacccccaccatgctacatgttataggtgaacaatctaattttttccagtagcttccactctcttctgtggataaatgttagtttgatgatgataatgatagtcataagttttattatcatcattactgttcttattcttcttctctggacctctgtgtttcctatcagtaaaataaatgtggtcagaccaaaagatgatttctaagatgacttatgccttaccattttatggttctatgattctagatatacattttgatgattatagatgctcattaccttaagaaagttatcagaagggaatgatgaactatgtttcaaaacatttattttcttaataacatggctaacttcagaatgtcattaaatagaatatatattggtgcaacgtttattattcattttcctgactgagaggctgaggccagtagtaaaaacttatagccaccaaatatcagagttggaagggacctgagagagcatcttgtctgtccctgctttcagaaagtggtgatattctcaacccaagagttatggtgacatgttatatacatcaagataaactcttttaagagcttcagtgtcatggaaactctttgtgtcagcaacatcaaagcccatgattttctaagtggcatttctcattctacgatgcactgcaaaataatattgccaaaccgtgaaagattacacatctgtagtaccagggttagctcaagatttcagagcatgccaattagatattttt

SEQ ID NO: 119394 - DNA, 1079 bp, Homo sapiens
tcacagcagaaccggcctgtctcccattgtgcggagccccgccccacacttcatatccctgctgtgtgtccttcagcgggtgacagtagctaatccctccgctggataccttcttgattttctctctaaacagctgcagagagctgagaaaactccttctcccactgcagcatgtcatgatccagtacttagctgttagttgccaccccagcaagtctcagaccctctgccaggctctggaatttagttgtgtagaatgttctgtacactgccctcggcatctcttaaaggaactgggtttctgtcagtcaggatgactcgcttcaagtgtcaatggataatgtctcatgaaaaaattaaaggcgatggaaaaatatgcggtcattgcttctaaaaagataaggtttggatttggagtaggaaatatataagaatgaacagagcttttacaacttttctttttcctttaagggagctagatttctaatcagtgtttttcaatatagtttaatggcttactttgtgggtttaggattttgaggttctgcatctgaattctagttttgtcatttgtcatttgtgtgcccttacacaagatacttacctctctgagtctcattcttctcatctcaaaaataggaataatactggtactgaccttgaagagttgtaaaaattaaaaagtgatggatgcagagcacttagaatagtttctgacacaataaaacttcaatgagtagtagacttcattattatctattttattattaatattattgttcacaacaccattccaaaaggagttaatttttgataaagaagcagaatttctttaatacagttggccctccatacctgcaggttctgcatccgcagactcaaccaagtgtggatcaaaaatattcaggaaaaaaaatgcaagtaaaaaacaatacagtatagcaactatttacatagcatttacatggtattatgttttataagtagacgtagagatgatttaaagtgtacaagagaatgcgcatagattatatgcaaatactatgccattttatatgagggacttgagcatcttcagg

SEQ ID NO: 119395 - DNA, 1259 bp, Homo sapiens
ggtgattagagctgggcttcaatcagctggatgattccccaaggcagggtcttgtcccaccagtgcacatggtgcgccccgtctgacaccagggcgacttgagaattgagcccagggaagctgcagtgtggtgcagcagatgcgtactggtggttgccatggagatcgctaatactgctgaaacccaaagaaagggcatttgccacagctcaggagcctgcctgaaaatgaatgagaaacaagtggaattcagaatagtcccccagctccttatcccacatggagttttaatttccttttctcctcctcttcctcttcctttttcaaagaatagattgaaaacaaggctgtgttataaagcatgctcagccccctccgacctcattgctgcctgacatatccctggaatagatgtatattaatgacgacgcatgactaataggattggggctgggggctggtgtagtggtgcttctggagcctgtgggccgcatgtcactggggtttagcaggcacgctgggatttgtctgcagcatatgcgctgctgttaatgattgaaaaattaccacaacaattagtcatggatcgctgaaggcagggcccccaaatgtgatggacaatgtgattaaatccatgtatgtgacaattaactctcctgcaggtttatccaccaaggagggtgccctaggggtgagagcaaaggggaatgagaaggaggaaaaatgggaaaacaaaaaggagcaggagagaataatgctgcagaatggatcagatacagctggcactattggttttaatctgatcctgaattaatcacggtttgattaatcctggttttattgcacctttctgttgcccatttatttatatcttccttaattttatagaagcatgactgattaaattctgcccattctgtgttttttaaattttaaaatcaggtctctccatttaatgtgatgtcctaggtggtccaaggtgcaattatctcgtaagagcttagcaggcaccagacatagcatgtcatgaatccccttatgtatcacagctgagtaacccagaataaatatttgtttgctcaatattctgcctaagtaaaaagaagccttgtgatgtcagtctgcttgtttatttgggtggaagaaataagaatacacacccccgcaactttgttaaatacagagagcacacattcagtatatgtcacacacaaaattttgtgcataaagaaaaagtgtgttaatatttggatgaagta

SEQ ID NO: 119396 - DNA, 1033 bp, Homo sapiens
cagtgattggttcattcatggcatgtgacccagtgagggaccaatgagacatgatgggggaaaagtgtcttcccttctgagaaaatgtcactaaagagatgttgcctcttccttccctccaagttgaagatcaggaggtgaggtctgggtctgctgagtaaggacagttgacactcagaagaaggcagcccccggcgaacgggagagaaccaggatatggatggaacatgcccacacctagacttcttgttttgtgagatgttatctccttctcaagtccctttgagtcgtgttttctattacctgagtgggaagcatactaattgatgttttcttttatatcactctgctttattttcttcatggcatttgtcagttggtgaattatcctgtttatttattctcatgtttattgcctgtcttccttactatcagtgaagcttcatttggacaggaacttacctgtcttgttaactgaattcacaactcctagaactgtgtgaagagtatcggtaggtgaccaataaatagttattggatgaatgaatgaatgaatgaatggagtgagggagggatgaacaaatgaaagaatgaagtgagggagggagattaatgttgcccttgtatattttataaaatatcatggggaggggttggagagggcttatggaaggccgttgccatgccgaggagttcacagctaggtattgagagcctgccccttggttgttgcagtgcagtggggaagggccagacaaaagggatgtgacaaacctaacaggacttggaactgcggccagagtggaaatggggagaggtgggcttaactcctgaggctgcaccagggggttattgggaggaataggatgtaggaggaatagcagttgcaatactggaaaacaaggaagtgtattttggaagtgtaggatattaagtgccagttaggcatcagtgtggagctctagctggtagttgagaatgtagaaatgaagacagactacttttataatcagaagaaaatatccctctttct

SEQ ID NO: 119397 - DNA, 1051 bp, Homo sapiens
agttctactttgctttagtgttcatgcgtttgaccaggggacagtcttttcttgaaaacccaggacagcaaagtctccagatagtcatctagttttaactcccagcaggataaaagcatttctaatacacagttgtttatcttttaaattttgtcatctttctgatccataacttctacttttacattatatatccacagaagttataacttcttataacaaatgctgttacagctcaaatctctgcataataaagcaattgctaaagccctgtgcagtgacccagttcaggcggtatcgtgtatataaaattccacagcgatttaaaaaaatcattctggtttgaattattttattaactccacattacaacttaattgtatggttaggtaacaactttaaagcagttaagccaaaacccacacagccacacctgaatataccagtctcagggagataccagctagctatattgatgcaccctgttctagcacaaccctctgctcctcaggagaaggagaagggcaggaccattggaagagttagggacctacggcccccttctgtcatgtctgtgtctgcacagatctttccaaagagtagattattggcttagtgttaacctggaggaatatttctagttggggtgatgcagagccctgtcctcagaactgtctggttcacgatttttatcaacgactttgatgaagacatgtttatcaaactggcagttgacgcaaggctgggaggatagctaatgtgattagtgacttgatcttgagtcaagaaaatcatgatcgtctaaacggatgcgccagaaataacagggtgaaaaatagtaaagttaaatatgaagccttcaaattaggtttaaaaaattaattgcacaactccagagtggaaagaagtggaggatgtaatttgtcacagattcaatatgagttaacttataataaggctgttgaaaaatgcaggcaatattatagaagtacatatacagctcaaaaaaagtaagaacatggcgcagaacgcatctggtttattgtatccg

SEQ ID NO: 119398 - DNA, 1060 bp, Homo sapiens
cactcagtaaatgttagctattaatagagaaacagatgcatttctgttactactcattttagtaaagcttaactttttatatattatatatttttatatttggaaaagggattatcatcctcactacaggacacctgggaagtcagagatgaggttttggttttagtctcagtagttgaccagagaaagggaagtgtttccctgagccccaaaccctgtttccacgcagaacaggtctgttcttgttatgacttgtttttattttagccttctattcaggtgagttctcactctgtggtaatttcatgaaaaatttgtggtaaatctttgttcagcttagtggtggggttagagataaaagttatctcacaggggagaagtctccaccgtcagaacttctgagtaaatgattgctttccctttgcttgtgaggagggatagccagtgctgtattgataagcttctctttcaatactagtatattttgttgctgaacaacaggacttttaaaatatattgttaatgagccaaatgtgatgccaggaggtcagcatgttgaggtgtggacttaagctttgcattgctttccttcatcccccgtggtcagctgtcagccacgtttccatcatgggaatgcatgcacaggccacaaggagttaatccttctgtccttccaagcaaaatgatctacctctgtcttctgtgaagagagatcatggtttttaaaagctaatatgataatggcagtattattagcaatctcaaatgaatctttgatcagttgaattgtttgatttacctactcattcatcagattttttgtgccgtgaacatcacacagaatcctagaagggcaccgtcactgacagaaatgaagctggttggatattggctgctcatgtccaggggtattgatgattctttcaaataaatctcaaagtaaggtatgcataaaaagataacactcagctgatataacattgcttatacagagaaggtttttcatttgtttgtctttcagtttccacatccaggtgttgtgctgtttccctggacctcc

SEQ ID NO: 119399 - DNA, 1023 bp, Homo sapiens
atcagacccctcagtggctttacttgcttacgtcacctggtctccatgaggacacatgctccatgtgtgtggcatgtggaaaggctcagtaagcattgatgagcagactgacttccatattatcctgtgttgtaggggcatggaagctggactctggggcttattctggagaatattctctccttgaagcagtgttctttgcttgaagattatttcttttggattttactcttcatcagaaagtagatgttatgatcagctgtgtccttggataaatgtgttttctcctgtgccctggagttcatcttttgctttcgtgttaagcctagacccttttttacctctgtctctctgaatcttccctaacttgatcccaactttcccctaacagtagtgattggaatgctcaaacttcaaggaaaaaagtacagacatacattagtgataatgttcaaaaggctatcgttagtcagattgtaattctgttccttgtggagaactttttcactggttctatatatatgaagtactcaggcttccaccagttctatcagagctgaaggatttagtagggtcaatatctactattgcactgcctaaatatttctaatctaatgtacttatatttgattccatggacagaattatttgctctgtactaatatttggccatatatgaagtcatcattacaatgtgttcatattcacctgttcatgctcaaatgaataattttacagtacagtgctgaagaaaatattgtagatttttgtttatttgctgtagatctcttttgtgaaagagaatgggtttaatggagcataagagtttagttgggacttgttgaatttgaggtgcctcttagaaatctcgtgtctttgcagaacttcagccattatctttggtaaaatcacccacctaacttctctttcagtctctggcttttatttggcttttaaatacttcatactccgcatatctaaatctgaatccatcatttcttcctgctttcctcagacacacac

SEQ ID NO: 119400 - DNA, 1034 bp, Homo sapiens
ttctgttgtttccttcacatctcatccttctttatcattcccatgtctcccttgctgtattgcctgcacaagttcacatgtttgaggaacgaaacttcaaacatagtctgtaccaagaggctttattattttctttttcctctctcccccttttcccctagagctagttcaaggtgtcctaatggtctaaaatgtcaaaagaaaactagatgaggaaaaagcaatcgaaaataactctattacaagcttccttatagttcagattcatccctttctttttgacccctttaaacaaatgaacatgttggcctatttcaggggtaattgctcttctcttcagaatacacctcctaaaatgactgctgtgtgaggttgaacattgtgggtgacgaatgtctgccagagcagagaactttgttgttttccctccttccctctcattgccttcattttcttcccttttagataataaaatccttttccaattatagaaactgtagaggtcaaaatgtgactcaggttaaaccctgtgaaaactgtagccgcctgaaattataatgcacatttttgcttttgagccaaggtagtgtgccagctggaagatgtaaatttgtcatcattttctgcctttgtttcatcttttctttccttttctacatcgtcgtaattctcaaactttattgtttttctctgttattctctccccttggtaaacccctgtgctcccagtggagccagaagaaattgtacatggggctttgatattttgccaactgttttctataattaaaagtgaattggaaatgggaacacttcctctgttccaccgatgcttctggggtctagtctaatagaaacatggaaaggtgcaaaaaaagaatctggagctaggaagggaaaatggaagcttgcaactcaggctaaggagttcctaatggaacatcagccctttaagccttcgggttttctgttctaaatttgctcttttctttgtgtcagatcattagaaagttttatccaaaattaaaccagta

SEQ ID NO: 119401 - DNA, 1055 bp, Homo sapiens
tgaacttcaggatcattgtctcccaatttgcttcctttggcttggtgatatcattgcctgcagaaatagaaaactggtacaaagccatttatctagttctgtgtgccagaatatctttgatgagatcataagtcgttcttttactttttaaaactaagtgactcaaatagtagtcactaactacttaaactttgggtacagcaatggcctacatttcctgtttcttttgtgttggttttcaactgtccctgtatggttgctgccttttcaatgccttctttcttctctctgcatacattaatacaaggggcatctgaaatttcagcagaagcaaatgtcaactgtaccaagctgaggtagcaattctaggggtggtgtcctttccaaatgtgttgttttatgaagatataagttttacatgattcttcgtgtcagcagttttgccacttgccatcgtttaagaagtctattgggtatctgatcctgttctctattatttcattgtgctgcctccctctcgccctccctccctctctccctagaaaactttattttctctagcttgggaaaatgtgtgtggtacagtgagaaattctggtaacttgggtactgcgttttcttcagcttcttgagaaaaggctgctgtggaggctgggaaagtactcatagaaatgcagcttttctcccaggctgcaaagagctgcccatatggttctgtcgaagcagaatggagaccaaataagacttgaggaggaagacaccacattagtaagcatctctcctggatgactgaagggaaatcaaggccagccacaccagcggagggtggggcaaggccaggcgcctcagatgcagcttgcagaggagaggcctgtgcagttaccttcagtgtttttcatcagagcaggtaaactgcaggcctgtctggtaccaggtgctggctaaggaacataccagggtaccatggttaaggcacggactctggagttagacaaacctaggtttaattgctaagggagtcagagtgctttggttgtaagctgtagcaccaattt

SEQ ID NO: 119402 - DNA, 1089 bp, Homo sapiens
cttataactccaaagttttaaaatttctttattcaactcaagctctgaccataggtatcatgttataaggaggctctatattgaaagagaacctataaaagagctgtgtatctttgcaatataactttgcattttttaattaaccaaggatataatatgtttactcaggaacccccccaatttaagttttcaattccagcttcagtggtgtgcatgctactctgaatcttgtgaattcagtgaagacgtatctgtccactgctatgtataagcattttgcaagatgcttggggtataaaaatgagtagatctggtaggatgttgttctggagaaactagtcttctagcctgagagacaaaagtttagatagatgcattcattgtgccctgggaggtactgtggtggtatggaatatgagcatggaaggaagaagagtgtctgcgtttcgcacagtttgggagatgggaagggctgtctgagctgaatttcaaagaatgatatgagtaagtttggaaaaaagaacaaaggtgtaaaaaagcacagtctatgaggaagaacatcaagcattttattagtgctagagctacgttgtccatagccactggccacatgtggctagtgaacacttgaaatatggcttgttccaacagatatgtgctttaagtataaatatacactgaggtcaaggcatggtggctcattgcctgtaattccagcactttgggaggccgaggcaggcagatccacttgagttcaggagtttgaaaccagcctggccaatatggagaagccctgtctctactaaaaatacaaaaattagccttgtgtggtggcacacgcttgtaatcccagctaccgggaggctgaggcaggagaatcgcttgaacctgggaggtggaggttgcagggagccaagatcacaccactccactccagcctgggagacaagagtgagactcagtctcaaaaaaaaaaaaagtatagacatatatatacacacacatacacacatactgggtttcaaagacttagttcaaaaaaaggaatgtaaaatatctcataattttccaaattaaatacatggtgaa

SEQ ID NO: 119403 - DNA, 1028 bp, Homo sapiens
catgtttccaagaacatgatgaattcttagtttttaccaatatagcataaaggagagtgatgagaagactggtctcactgtttcacagtctgcccagcctctattctttttagcctttggaacctctactgacaatagataatgaatgtaccacttgacattctactcctattcacatctttagagatagcagtgttacctatgggaaggaaatattaaggcgagcaatccataagacactaaaagtagtgagacccataggagagagggaacttggaagaggatgtgtgctgggtttcaaggatgaagggcatatgtgggaaagaggaactgtgagggcactgagtgcctgactacagagtgagctggtcatgtagaggcccttggtttcctgggcagaggaagctacagggaatcctagaatccctaagcagaataaaagctactgtgtgaacatgagaggatttagagaagatgtattaacgtaggatatgagtgatttgttcacagtgaagattcataagacaaatcccaagttaaaagcagagcatgttcattgctacttgacgtgttggcatctacacagagctgtctgatgataatacttacaagtacctttgtaatccttcctttgcaccaggtcctcttctgagccctttccctgtaataactgatttaggccttacagtagctctaggaggtaagtactgccaattattcttgctttacacatggcgaagttgaatcagagagagattcaataacttgtccaagatcaccagccagtaaatggtgtagccaggattagtctggctgcagggtctgtgctcttaactcgtctactctttcgataggtgaatagtgtgtgattaagctaactgtatggctatgcttataggacaggaagaggctgcagcttagctagagcccagttttcctctgagaaggaaagcaaaccctggtgactctacagtagctttttgtcactggcctgagaccactgtgttctactttctactaaagagctg

SEQ ID NO: 119404 - DNA, 1013 bp, Homo sapiens
attacacttagtggcctaacatagcacgaattgactatatcataatatccttgcatgaggagcctggctatggattgatagggtcccctgatcaggatcttaccaggttgaaatcaaggcagaggcagggctgtgtactctgaagctggggtgctatcatcagctcactccagctattgggagaatttgttccgtcccactgtagaagtgaagttcccattttctccctggctgctggtgcctctctgagctcctttaggacttctcaagggcccgagccatgtggcctcttcacagccaggaggtggatctctctccaatcggccaagatggagtcctagataaaaagtaaagcagtcacaggcttaaattcccattgtgttcctagatcccacccatactcaacgggaggagtttacacaaggcatgtgcatgcggggtgggagtctccgaggccatctcagcctaccacaggatcctactcatctgttagtgtccagttggaattatatcctttcatgagctcatttcataagctttcctgcagtgtgaactgctcctttgcctgccttcattctgcagtttctatcttcccttttacactgcctcagtttgtgaagtaaacccttctaatttatggcactgacacaatctgagcaggacactgtacctttggagtaggtggtgctagttatacccctcgtctgggcctgcttgtgttctctgcaatgctgaagtggctgttggtaagaataagcattatggtgtttaataaaactgaggttcttaaaggcatgacgtatgtactttcttcatgtaagttcgttctaaacatgttatggccactatggcatgttttgaatgtatctcattatctactacacttaaggacagagaccgtcttttctttccactctgtaacctatattcagtgggctaaatgtttgaatcagagcaagcaaagactacagaaaaatcataactcagttcaggaaccagtgcttcagaaagcc

SEQ ID NO: 119405 - DNA, 1895 bp, Homo sapiens
cccagcactttgggaggctgaagcgggaagatcgcttgagcccaagcatttgagaccagcctgggcaacatagagagaccccgtctttacagagcaaataaaaataaattagctggacatggtggtgcacctgtggtaccagctgcttggttggccaggcaggaatattgcttgagccggggaggtcgaggctgcagtgagctgtgatcatgccactgcattccagcctgggcaacagagtgagaccctatctcaaagcaaacaaacaaaaaaacagtaaaaacattagaaatgcagttgaaacacctacgtctccctgatttcattctgcttcccagtctccccagaggtcaccactagctacagtttgatatttacctttctcatgttcttatccatttgtatgtgtccaaaaaacattctgtaggattgcttcaaaatttatgttatatggtaaaagtcactaaaatatagaaatccagagaagttttttggaaatttgttgagcaaattctaaaatgtatatggaaatgtagagggccaagaatagctaaataacaatgttgaaggatttgcttaatcttatgtcatctttttgaaaagtgatagtaattgtgagaatgtggaactgatgcaaggatcaacacaaaggcccatggaatgcaatgaggagcttggaaacacacctgcgcactatgctagatttatggcagcactagcactatggaacagaggcaggaggacaaggcttctgtgtaaatggagcagggataattgggtgtccacatggaaaaaaaatgaaacttgaccccatatttataattgttcaaaaatgaattccagggggtttgtagatctaaatgtgaaaagcaatttattagcttaccgcctttgaaaaagccattttaccatgagtgattctttcattctttttggagtaaattgaattgaggagatcgaactaaatgaactatggtgatataaaattaaaacgtaattaaatgtctgctcttcaaagttttgaaatgagtgtttacttaaagtgcttcttgtaagttttttgtaaagcattttatcaaattaggggtgtttccttctactttgagtttgcttcaagttgttgctacaaatgaatgctaaaatttattaaatctgtctatatatttcgagatgatcttatgatttctggctttattctgttaatcttgtgacatttagtgattgttttttgaatgttaaaccaatattttattcctgaaatatatataatttgactgcaaaatattaccattttatatacttgtagattttgtttgttaatatttctttaggatttctgactttgtgttcaggggtgaactaggcctttaatttcctgtgtttgttacgatcttctcaggttttgatgttaagattatgatatcctcataaaactagtttagaagtatttccattttctagcctctggaataatattttgaagatttatgttatttctttcttaagtgtttgatccaatttactagtgaagtcacttggggctggagtttcttttgtggaaagtttttaaattacaattaaatttttaaatagttattaggctattcacattttctgttttactttgtatcagttttgattaattgtggttttttctagggaattgtctgtttttaaattttcatatgtattggcacagctgggcgctgtggctcacgcctgtaatcccaacactctgggggacagaggcaggcagatcacttgaggccaggagtttgagaccagcctggccaacatggtgaaaccctgtctctactaaaaatacaaaaaaaatagctgggtgcactggctcatgcctgtaatcccagctacttgggaggctgaggcacaaaagt

SEQ ID NO: 119406 - DNA, 1409 bp, Homo sapiens
aattattaatattttatcaaattttacacacactgttttttttggcatatcaaacctcttagagtttgcttttcttcttaatgaagtatattgtttgagtatttgtttctgtgaggggttatgagtggtacattcttttggtctttgtatgtctgagaatgtcttcatgttactcccattcttgaatggcagtttaacaaggcataacattctggaaaggtagtcattctcccttagctctttgaagatgctatttctgccttctggaaaagtctaatattaatcaaagtgttgtttctttgtagataataatgccttttattttgagtgatgtttcagaatttctgtttaaatttgacattccctaattttaatatgatgcattttggtttggatttgttttggtttatcctgcttagtatttggagggtatttttgttccgggattcatatctttactcaactctagaaaagtctgagttattactctccttgaatagtggctctcctagattctctctattaccttctctaggtttcctgttgtatattggagcttcttagttatcagttatcttaactattttttggtatttcttatttctttgtcttgtattggtgaatttgtcagtactttctaccagtttaataatttcctctctaattttttaacttaataatgtttactttttatttctaaaatgagcttcttttcttctccattttcttgtttaatttctgtctgattttgtttcctaatttcttgcttttaaaaatggttgttactttgtttagtaatttgaatatcttcagtatacttgttttaaagcctttagctattctgtattattttttatctaaaatgagttcatattcttgttgttgatttaattggttgtgtttcttcatattataatttttcgatgtttcaaagtctgactttgcaagcttattttgaatacatgctcatttccccccatttttgattatcaccacttgtccatcttgtctaccaactttttacggcatcctcttgtccctagggtgcccagttaagaagtggtcttttaacggcgttatagagtgcttgccttctgattatattgtcaccaggttagtgggggttttggctcaatacctgatcaagagtattgagtatctcttctttctgtggcttcctataaagcagtaggtgattcaaagcatgaactcatagcagcatcatgacaggatgttgaaatgaggccccaaggaaataatctccttaacattcaggttttcggatgagtgttcatcagaaagcaagttatatggcatgtgtctgtgtttgttacatctgccttttccctgccctgacatttattggcacagcccattcccacagatgtatattttatgtaagtcagtca

SEQ ID NO: 119407 - DNA, 1038 bp, Homo sapiens
tattgctgcaaacaaattgctgccagtacagattacattgttaagcatgatggttgaaaatatatatcacatttagaccattactggccacaaggaactgatattatttgatgtggtttttgaggttcgttctttgtcttgctgttactcttctagatacatatctatttgttgagtatagcctggtgtcatcaccctaggtcctacatgttaagattcctaaggttcagacaatagatggaggataaagagttgattctaagagtcttttaaaattctgcccatgtttatgcatatatacgacatacagtcaaatccatccccaacatcatctttgagtgtatgatgagacagaagagatctgaaatttagaggccttggaattatttagctagtcgctagctattttcccctgggtcactcacctgactgttctgtcactacattttctcactggtaaaataagttcagatactctcaaaggccactccttattctaggatgctatgaaagtgagtaggattttcctatctcctcttctgtgtacctcagattgcattgttactcctgacattcatcttgacttaatcttgccagcttaaaaaagttgttgtgaaaagagatgagtgtttctctgttgacttgtgattatgtgaacagtgcagagtgcaagccctctctctgcttctgtctggtctgtctctgtccttccccctttctgtctgtgtctcttgctgtttttctctatgtggcattttctttcactctgtctcttgtcactcttgtaatatgcggttctgattcacgttcaactgtcaacatagcaagggggaaatggtcccaggctgcataaatccacaatgggagtgatttctctgctctttattaagatttttgttgatgtatgtgacattcaacaggatttatcccaaacacaagagcgttattaattatttataaaacatttctgagcatctgctcttgtgccaggcaccgtgcttgaccctggggacacaggaagtatagtttcctgccttc

SEQ ID NO: 119408 - DNA, 1015 bp, Homo sapiens
ggtgaagtcagggcatattgttatgggggagaggtagttgctgagcaagcactggcatgggttgatgcttgggaatggctgtcaagaggacagagtgcaaaggtcaacaggtaagataaaggaaagcttcctccagaaaagaggactgcattaacaggggttggggagagaggtagaagacggatgtcagggtcaggcatacagtgtttcttccctgcctgcccaacatgctggactctttaaggatccttcaattcttgaaccttgcttaaggacaggttatgtaaatgctagtcatcagcaaaagccaaactcacattgttatttctttttaatcatagctgtattaagcttttggaggtctgttctcccaaatgtttctgtctgttaagcagaaaatatttcttccttgaccaaggactgaaaagtgaaagaaaaaagatagaataaaatgttctatctagaaagtgctatctagatttgaatagttggaacatcttcctaaggtgtttattttggtggatatgtgaggaaatgagaagagacgatgatattgaaagttgacttgcattatttgtttaaagttttgacaattttgagtattatggtgtgcactttgcattctggtgcagtgataaaaaccacaacatcttctctttatttcactcttctgggcttaaatttgcatctttaatattgtattaccataatttttgcatattgtaaggtaattcagttgccctcttcctgcatggttcagatttccagttttgtatgagtttcttattattctcacccagtttcccaattagcaccttgttaactacacacctgctgcacagaaaattgtattacgccatttagcctttttaaagaaaaaaagagagaatggaagacactctgttaataggttatttcaacctcaaaaagtgatgcctctgggcacagaaccacaacatgattgctgacggggagaacctgattgtttaatagatgctagaactggaacaagaaa

SEQ ID NO: 119409 - DNA, 1041 bp, Homo sapiens
gcatctgcttggcttctcaggaggcctcaggaagcttacagccatggcggaaggtgaagggacagcagacacgtcctatagtgaaggcaggagcaagtgagagagacagttgggggtggggaggtgccacacacttttaaatgaccagatctcacaagaattcactcacttttacaagacagcaccaagccatgaaggatccacccccatgatccaaacacctcgcaccaggacccacctccagcactggggatgcaattcagcatgagatttgggcggggacaaatatctaaactatatcaatgcctaaaaaacaaatagtaagaaagagatcgatgactgcctcccatacaaatgtacgatctcctcttgggagttctaggtttgtgccacagcttccttgcccacctccccaccccaagcccgtaacaagtagcctcattttattccaggaaaagaacttagaccatctgacatgaaatcccccatcttttctcttctccacttctgatttttttcagggtgcttctatccatcctagatctacttaatcaaaatctttggggatggaatccagaaatctgcttttttaaaatgctcccagtgattcttctgtgccttaaagtttgggcacttctgaccaacgctatagtaataaccaatggactggttccactaacttggttcttcctatttctggccatcatccacatatcatggtactgtctcatgttaatagtttaatgctgtcttgtttcaatagttcctcattacttaaggaatagatcttgagttccttagcacaatatcgaaaatatttgttcactaaatgtttcttcctatccagtctgcctcgccccctgctcccttatacctgctttttggcagtcacataggacttctattttctgaagtcagtagaaatttatttgttgattcactgattcaataactctctgttgagtctctgttgtgatacagactctgtgctcagccattgagttcatgaccaagacatagccccttccctcactgagatta

SEQ ID NO: 119410 - DNA, 1004 bp, Homo sapiens
aacataatgactacaaataatgacttacctatgttaagtacttatggacccacggtggctatgctgaatactttgcatgtatttcctagaatctttacaataacaccataaagaaagtacgaagagtgtcccattttgcagatgagggaactgacatttagagaatttagacatctgtcctacggtacacaactatcaggtggcccatacgaaattgcttttttaggtatcaaaagccagtcacttattaaaaatttcatgtagttcatgctgacaatttctggcagagccattgctaccagataactctaagtttgtgtgtatatactgatgtaaaactctccatggctccatggctgggcttttagtcagatttcaccaaattaaaaagatgaacttctacaaagttaaaaaatttttgtttgcactttcagcaaaatagctctttatgttaaactctgagacatggaatactgaagtttatgatatcattgtggttgcaacagtgttcaacttgcaggttccatgatggttgatttttgactgcttgagtgtgtttccctgcaggcctgcagggtgagctgtgaagctcacatagagacatttgagttgtattaaaatgggttagccaaggcctaatgggctgtaaaaaataatgtgctgtggtggtgtgtctgatgatttccagccctcattctttcatcattagaccagtgacaccctctaaacaaacatcttaccagtcaatggataagtggtccctgtgtccaatacataattctcatgcttaaaattaaaaagttattgtaaaaacaaaatggtcactatgcctaatatatcactgttcttccttagcaattagaacctctaaaatgagtgaaattagaataaagaagaacatttctatcttgtttgcatgagcagataggtcttggacctctggaagttcagctcagtccaccagtgtttattgagcacctgcagccaggtgagaggcattctgc

SEQ ID NO: 119411 - DNA, 1056 bp, Homo sapiens
tggaatacacacacatatatacttatatttacatataaacacttatatacacatatatatgtcaatttctttattcatttatcaatgatacttaggctgtttccacatattagctagtataactaatgctgcaatgaacatggggtacagatctctcttctaaatactgatttcattttctttgaatatatgcctagaaatgagattgctagatcatatggtagttctgttttcaatttatggatttatggaggaagcagcgtactattttccataatgattttttttcaggtagtttattattagtatatagaaacacaactgatatttgttgatttttgtatcctgcaactatactgaatttgtctattagttctaacagatttttggtgactctttagagttttctatatgtgagctcatattatcttcaaacagacaatttatcttcctgccatatttggatacctttgacttctttttcctgcttaattgctctggctagcacctctagtattatgttgaatagaagtggcaagagtaggcatctgtatcttttccttaatcttagaggaaaagctttcagcttttcaactttgagtgtgatgtttactgtgggcttgtcatatatggtttttattgtgtctaatttattgattgtatttatcatgaaagggttgcatgttgtcaaatcctttttctacctcttttgagatgattgcatgatttttatctgcattctgttaatgtggtgaatcacatttattgatttgtgtatgttcaaccatccttgtatcccagggagaaattccacttgatcatggtgtatggtctttttaatgtgcaactgaatttaatgtactagtattttgctgaggatttttgcatccatgttcattagaaatatttgtctgtacttttctttctttctttctttcttttgtagtacccttgcctaatttaggaatgagataatgcttgtctcataaaatgagtttggaagtgctccttcctctttaaatttttgggatagtttgagaagggttgttgttaatt

SEQ ID NO: 119412 - DNA, 1107 bp, Homo sapiens
ccagattccaaatagttaatattcttaaaccagcaagaagcccacggtcattttgagaaacaggaatagtgatttgggtggaggtgagatgtgagataccctgcaagtcggatgtgaatgcccctgccaggttctcttctggcctctagtaaccagtggaatccaaaatttgggttgcacttggtcttttcagtttacaatgtaggaaggacaaactcacttataatctttgttaggtttcccctgcctaacttggttaaatccagcatgtctcagaggtacttgacaatggcccagggttttcacagtccccctcgtgacaccctgtgggatagttttggtcaggtgacaatgtgtgaggtgctgagcacccgcttttgcagatgaggaaacctggatgcagaaagctggcagtttgtgcctggtcagggagaagaaggcctggcgctggcactgctgccctggacggaaagcagctgctccagaaagcactcagtaccttcttcttctccctactaagtttggcatttgacccaacagatggccaaaaacttgtaaatattcacccatgttttgttatttgaatggactgatcttactgagacttttgcttgctggatggaaggtgtggctgtctttgggaaggggagagtgacctgaccccttgaggactttgggccatgtttgccaagacagctgggtctgcttctgctcctggtgcacagtgccacattttgcacttgacacctctaaaattccctttcccctctggcctatgagctcttgggaagcagggaggaagtctgagtggctgaagcagccattgcaggcaagacacagagcggcgcctgatgttcttttctctggtctgatgtttgagttctgcaggccaccgcctgagctcagagccggccatttctccagcagcactccaaactcacagcactctgctaaccaaggcattgcagggacccgctgtgaactttggcgtaggctttgttggactcatttgaatttggcccaaaagaaaataacatttcacatttctccctaacgtggagaaattgaactcattgtcttttttgttgaagtctactctaatattaa

SEQ ID NO: 119413 - DNA, 1038 bp, Homo sapiens
aaatgttttcagaagtaatcaactcagcataaccactttccctgggtatttctgtcaccaaaaggggtacaaaacaatgcttccaacacaggcataaggtgaatgtctactggggggctggggtcactgcagagaaaaaacagaaacagtgttaattctttagcactatggaggtcaggaagaaatcgaaaacatgtagtatcaaagcatctggccccaaaggaccactagaccaggacatgggggtaggggtagggtgaggaagaaaggaggaaggtcagattcaagggggtccagtctgtaaaaggccttccttctgtgagatttggatgtttgacatttgctccaattttgaacaagccactggaaatcacgtcttaagttctttgggttcatttcaatttgctccttttcctctgtacactggaacagtcagaaggccagctttgtgtggattcaggcaaattcaagtgacttcgctagctgggcctcagttttaccttgcagcatatagagtccctatcagaatgggggccttgcagagactgagatgatgtgaaattaacaagaaactgtgagccagctctgagagttcatcctctaagtatatttgaggttaaattcaaggttaggggttcgcagacctagcttctcattatgtgtgttttcacctagcatctccactcattttaaatgaggcagatggaaggcttatatctgtctcacagtaagcatgattaactgggagaaattataaccaaaaccatacgtgagttcacttaaagtacatgatggcacaagaccatgacgatacagaaaagaaatgctatggaagatctacacagatgggcaaacctcctgcaaatattttacgtctgagaggaaaaatagagtgtgacggtaatgccgcctccagaaagactagttatttaaccgaaaaaaatgaacgtaaaagattaagtgtttggtaagttctgaagatgagatagagacagaatagaaaagagaagttctctgtatttcttctgtcaatatatt

SEQ ID NO: 119414 - DNA, 1052 bp, Homo sapiens
acttgatgagtctcgtgtggtttcttaatgaagtaacagaacaaaagttgcctgagtaggaactgtgcctaactctggccaacacagtatgctcctggtactcagtgaaagtaagaataaaaacaaaaattggaacaaagtgagaaaatctgtaaatatcaaagcagcatgaaatcataagttaaaacaacctgaattcataaagtaccaaactcaccagccaaatttgataagcagtttttattacaaaatgaatagatggaattaaaagtaagggccatcaaacatttcgatggaaaacaaagtaactgatagtgcatgctattttttataggtaaagctgatttttaagtgaatttagataagaacacgatcgcatgggctataaacagactggaagtgcttatgactcaagataattaatctaaaagctaaattaatcattcgaaaaggaaatgtcatggaaggcaccatagggataaatgttggatttggtgttatttacataattgttaattaggctgaatagactacttctggaaacagtagtagaaacttggactaaatgtttgtgtccctcccaaattcgtactttgagatccaaccactagggtattaggaagtggagctttagaggggtaattagttcatgagggtagatctctcaggaatgggattagtgccattagaggaagagacagcagaacttgcagctctctctttctctccccctgccatgtgaagattcagcaagaaagccgccatctctaaaccaggaagagggccttcaagcacccaaccatgctggcaccctgtggcctccagaacagtgagaagtaaatgtttgttgttcaagccaccgagtctgtggtatttttgttacagcagcccaagctacatcagagcccttagttttaaatgggaggccttggggccgggctcggtggttcacgcctgtaatcccagcactttgggaggccaaggcaggtggatcacccaaggtcgggagttcgagaccagcctgaccaacatggagaaaccctgtctctact

SEQ ID NO: 119415 - DNA, 1074 bp, Homo sapiens
ttccggtcattgaatgactttattgggtttgtaaatcctaaaagttctacatgaaaatctgtatttaagaagatatatacatttctggaacaagaatttgaatctgttttcatatcctcggggagacctttgtcctcctccctgacaaagttaagaaccattgtgtgaggaaacagagtcatgtcgtggctgctttgtaggctgcactttgcctgctccaaacacacagcagtgacagatcaaaatctaaaaagcgaaaatgaaaaagtcataatcgtgccccctactcccctaaaaaagatatatcactacagaccagagacaaacgcaaagcagagtgtgaaaccagacactgtgggctgcaggatcgctagccgggaggtggaaacagaggcttagctctggtggcagtaagactaaatgtgccaggccagagcattactctgcttgaaagcgggcagggtagtggtcctgtcctctgatctagaagggaggcccgaatcactgcctgccctaacctctagcctatagaaagctttgatcctgggaagagcacaggacagagacaaggcctccttctcaggaactgagctaagcaccccatgtcatcatcagccgtatcaccattgggcaagaacccagaccaccaagtcaactccattctgtgtgaggggttcgagcagaggaaccataaaaacctctgagcagggagggtgatcagcaagagaacattcacaattatctcccatgcaggccaagcctgcccacccaaattccatgccacgtgaggaactctgaccttggggtgtcagccatccaaatcagcaatcagaatgtgaattcactggagactaaagtaaaataaaaaagctatcttggaaaaaaaaaatgcctgatgccctcaaagagaccattggagaaataataaccattaaacaaaaaaggaaaattctgaataagaggcaaaaactggcagaaatgaagggtaagtagataaggaaaaaaattagaatctcagaaatgagtgatagattcattaaaataaagaaggaaaagcagatgagactactagac

SEQ ID NO: 119416 - DNA, 1035 bp, Homo sapiens
gtgcaagagaaggatagggtgcagtaatgggattgatggagtctgtgaggataccaagtgaacagggtggctgagggccagaagtgaggtagggagggtgggaaattttatatggagaaagccacttagtgtgtttaagaaacccagtaggctgggctggcctgaacctacagaacgtcggaaagaggtagaagcttttaggaattggaggctttctcctggggcagtggggagccacaggatggtttttaccaccaccgctggttaagcacctaaaagaaagcccacatctcagtaaccatgatctgtagttagcctcttatttcccaacaaaatcgtatgtctcccattcaaaaaaacaaaggccactagtagatatcccatgtccgatacctacctattagtggattaaatgctttcttttccgttaaaccattaaactttttatattttttagcttgaaataggcttgcaatataataagctgtctgggtttttcttttaaactgcatggattttaaactgtatttaccacaatgtatattttaataatgtcttggggcatgtgttctggctgcctgcgttattatcatattgactgttgtccatgaattgttgacacgtgtttcattgggacaccttctgccatttctctgtcaccgtgcctggcatcagaactcaggaagtgtggtacctcagcttggattaattgaagaggagattccatgctaattcttggcaatctcagtctcttatctccctaaatttccattttccataaggaacaaaagggaaaacaacctgtgtaaccaccaaactcctgtcatctattgttacattaactcatgggtcatttgtcacagcagtgtgacttcaggagagaaaacaaaacgcttctcaggaaccaatatattttgtcaacagcacccggatgctaactatcgtgtttgtatgaaatgtgtgttctaaactgatgcatttgtttgacaactttattgatatttcaagttggataatcatttatgtttgagcatt

SEQ ID NO: 119417 - DNA, 1072 bp, Homo sapiens
ttgttagcctcttagcaaatatccggctgtgatcaatgatatttcattctggttgccctctgagaattacgcagaaaatgatttctatgacttagtccgaacaattggaggagacctggtggaaaaggttgatctcatagacaagtttgtacatccaaagtaagtgaaaagctttctgattttacccttgactatctctgtgtgataaatgtcatgtggaagcatatcataaaatttgctgaaacccagggtatctgagacaaaatgtcttctgaatttgtagtgaatgtatagcttatcagaaaactctttgatatcagtcgtctctgaaaatctttccaagatgcattttccatctttcctgccttagtaaagaaaatatatgaaacagaatcttttaaaagtcctgcagcttttcagtattgtttttggaagtgacttcttaccttagcatgttccaggtgcagaggaaatgggcagaaagagcagtttgtggagtagaagctgttttgatagtctctcagcaaatatttgttaagcacttaccacacgccaagatctatattacgtcctaggaattaaatgtgttccaaacagacttagctctgccttcttggaacttatagtcttgtgagagaggcagacgttaaatacataattatgaaagcatgctattatgagggaaaaatgcattgggtgtcatcaaaaaactaatttcatgtggggagtcagggcaggccactttgagacatggaagctgagaacagaaggatgatgggcagtgaagaaagaagaaggagcatcgcagatagcacatgggagtcctggggggaaaagggcacatgagatgcagaaggcagccaagaacacggcagctcaaggaccaagggggaggctgtgtaaagtgatgattgttgggtagtgatgtgtttccagggccaggtgggcctggaacctgcaaggtctcagacttggaattttaccctaattgtagtgggaagctatagaaggataggagcagagagataagtgacgtgatttgatttgcatttctgactggtcacctttaaat

SEQ ID NO: 119418 - DNA, 1106 bp, Homo sapiens
cagaagtttctttaaaagttgaattgagggtattcttttttcttcctgctacttcattgtgactgtgatggctagtattcttgcagccattttgggccatggtgcggacttggcaatggagactgtatggagtggagcaacaacatagaagaaatagcctggggcttgaatctgtgtcacttcagccctggacttgtagctgagagagaaataccttgtttaggccacttattttttagatctcattattgacagccaaagcaaaacctagctattacagtactgggaaatatacctgaggaaaaggacacattatttagtaatgatggcttactgtgcagtgatcctcaataagtatctagggcaagggctgaccagattgtgaatatttttgacgttgtgggtcataagatttctctcgtaactactcaagtctgcaagtgcaaaagcagtcacagataaaatataaacaaaggagcctggttgtgttccaatgaagctttgactacaatatcagacagtggaatgtgaatttggcccatgggctgtaggttgctaacccttgatttgggggagggggatacatgaagttttttttgaagactctgactcccaaattccaaaaccctctactgggagatcatccttccttgagcaccctgtgcccatcctccccatctccccaccaagtccctgactacttaggtgataggaagtgaatggtctcctgaccttgaaccttgacctcaagatttattttattccataaacatataaatgaaatatagcctgatagtgcaaaagagcgccgaccctttctttgcctaacatcaaagcatgcttaagtgtgagacgtgataggactgagtgaaagacaaagtcgttagacacgttgcatgttattttctgaacaaaaacagatcccaagatgtttcagggagacataaactgccgaagaagagcctaatttcataatattagacaaatggagaaattttttcttgattacaaataacagcttgtgccctgaaggaggatagatgttcaggttagaagaaaatggcgttttgttccagccagtcatttagaaccttctcccagagggt

SEQ ID NO: 119419 - DNA, 1077 bp, Homo sapiens
gagacttgagaaggcaatcatgtatgtcagtatatgaacttgatatcccctccatcacatttgtaatatgaatacattgatcatcttcagtctccaagttcatgcaccttaaggaattatggtgttgttttttgttttattctgtaacaccagttgctcagaatatttcttagcaaaatggggtatgaggaagagtgaagagtatcccaggggaacttagccattgcctttagctgccaacacttcatttggagatgccagctgattatttatgaactgtggagatggactgtaagacaaagtagaccttaataggtcagatttggtctggctttaagacagacctttttgagagtgggaattggggagtaaaattttttttttactaccatccctttcctttgattgcaaggaggggtttggtggtgaaaaatgccccaggtatctgcagcaagggcaggtttgaaagggtggattcactgatgcccctaacccgattctgctcatagactcactccttgttccggggactgctggcctgccacttcctgctcacagtcgcagatggggcttcctgagtctgtgcactgtcagtcagagctgagatgctagaggtgagctcctccctcaaccccaggtcactaaaggggcctctcagttctcttcatccctacttgaacttcctcatggttatattcccttttgtgatctatcacttgccattttttataatttggcttaagtgggtagactagaacacttgtgaccatgtctgacagaattctcaagagggtcttcaccatgagaggcaccttctcggtgtggctggcctggcttcccagtgtgcatgagtcatggacgttgacctggtcaaagctcttcctcctgcagtactggagcagtgcattctccttcctgtctccctctcttcattcttttttccatatgttcattcattttcactttgtcaaattacacccaataaaaatgccaatgcatacaaatttgaaaatagaaaagatgagattcacccatcatctcaacacccgaacacaacagctcttacacttttacatt

SEQ ID NO: 119420 - DNA, 1068 bp, Homo sapiens
atgagtagtcttctagtagtcagttcaatggtagaaaaatactttggatgatcatgtttctttaaatatcccacccgttgtgtctttacttgtatttattccacaaatgttcataactagagaatacttgatttaatggatttatgcaaagggttggtgtctcatggagcaagcaaaacgtcctgactctggaaaccagacctgcctcttcatacttatgtgtctggtaataggcatttgaaataatactgcagggaagtttcacgttgctgtcatttacccgttctgattttccttcctcgtatagctcacttgaagggtgggataagatggctgaaagcgctcctgtcagccctctctgagaagggagaattacacagacgtgatgattggctatcagagttccccagcactggggtggcccacttaagacaagcctcattaaattcacttcatcaagtaaagccggtgtgtctaacttaagaaagaatgtggcatgcaaattaagacctgaaaatatgaatggagtctgagcgatgctttgatcagcatttcttaatatggcacatgggggagaaaacttcttaaagttgcatttacttcccctcagttttgtatggcaggggaatctgttcacctgctacctagaattgcctcctccaaaggagaaacccactccttgggaagcaaagtgcaatacaataccaagtatgcacaatttgaaattagacttgacctccactcacctcacaaactaaaaacagcctccccaaaataagagaaagaaagctgggaaaggaaggtgtgaggaacatattgctgggaaaacagataagagttgattatatttagaatttttttcaacccagattgaatcaatgaatacctatgcattgaacatcttagttttgggattcctactgcaggagaatctatttaaatatgaatcccaaataaatttatatcatgtctgatataggaataaatctggcaatattaaacagatcaaattctcaagacaactagtctgaatggaagctattcttagcatagtttaagtaaaggaga

SEQ ID NO: 119421 - DNA, 1076 bp, Homo sapiens
agtgtagccagaagtaactggaatgcaaagcctctgtgtgcccttcgacccagctaaatcattccacgggcagattgatcaatttcctgagctttcatcatgatttctggagttcagttgtcttgcagttgctatacaatgtagtttttgtcatattccctcttatttcttaatgtgtcctggaaggaatggaatatgaagtctttgtagagtagtggctacagcactggctttagaggccgccctgagtgcaagtcttggctttgccacttgttggccgtggaaccattcgagcaagttactcacctctctaagcgtcaatttcttatctttgggtttaacagtgaaccgaccttagaaggttattttgcactgcctggtgcataacaagtgtccagtaagtgttattgttgatggtgctggttacatcctaatggtgagtttcctctgggaaaaactaattgtaattaagtacaagcattaaatacaaacaaagaacagccaagtttctaatgagcaaactttgtgttttatgtttactctagttaagcccatgctcaaaataggcacctagttgctgatgataatttactccaaacaataaaattactttcttaaggtctaattgtttttgatagaaaaaagaggaaaaaataataaagcaggttgaagatgtcacaagctgggaataaaagtttggtgggtttttaagatctgaaaaagaaatttttttaacaccttaaggaaaaaagttgcaatatacttttgtttctttttttatgcacagtaagtgttataggatgcaggtgacacatgtgctggtggggaagtgaggtagaggaaatgagaaggacgccccatgtagaaaatggcagaatcggaacacgcacccagcccctctgtgtgcagggtggcgttggatgagacgtgcagcctggccaggcctcatgtcgttgtttccccaggttttgatttaggcccgaagcccaccccatggagtctacatggcaaagggagcctgcagaaggcatgtgacattttgtatttgcatttggaattcagtgagctgctgattt

SEQ ID NO: 119422 - DNA, 1362 bp, Homo sapiens
atttctctaaaatgcatgtacggtgaaattgattgatgtagtagaaagagacctgtgttctgaccccagcttctctctcatctggacaagttacttagcctctctgagccactgatgtaataaccctaccttaaaagcagtattataagtctaaaatgagttgaagtgcttaaacgtacatccacatatttcaaagcaaggtactggatttttcattttgacatgtgtttcttcagcctttcggtggccagcatattcccagtgccagggcccagtctctctgcctttgcatttcaagtcccatcatgggagttaccacttaaccagaagccatattgttctcagtgattatttgaaatttgcatatgaaatgttaccatgtttacaccctgtacttaaaagaactcctaaagataggcactcatctgggaatcatgacagatatcttcaggatacctttggggattttcaagaatgagaagtagatttctcttgcttaagtagaggggtgtgtttccatggggtcctttgcataaatgccctatgggaaactctggtgcctgggaaaggccatattctgttgtaaactggggaatcagacctaccttcctctcttcttctatccacatttgttctttatttgcaaatgagtcagctaagaacagtgccaagcgaggctcttgagtgtaagcgcttgaaaagtgtcctattgtacttacaacacttcgttgatgaccagtggctgcttaccactgaagatggggtcagtgcctctgtgctggggtccctgttgctgcctgtcacatcctgggcattggctggaacccagaggtctttgaagagtgacctgctttattccactcacttcagagcattagtgccccaagtgggtcccctgcttttcctcagtggtctctttagtaaattctcagctcatctggtgggtttcggaaaaacgtttttttaacatcgggatccattttgccatatctgttccgttattgcactgagcttgtaaaagttgtattcccaagataatgtttaacttttgggggagtgtgtgtgtttcaagtccctttttcctttaatcatttgagggaacttttgtcaggtgtgtgtgtgtgtgtgtgtgtgtgtacctgagaaaacgcgcacacatgcctggatgcacacgtgtacacacgtacttgcacatgccattgagtgcccattctgtatgaggtcccgtattatgtactggtactgtgggaggaccaaggctcagagcgtctgacttacgggtttaaggtctcacggccattaagcagtcatggcaggattaaaggagatgcagcagatctgaattggcttcatatcacggca

SEQ ID NO: 119423 - DNA, 2055 bp, Homo sapiens
ccctgttctccacggtcatcatccttggtggtcaccgtacctacatgtaggtccatcggaaagctgctgtttgacacttactgactttatgtccctctcactagactgttaactccttgagggtaggaaatctgttgatgttatccttggtacttaccataatgcttgcacaattagaatattcactgaatgaataagatctccttagccaaggactcacactaatactacataggtgcatacatacatatatgtatgtgtatatttgtgtgtgtctgtatgtgtgtgtgtatgtctgtatgtgtgtattataacacatgcatatgtgtatatgtatctgcatacacaatacatattttagacgcatgtagcttatcattttgggaggaataggtttatttctctagggcactataaaggtagagtgatagacttaagcttgagctacattgatccaggacaatccatgggaagtgctcttctgagcactgtaaatccccaataggacttttttgttaagtttcttgtctaagctttctgattgcttggattaaggactaatgataccttatgccaaggtaaaaatgttactaaaaaaaaattgtaattttaaaaccttttggaatgtcttgagttattctttctccatctaaagcagtcattgagacttgacatcagagcatgccctgtcttccctcttgcatatggaatctaacccagcatctcaggaagaagaatggaagatgattttttaaatgtcaaaaaaaaaaattgaacttcctcctgtgcttttcacctcagcttctgctgcagaccttagatgcctgctttccagtattcgataagagaatgatgtatacagctgtaaacaacttcaaagaaggacacacttgaaatgccttgtgtgctgtagttgctcgttattttgagttcagtccactcttagggcaggcacagaaagacaggacctgtaagtaaactcgctggattcatcaaatctccacagaccatttgatgtcttcgaagagcccactggatcctgataccccagtcccctgcagccttgaagcgtgttcacgctggctgtggttgggtctggccctgcaatgcaggacatctggacgtgaacacagcctcttcccagagagatgagcttaaagagaacgacattatgggttcagagcatgagtttcaggaaaaagcttgattagtaatttattttaaagaaatatttacttacgattacttaaagaaataaatagcttcattctaaaaaaattcctgtctcccttaggatctgtcttcacacgcacaaattttctttcaggaggagggagcaaatgtacgtgggtgaggcaaagaactgaaataataatccacctttgatcaaaactccttgttatagtgttccctgtgaaaacgatttctaatcaatgagcgctgccacagcacactgaggagtaattaccttacacgtgcttcactctgagctgtgattagaaacaagatgtgggctcagaagggcagacgacgaatataaggagaaaaacctcagataggagccaaaacgtgcaggctgtgagatactgaataagcatggaggtctgctccagggagtgatgccgacattcgttcattcactcggtaaacatttcctcactgtgttgggcatcagtggtggtattagcagccacgttaaggtaacttatcacatgctacccttatatacaaagataaggcaactggctggctctcactgaagtatgaggttgacttcagaggtgctctgtactggaggggggtttgggttgctaagactacaccttctgaccagacttcccagtggtttggagccaatttccaagggtaaactgcttgatccacagtctaccagcctgagcattcattgtacctgggcttcatgagacactagggcctggaaaagggaaagaaagacttggaataattctacctagaagaaaaactcgaggaggggctagggtcaagtgtgtggcagacttattgagaaggtgaaggccatttggtctctgtaga

SEQ ID NO: 119424 - DNA, 1672 bp, Homo sapiens
gcgcaccaccacgcctggctattttttcttttgcattttgtagtaatggagtttcaccatgttgctcagactggtcttgaactgagctcaagcaatctgcccaccttggcctcccaaagtgctgggattacaagagtcagccaccgtgcctggcctgttgtttccttttaacccttgttttcagacagctgcaagaatgccagcagatctactctcatgaccttaaaaacatactcagcatctttagcccaccttggccacccaaagtgctggattacaggcgtgagtcacctcgaaaacattcttgttaggtgatgtgccccagaggaaagcttggacattctgaagtttgacctacctgttctaaactatcattggctgcttacttattgtgccatgttcctaaggctcagcctgcattcctacccctagtaggtaatgatccagtttttaaaattcttaccctctccaaaaggattgagagaaactagaatgagtggcaggcttattagagcagttgttctctggatacgtttacaaatgggaatagctgcacactcaggatcattgaagactcacctaaacataacctagaaaagagactgaacaaactctcagagccgactcagcacttatgattctgaagaagtgatatgcaggcacagaatagtaccttattaaacatctttgtgtgaaaggccagctaaccaacttggatgagaatattctccccaccttcaagggtgcttaagtttttattgggttacttctgcaaagcttctacccatcagtaaatattagccaccttggaaacagtacacagaatgacagtcattctccctctggtgtaaaattaggcactggacaagagtgcatttacctgcttgcaggcagaattaaaacagccagaatgtgctttaagtgtctaaggaaaaatttggccaaggctctgggccagtgcgtctgttgttattttagatttattcaattagagtcacaagcaaagtaaattgagctgtgtggttgatttgaatattaccttggaagacagtgtaaagagattaacaaaccctaagggatgagggacgagtgccaagctcctcctctgtccccacacacagtcgggccaggtttcacagattcatttaggaatgacgaaaatgcatgcagaagagcagatgtgccttttgttcagggccacgtagccattttcccgcttctccatcctctgaaacttcctctgtgtgcatgaactgctgcaaaaatgaagctggtgcatgtggaggctgtcagatttaagaaggtggcctgccctgagaactgggggagcttgggtccagtcgaatcctgcttttgtcttggcaaatgtattgtctggcacagccggctgcattcagttgacgtggtgctttgacagattggcatgggtgaaatattaaaagtaattgcacgggcctcatatgttttcagaggctataggataaataagccatgcatttcaacaaagaaccttttcagtgttaccatttttagtgccatgtggcaattggttgtctcacactcccttcaaagagtgaggcatttttacatgttttttacttagtttaacggaggtagggactagaatgatgccaggaagccatcctgtttttaggactgaaggggcattttt

SEQ ID NO: 119425 - DNA, 1073 bp, Homo sapiens
taaagtagcttgcatcacttcactcttttaaacttttacataaccaaagtttctgtccccagtacacattgtttggaagatttgagtggttgggggcaaccctggaaccctgaggcaagcttctggtgacccttgaggtttacatgcagggccaggagctgagggtgcaggctgctgggggcttcattcccaggaacaccgtgaaggatactgtggtgttcgccctacctggcaccagaccagatattatacttaatgcttaatatacgatatctcatttaaactgatggcaactcaataaagtgaatactgcagctattaccattttatagatgagaaaaccaaggcttagagaactgagtaacttgtcctcagtccacacaagtaggtaagtggcaaagctgggattgaacccccagtccatgtgattctagagcccgtactcttatccgctaggctgtgtaggatagactgatggggacccacaggccaagtttggcagatgtggtctagggttgctcatgagttgaaagcagtaattgttggtgagtgaggcctaaaaatatccttctcattgcctttttgataaaaagaccccagactttttctgagaaggggcttcttagatttcctacaggtactttgatcattgggaaaggttcaggtgacaatcgtattatagggcaagcaagggaaagggccccactgccggacccattttctttcctgttaggaaacctttctaactaaggtcagaggaccgagcctggggttttaaaagaattcacggagcaaaagtgcaggggcattcaggagggggacatggaatgtggcacggtaccagcagtaggccgagagatgtcacctgaatcttcaaggtctaatggtagttatcctggtaccgatgtcaaagtgggccacatttcttttttttttttttttttttgagacagagtctcaaaagcacccaaagaaatgttccttaaaatatatgtacatcatggaagagagatatatgcacagaacaaacagatgctaactatataccttttcacatcagccataattctgca

SEQ ID NO: 119426 - DNA, 1030 bp, Homo sapiens
attaaagatggcagattgaacataagctttaacctcagttgcctctcaatacagtaatagtaaagggtttggttttttccctctcaggtataaagtaattagagactaagtgacggggagaggagacatcagcaacataattttggaagctgaaaagcagatggagaagtggagcagttaggtttcagtagacccaagaaagctgaaatccaagttggcaggggaacaatcaagaagcaatccagcttgaactacaaaaccccccaaaagattcaggagttagtagtacaagcttcctcttgaagtagggctaacacaggactgtcgattgaaaatgtgtttgaggagcagaaccctcgattttctcctcactgacgtgtagcaaaaggaccactctgccaatcaccaacaggccttcatcttggtagaagtctggagatttattctctggagatgataaaagcaaggtgtttccaccaaaacgagaagtaagctaagacaagatccacgaagtaagagttgcaacaaaaaaagcaaggcaagaaccatcccaaagcctcagctgcgcggtcatcatcagagggggatctgttcagactggagcagagctgaaggcttcagggacacttcaagaggattaagtaattgcaaacctaataacaaccattgcctcttctatttattgagtgttcattgtgtgtcagacacagttctaagcatgtgtgtattaacgattaaatcctgatagtagccctattagatggtagtcattatcctccttttatcagtgagggaattgaggcactcagtgcttaatcattagtctaaaatggcatagctggttagtggcaaaactgagatttgaacccaggctgtccacactcatagccagcataccacgcctcacccccttgacaacaggagaaaccaagctgatgacaagttaacacagctgggaaagctgggggaaacagaacgttgcacagagaagaagtcatcttagtttactgtggagctcagtagtgacctg

SEQ ID NO: 119427 - DNA, 1067 bp, Homo sapiens
tctactgtaatctgctcagtaatacaagtgagcttttctatgcaaaccctattgctccaaaaagaattgaagaaaaaatgttttaccaattcagacccacaagtatttattgtgcacctactacatggaaggcgttggaccagctgcagtgggtataatgacgagtaaagcaggctcagcccttagctttttgcattttattttgaaaaggaaaatcctaagaactaagtgaccacaatacaagtctgacgagactggtgtatgagaggaacaagcaggcccctcctgggggatcggaggggaagacatctcatttcagggatcaggaagagatagacatgagttgagggatttgcactattggaattataaaataacacatccccaaccttcattcattgattcatttacccattcaacaattgtgagtgcctgttacctgtcagatgctcctctggaccctggggatgcaccaaagcaaagctcaccttcatggagtgcagggaagagaatagtggagaagggcaggctgcatcttcgtggagtgcggggaagaggatagtggagaagggcaggctgcctttccctgctctgactctaccctggtttctgtgaacattcagaagtttcctacgtaatgctgggcagtccttggcagtcttggagtttggctggcatgggtgctgtgtgtaagtatagtatcagtggcaccctgggttctctgacagcatcaggacatcactagtagagtcagcagtgtttctcagaagcttctgccctgaccctttgaccatggaatccccagtcacattagggccctacgtccacagaggagcagcaggagcagagaccttctgtggaaaccacggctgccccatcccagccgggtcataggtcagtgtggtctgctttaatgggacataacatcctttctggaccaccctacttgccacatccatgggtttcctcctggcagactgtggggtcggatgcctcttctccaattatctctgttacagtattcactgataaccatcttagagggattaaatcagaacttacaaatg

SEQ ID NO: 119428 - DNA, 2127 bp, Homo sapiens
tgacctcaagtgatccaccctcctcggcctcccaaagtgctgggattacgggtgtgagccactgtgtccggccaaccttgttctttgacacaggtgttttaagcatacatgtggtgtgtcctaatgagaatgaaaattgtgtgggtggctaaccataccgtatatgtcttagtgctccagtgagtatcacttgagtggcttttgatctgtatttgacagatactttaataatgttatacagatattttacagatactaaaatattttatattttacatatccttatgtaatgcatatatgtatatacattgtgtatatatacatatgtatcacaatatgtgaaaatatatataaaggccttgtgaattcttttcaactattatctctttatcccctttttgtgggatgtgtatttagaaaaaataataatagaaagtaccctttattattgttcagcttccacccccctcacagttcagaagactgatccttgtatctttcaagctggaagcctttatctaaacgagggcctgtgagtttaaatttctctggacaaacccagatgaaagatggcttgttgaaatgaaggcatctcttccactgtgctgcactgattagattgaccaatcaagcttagaataggaaatgacatggaagatcagatgcgggaaatcattgaaatatttgccctcctgttacaggatcactgaagtccacttattatgagacccagaggtttcccctctgaagatgcgggaaggcagtgactatgaaactggtcctggaagtctgttgttctggcatcctctgccctggctaaatgaggttctggcttcagaggggtcttggtttataagtgctccagggagatgtatatgcatttagctacacaaaacctgggctgcattaacggttcttaaaagcagagaatatgaaagggaggacagaggcattttcaaaaattgatgttcaattttataactctcagtttccagtaaaactttccgttatggtcagtagtttataaaggagcagttctgagtcattgttaagagtggaggctcgcaggcagattgcctagattcaaattttggttctacccctcaccagccatgttggttagaaggttactcaacttcaatttcctcttctgtgacatggggaatagtcataaaaatgccttcctcataattgttgtgaagattagaaataagataacatattaaaagcacttagattgggaggccgaggtgggcggatcacctgaggtggggaattcaagaccagtctgatgaacatggaggaaccccttctctactaaaagtacaaagtttgctgggcgtggtggtgcatgtctgtaatcccagctactcaggaggctgaggcaggagaattgcttgaacccggaaggtggagtttgtggtgagccgagatcgtgccattgctctccagcctgagcaacaagagtgaaactctgtctcaaaaaaaaaaaaaaaagagaacttagaacagtgcctggcacaaaataattgctcaatatacattggtggttgttactgttattaagttattgttattacttagcagagattggaagcattaacacataatctttccaagactttttatctccagtaactaaactccaaaaacatatgggtacttcaagggggtgaccactgagctattcaaatgtacccttctattcccaagagtacaccagtgtgcactctaatatacacaagaataccctaactacataaactacattacatgtctactcatacattgcctctttaagaaatgtatatggcacagcattttattgtcatagccatgatggcatttatgttttataaactggagggaagttataagaatttttcatcaaagaactaatcttttctagaattagatagatggttagcaaaatgtatgactggatttctgtcatagaaattttcaaggagatgaattctaggagaaattaagcatcttccccccaccccaataacacaagttattggataattttaaatttgtgtcaaatggcttaatatcctttccacagaccctgaaaatacaaacatttgatatgtgctcgtatccaatttcaagttctgctta

SEQ ID NO: 119429 - DNA, 1014 bp, Homo sapiens
tcactgtggaaagcaaaggcagacgtggctgatgttctcaaagagcaatagtctagactagaggggaaattaactttcatggaataatcacacatgtagatgtgagtgacagctgaaataagcatctgcaacttgatgctttaagagcagtgagcaggctgggcgccatggctcacaggcccgtaattccaatactttgggagactgagattggaggataacttgggcccaggaatttgagaccagcctgggcaatatagtgagacccccatctctacaaaaaattaaaaaattggctgggcatgattggtgcatgcctttagtcccagctacttgggaggctgaggtggggggatcccctgagcccaggaggtcaaggactgcagtgaggcataatcacaccactgcactctggcccagacaatagagtgagaccctgtctcagaaaaaaaaaaaaaaaaaaagtaacagtgagcagtggagtcaaggttgagtgtgaggccagggagagaagagcattattcaaagccaaggagctgcctaagcaaagctccctggcaggaaaagaaatctatggatcagagctctggaaagaaggccagtgtggctggaaaagtgggggacatggtgttgaggctgaaacggggctgaggccagaccacactgggcctctttgaccatgtagggatctctcactttaccaagagcaatagaagcccctggaatgttttaagcaaggaatgtcacacgatcagatttggttttcaaaaacatgactctggctgctttgtggagggggactgaaagggaagagtgtggctgcagaaccagcgggaggctacagcacagctacacaagcaacaagttgttccaactgaggttgtggcgaggggatagagataactcagcagatcccaaaataaataaaacccaaaatttctacagcttgctacttagttgaacacgagggaagagggatgatgctgattatggaaccagatggatgatgctgcc

SEQ ID NO: 119430 - DNA, 1047 bp, Homo sapiens
atgtccagtttttcacaatgtctaaaataatatggttcacagtaataagattttatagcaggtgaatgtttacattctcatttcccagatatataataatcagtagccactccctttgcattaaaaacaagcccccctggctactgaatggctcttcaatgtagggagtatcttagccagcttggcacaaataaaacctctttccttttcagctgttttaaacatttagcagtcagatcagatgattgaactttcaaaaaaattcttcccaatatctgtttggatggaatcatttgccgtaaagatctggcattattcaaagctgctctgtgctcccttaattgaaaagccctgacattgacattggacagggcttgcctttggggccaccagcagacagctttcttcagtgcctcgtattgttaatgactcagagaatgtgtttcgatgagatcagaagcaatccactaaagaaaaagtggagaggacttgagagcttaaaagagcggagaggagagatgtgagaaaacctaaaaaaagacaaaagttggtgtggaagaaggggtggcgcgggctccatggcagatttgtcattcgtcccagtccagctatttagaatcatttttccagtgggaagagagatgaagagaaatcctgtccaaaagaacaaggaagatgtctttgaaatgatatgaggggagccagagacagacatggaggtgagcaggaccaggtcttgctccttagatctccagggaagatgtactcagcactactgtgcgcacctgggctgcactggtgtctttactgcaggcagaaaggatggatgcacgctggccagggccatggactgcaggtgcttaagtggccccacagtagatggctgtgttcacagctcagatctgtggcccccctggcctcctcagcccctctgaacagtatcccactgttagcagctctgcagtgaaagtgcaatctgaacacaaattaagtggcagctttggggttttaaagaaaaaggaaaactttttcattttagaaacagaa

SEQ ID NO: 119431 - DNA, 1035 bp, Homo sapiens
ggaagtcaaagactatccaagtggctgagaatcaagtggacccccttgactcatttccacttagaaaatgctttcaaggcagccagtgttacaccgagggtcctgccaggggagccgaggcctttgcctgtcaccctgggagctggcttccaggccttgggcatggatccctcgcccagagtctgcttggtcttgcaccaatgatttcacaggttatatccagacctcatgcttgataataaggtagtaagctgacttcccttggtttcctccacttctgttttaaatgaataattaatccattaaaagcatcatctcaaaagcacaaaatatcctataatctatgactataagttcttagaataagaagtggacattgtgttatgcttacttgtagactggtctgtctctcttagtaggacatgagatgttgaggatggatctcatcctagtcctagtccttaagagcaccaacatggacgcttcctcagcgtaggcatataactgtgatctctgaagattcctatgggtctatcattcagtagctcaagggcagctggacggagaagagattagaagtcttgttcctgcttcttaacttgttcacaaagatacttcatttttattattttggtcctgccagttctcttcatctggtttcctgtatcctttcatatacagtgatgctgaggcattttttcatttgtttgttttatttgttgttttaaagagaaaagggagtatacttgttgcttcagggcaaaacaaagaccagtgggaagaaagttatcaaaggttgatttcagctcctcacaaagagctttctaaggacaggctatttgtgaagggactaaatgtgtttaagtagagctgggcggtcacatgagaccattgtcctgaggaagctcacccaaaaaccccgatggccaggatgttgactgatggctcaccctggagagttgacatctggagcctccgctgacaagcagcatggtccgctggcaggtgaataggggccatggttctgcgggctct

SEQ ID NO: 119432 - DNA, 1055 bp, Homo sapiens
tctttgttgaatataacaaagtgaatataaacaaaatgaaaatttgggggaaaagtaaaatatcatttggcattaaagataaccccttaagaaaatcactatcagtaccaaacatggagccatccagccaaacccatagaattctagaacatcagagctggataagcccttagaacaatctgtccaaatctgttattttgcagagggggaagtggagacccagccatgcaaaggtattagcaacagttagtttacatttctttctggctgcatttacagtgggtaaatacatcttaactttagtgggttgaaaaagacaggtgctatttcctcaaacaatattttggctgctggtgatcgactcttagagcaagagaaacactttctaacatcgatgtgggattttgtgtgtgatgtgtgggtttcctgagctgctgagcttttccacaatctcctgctctattacttcgtagcccactttcctttaatacccaccgtcagagaggttctctttaccattcctctgctcagctccttcagaagtctgtgtacaccgacaataaatggtaggtctgaaaacagatgagaggtttttaaatttgaaaacagatgagaggctttcttccctcaagggatgatgtggggtttagtagcttcagctatgttgaattttacttataaatggtgatgacttgcttataatgtgaggtttattttctgttttatatgtatcttataagcagccacatgagcaaatatttaatttattgtcactcttgtactgttggacagcagcagctcatgtgaatgatactataccaattcaagctcgggaatgactattggacacccagcacactgttagggttatctgcgtgtgtccatgtgatactgaaatggctggtcccctggtcaaatagccagagaaaccagagggaaagtgaattcctgaacttcattcaattaaatgaattgaggtttagatgttttttactgtttaattcaggcgaaacatttgttattctttatgtagaaacagctgaggcaaaaatgga

SEQ ID NO: 119433 - DNA, 1024 bp, Homo sapiens
tcctgccctgctagtcatttggcctcctgatggcaaacagaggtcctgagattcggagagtgaagcggagtggctgccggcaccaccttctcacctgcaagagcacccagagccttgtccggagttgggcttattggaggagctggtgaaggagaagaggctgagttggcttaagcaccccttctgcctgcctctaaccccacaccttcagatccctttagctgcttgcacagctcatgacctatgaacgggggtggggaagaagtaggcagaatggagtctgacatgagaaaagtgtcaataacatcccatttcttgtgttgattcttgatttctgttcatattcaaacattattttgttgtatattttctttcgtaggcctccttaaaattctcgtagaatgaggcaagatataaacacttacatagaagttaacagcagtgtgttaatgatatatgcagccaagcataggcgcttatgcccagagtgcgcaagtatacagaggacattcagtggccaaagttggctagagttgctttggtccttgatcaagtcctgtttagatttctccacccaaataagttacatcaatactgactagataatacatattcaacaggcagtacaccccctgatcattgtggatatcacaattcaggaaatcatttacttactaaacatttttacttactaaacatttacttactaaacttttgtgtcccctactaaacttttagcttctagagagtagaaaccatgtcctgttgttctttatgcttatagtacttggcccacaactgatgcacaatggatcacgaggggtgactagataaatgagaattttttaatggcaagatgattcagagcaaatgaaatgtagaatatcataatattttataaggaatggcattttgggcaagttattacttgtacgtacttttagaaacagtctcttcctctaaccaaatgcttctgagtaggatcctgctttaatggatagaaaaacatgagttctcattagta

SEQ ID NO: 119434 - DNA, 1048 bp, Homo sapiens
attgcagttttgacagtttatcagtgattcatcaccataatctcttactctccatccttgccctgtgaatagattcatacctggaagcagccgtctctttagaaaagcttctatcctttcctggtttttcctgagtgcctggtcctcccaaaactcctatcttttttgtcctgactcagaggaaccctcacttcccccacccccaccccccaacgcacacatttccttcataacaacaccctagagtgagatccttttactttccgttttacttcccggttcctgagggcattacttttcataagaaaattcatcaaagtgttttcctaaagagttgttctccctctaaagttgaatttcatcctccaacccaatatggaaacagctattgccaggtatatgtccacagcaatctttccttcttgctacataatcacagttattttaatgattatttgattttctacagaatgtagcgtagctctgatgctgttagggtcttgatgaaggcattagaaacaatgcttatgctcagagcacttgtgtgtgcttggacgttgtgtgaatgtgagcaaagttgtacttcagtgaaggtgcccaaccaacactgagacacataaccaggaaaacaaggctgcagctgatggtcagagtagccacgggttaggcatgagtagccatgggttacgcataagcatccacaccaccagcttgggcagctgtcacctgccattgtttatccacagggccagctagaaaaggatttctggtaggcatctctatcaacaacacaggtgaacatagggaaaacgctaaatgagaattatgatcaactagaaataaaaggaaaatcagtcctccctgtatttcccatacagctgccccatcggtcctgccatcagcaccacatgaggcgtatatggaagatggtttattgttacctttttattaggctgcttctagaaaattcagcaagtacccacagtcctaccacctaatccataacccctggtcaacattttggtatatttccttctaattttgtttt

SEQ ID NO: 119435 - DNA, 1001 bp, Homo sapiens
gcttggctaggctgggatgaggcatctttacttacacatctggcactggacgctggctggctgctgggacttgctggggtgatggctggagaacatttcacctctccaagcggcctggccttccttactgcagtgtcttctgaattgttagcttccttatatggtagcaagtgtgcaagtcagcaggtggaagctccgctatctttgtcacctagcctcagaagtcacatagcatcatttccaccgccctctactagcgggagcagtcataaaagcccacccattttcaaggcaagaggtcatagcctgcgcctctcaaagggaggattgtcaaagccgcactggaagatcatgtaagttggatgatagcattgctgctgtatttgagagattgtgctgtgctctatgtagaggtttctgtaggaaataaacaagttgagttctctggtgaaaacacatctgaaaacatgttaataggaatatagctaatccttagcatttcttatagtagctaaggtcagtgtatgctaggcctggtacctgagcagcagtcttgatgctaagttaacaacaggtagccaacaggagtgttttctagctatttggaaattgaaattcaaccaaaaaagctactgccactctgaatcagttacatcatgataccttagatctaggctaccttttttcctgaataatagaaggttacattgattagaaattatggggaaagtagattccttcatataagaattggttaaagtttgactctgttctctgttaaagtaagcagctttttaaataattgagttctttggaggagtttttatattttatatattttttacctatttagccatgataaatagaatcagataagagaccgagtgtgaatattcagcacgaccttcaaccaggtgtatatatttctctctatgttctaaaggactcagcaatgtgtagtgcctatgagttctcatttgaaaaaggaggaatcctatatg

SEQ ID NO: 119436 - DNA, 1454 bp, Homo sapiens
gggtttcaccatgttggccaggctggtctcgaactccggactttgtgatgcacccgcctcggcctcccaaagtgctgggattacaggcgtggccacaactgcttttcattactctcactgcttcacctccacctgtgatcagtgacacacgtttgagagacacctggctttggagacagaaatcaggatccttgacctctttattacctttcctaatggaatgaggttgcacacgtgggccgcgctctgctgcacaccagcagttcagagagtcctgtcgtttgggggagcactcctctgtcactacagcacctattgttgtaaaaccttacccactattttttccaaacgacctcagataaatactttacttgatgtttttattcgcgcaaggtgttaatttctaacaagacttttatgagcacagcaagcagcagttgctttttcatgtgaacattaaataagactcaaggtatgaaaagcctgctgcaaagggtccagaaggatctatgggatttggtgggctgcagcagacaaatggcctgccagtctgtgacaagtgtgcagtcaccgtgggcgccagccttgggaggcacaggatccgctaagtcgtcgggattaccgggctctgcccctagcagcccccggagagttagggccccgtgtgcacatctctgcaaaggctgttggtcaaacacatgaaaagccggtgttagtggtgtctgcctgagccaccgtaaatcacctctccctctgggctgccactgcaccttgtctgtgcacagtctggaggcgtggggcgtgtgtcattgggggaagcatgcagttcagggtcctgttatgtccatatgaatgtgaacgtgaaagcatttcctggcgcctctgtgctgggctattattgggaccaaggactcacacacaacagtgacatcatccaggcgcagaatagattgtactgaaacgtcagaagccagataccaggttctctctcacaaacagttgttttaagtgccaatatcaaggcttgacagtgttagtgctggcaggacttttgtttttcattatccccatcttcatccctaaacgaacagtagcaatgcagagaaatagtcattagaatgaactaaattaaaatcaggaagcagttaactttatgtcgactctaagataatgttagtaaataaaaaggctaattggaattctcagtattctaataagaactttttattagtaggttatttgtgctttaatgggctgctcgtggcatgtggttgagtcgtgatgcttttcattactcatttttattaacatatacggtaaatattaaaatagatctcggcagcaataacataggtagaaaatgatgggtggcttgtcagatacaaaatacagcagcatacttacagatgtgttctcatgattttcaaatttatgttggctattttttaactttg

SEQ ID NO: 119437 - DNA, 1070 bp, Homo sapiens
tctccagggcccctttataaagacaccaatcccttcataagggctctgccctcctgacctaatcacttcccaaaggccccacctcctcagaccatcatcttgggggttaggattttaacatgaatttggagggaacataaacactcacttcagagtaatgataaagtatattgcccatatgctacaaggactgtcttggtcacttttcagctgacatttaagtaaaagagtataattctctgcaactatgttttgtctcattcacgtgtcaatatatacatatgctagatttccctttgcaacaatggttggatcagttcaaagtggttcattgacgtccaaaaaaagtgaaaataatgcgtaaatcctagaactcaagacatacgcaagaggtaataattaagcttctactgtgcctgtggattgtgaatctacaagagtcatgattttataaaagcagccccaaaaggaaaatacaaataggaaatataataaggaacatctgaagattcgaacttatttgcactgcagaggcactgaactctggcctttggtagttgtctgttaacggaattctgttaaatagtttcctcatttgtaaatgcagatgataatagaacttgcttcagggtggttgtgaggcataaatgaggtaatacatgtggcatgcttgtgtacatgttgatgtgctgtctgggctgtcattattatagttctcaaaattattattattaatataaaacacagccatctctctaagcctatcaggtttttccagaatgaattaaaataacagtgctttgttacggaaatgctacatttggtcattcaagatggagaaatggccaaaattgtggcagtaccatgaatagttgtaaaagttggtccaagttacaatctgaccaaataagccataaagtaaatagaaaatatagtttgaatcatgaaattgccgttttttaatagtcccaggtagcgaaatattagaaaatccccatgtttcttctcgacttcatgctcagaggaaaagcagagtgagctgctggcaaaattcctctgctaagtggcag

SEQ ID NO: 119438 - DNA, 1017 bp, Homo sapiens
tgtgcagtcacaaacctttaatggtcctggcaatttggcattatggtggagctgctgatttgtgattttgtctttaaacttttactctctttaacttgacctggaaatggatacatttgacagggaagaaggcaagttatacacagtgtatgtcaggttacactatgtacctagaggtggtagcgttttggttgtaaaacatcagtgtcaatgttgtatctgggcaaagtaatacagtacccagttctatttcaatttccaaaccaggggaatacaaagagcttatgcaagtcaattgtaaaatcactacttattttggcaaatgcttaaaaatgtgtgaattctggatattatcacagaaaaatgaagtttatttctggctcattcttttgtaggacagacctgctcaccttacaaaaggaatagaggtctggagacgttgacgcttaggaaaataaatttaattaacaccacctttatttttcactataaatgacaacctcttactcttgtagcatagcaaatgcaggcacccacagaaattcaggactccggattgctttgctaatcctggtgtgtccatgggcaggtcttgcatgtgagtgagcattgctcaaggtgcaaagagcaccgctaagcagcaccgcagagctttcaaaggggcttttgcatatttgcacaggccattgttgcagacaggagggtggcgctttgagcaggagccccaggatgattcggcccaggtgtaacacggcccctccccagccaagtggcagccccagagaacagtggaaaagcatattgccgtcttgctctactgtgttctccaaagacatgaaatttagtccatatgtttaaatctctctttggctgattgccttgtgcagttgatacatatagtacaacaaaataaaattaaaaaataaatcagtttggaagcaaacttgaaggggagaaaatgctgcagccctgtgcagagagcacatgtgagcatcttaaacacgccattgtgtgtgt

SEQ ID NO: 119439 - DNA, 1865 bp, Homo sapiens
cccatggtgggatcttgctaagtagttgttgagtaaatgaatcaggtacttgttactgtataccctttttgaagatttcctgtgatacaagtgttggcggcatttttgctgatagcttttcaacaacttccctattttcagacgatgccactgttcaacagtaaaccgggtgaaacaggctgtaacttacatatacacacaagagacatttgaaatatcaaatttaagcctggcaattcagaatgcaagctcattttttttttaaaccaaagcctcttttacctaattgagccagaaaatatgtggcccttttccctcccaatttgcagcttcagttctccttgactgagtagctaatggaagatggggcctgttcctgctctgcttgtgaaatctgactctcagcccgaggctgtgtggcttcatattttggatctgaaaataaaatgcttttatttgatcctggcgtattaaattcaggttaggtgtgttgcaaaacagggaaatgttatctagaatcttcctgctaatactgaatctttggttcttctgagccactgtgtcttaccagtcttcctgtggaagatggcgggaatgtttctaatcccactttgagcctgagtgcttgcaccttatgcagaacaaatcacaattcgtatcatagtcaggatctgagatttgtctctcacctcactccctctcctacggatttagttatgctcatctgaagtaaaggctgcctgactgggtgcagtagctcatgcctataatcccagcactttgggaggctgaggcaagaggatagcttgagcccaggagttcaagaccagcccgggcaacaaggtgagatcccctctctacaggaaatttaaaaattagctgggtctggaggcacacacctatggtcccagctacttgggaggctgaggtgggaggatctcttgggctgaatggtcaaggctacagtgagctgtgatcacaccactacactgcagcctgggtgacagagtgaggcaagaccctgtctcaaaaaaaattaaaaaaaaaaaaaaaggaagaagaaagaaaaagaaaggaaagaaagagagaaagagataaagaaaagagaagaaaagaaaaaagagctgcctgctgtagctgaaagatagcacttagatgctaatgtgggattttgaaagcgggagacctttcttcagaaatctcaggtaaggcagttgcgagggcacaactcaatgccctcgtgaggcctcaactctctggggcctcacacaaagatgagctttatgtggactttaccagaagttccagggatgcggccagccaggagctgtggctgtcaccagtttgtcattggtgtgacactaacagagagaaggtacatcttaccaagacaaggtagttcaagttcaggttctgtagcatcattcagctcatctgaaagcttgtagttgattttatgtattgcagcccattcaaaaataatcttgtaaagcatagtgtttgcttaaacttgagacagcttgcaatgtggcttccgtttagtgtgacacaaacctgttgtggactctctattataccacagaaattgttataaccaccacgtctattgtcttccagaaggacacttgagagtcacttgtaaaagttggcctgtgctttcctattaaaaactgctgtttaaatggtagttagtctcctgtttagtatgcggtgtagctagatcaccctgcattcacaatgctctacataaaaaaaaaaacaacactgctgcaataccaatagttaaaagcaattccattaaatacattgcgaactagttttaaatttttatcttgatgtaggcacttaagaaaaaggaagggata

SEQ ID NO: 119440 - DNA, 1028 bp, Homo sapiens
actctagcctgggtgacatagtgaaacctgtctctttaaaaagaaataaagtttaaatgttttaagtaaaacattttaaaagattttattatttaaacatatcaataataaaaccattgcatattaacctaatataattctatgaaaaataactataaaaatttttgtgaaaagaatgacattgatttatatttttgcaaatctttttcgggtctggtctaagaagacaactagcttcttataccagcttctgtattcagtctgatgctcttaagttgttttggttaccccagatattttgttagaaaagggaaaagtgtgttaatagacttttgagaaaattgtggctattcattctttgacactctaccaaaaccggaaaagtagtagttttttaaaagttagttgcattgtgaaatctgaaattatatcaatgactgatataatttttcacttgttacattgaaatcgattagtctatcttgcaattttgaatggatcattcactctttcatgattgtgtgaaatcgtgcatcattcaattagaaatattggttcagtgagttatgtaactcttttaagcgtcgacacatttcattatctaagatcaaaaaatcacattcattagtatcatcaccaatcctatcaggaatgccttaagtattgggaaatatggagacacattttccaacgttgacaattttccaaatttgcttgaattttatcattggccaaaaacactgtcagttcttgaagtggcaggctcattgcatttattatctctgccatcattggtctgtcagtacttcttccatgtaaaaataatgttccatgaaaaagagttgctggttcagctcacagttgaatctcagatgcacatttccttgagacaaccttgtgcttcagcgtgtaccacgggttctctgtgtgtgtttcccactgagtcacacagaatataaaaaaggcatatcaagggttgaaacttaataaaggtaataatttgtagtgctttttaaggacgttttaaa

SEQ ID NO: 119441 - DNA, 1062 bp, Homo sapiens
tgtggtcaggacttggctctgtgagtctgcagccttgttcagccctccctgcagctgttactgtatccctgtcttcctactgaggccatgcttgggccattgtggcacctatacatctttaatacacgccccaattaatgagttaagtccagataaagtgggtctgaggagttcacagattggagtgccacagggatcatattttcaggtgcattttcttccaatgcactctgacagctcaaaacacttcctcgagcttctatacattctgctcgttgccatgtgtccccagcacttggatatgtaatgcgagggataccaacagactgatttctaaatgagcttcctgcctcaaggcaaaggttgagttgcccgtgcagctgggagggccaccaggtgaatgacgctgttagaggggaagtgttggggtgaaaggtccctgggagcttcgcttaccaccgtgggcacttaatggatgctaaataattgaaagaataaagtgagagatgagtggatgccgccttgatggcccctcgatgaactaacagggtccgagaacatttgcaaattggtcattaatgtttcatcaacagtgtctgcctcctttgttcatctcaaagggtagccagggtttccgatcacagggatagtttcctgagaaacttaaatggaggaattaggccgggcctgcaattccacccaataatttgggtttgtttcaaaatagcctaatagctgggaatgggctggtttggcttgctaatgtgcttagaagggtcttgagtgctttcactcagtgacatttggagggggattatggattttggagcattaaagctttattgtttttgttttttgttttgctttgcctgtttttggagtgaggtttgctgacgctaaaatgactgtttattcatgacagggagggggtgaggaggtatagggaataattctactcatggaaaaaggatgccttcttcaaaatgatttttgctgttggcaaagctgagaacacactcacatgattctctgcctgcagtaagtgacaggaaaaacacattg

SEQ ID NO: 119442 - DNA, 1049 bp, Homo sapiens
cacactctgcccttcatggcctgttctccttaccaggagccttattgaggcagaatatgcatgacagcttactggatctactaaagggaaaatggactcacttctgactgccacactgttcaaacaagtcagtgctaacacagactgcggcagggtccccaagggcctctctggaaatgcctgcccttcctcccacaccaacctccgcatcccgagagagttggtgcacatccagatcttaaagcatcctgagagttggtgaactaattcctgttaaaaccaacagtcactttaagtttgaggaagaaaggtttaaccaagtactagtaagattcacatttttagcttttgttcttccagctgactctgtatactgggcccacagttgtacagagagttaccctatgctgactgcacgggagatgcacagggcgtgtggatgctatgggaatggagagcattggtcatgcaacagcttcgcctatgatgccgtgtctttccctgcccttctatatgttcttcatgtatttccaggtctcctattgattcatccacactatgtacaggattagaatgcccagcagctgggggagcctttccagggtatggttcagcgggtgttaccagtgacccttgctcactcctgtacctttgcttccacgggaccactcccatggggtctataacccctgtgggtatgcaccagcagccaggcttgcacaacagcctcctggcctggctgcgctgaaggacttctttttgttttttcctgttgtttgtttttttctgatagagtctggctctgtcgcccaggctggagtgcagtggcacgatctcggctcactgcaacctctgcctcctgggttcaagccattttcctgcctcagcctcctgagcagctgggattacaggcacatgccaccacccccagttaatttttgtattttttagtagagacagggtttcgccatgttggccaggctggtctcgaactcctgacctcaagtgatccgcccgcctcagcctcccaaagtgctgggattacaggc

SEQ ID NO: 119443 - DNA, 1030 bp, Homo sapiens
atgaaatcaaaaaattaactagatgtggtggtgcatgcctgtggtcccagcttttcaggaggctgaggtggaaggattgcttgagcccagaaggtcgaggctgcagtgagccatcattgtgccactgccactgcactccagcctgggtgacagagcaagaccatgtctcaaataaataaataaataaaaggatctcttctgtcttctgaggtgactcctaggattctagagccagaaggagcctcagagcacatttattccactcctgtcactgggggcaaaaatgaggccagtagaggttaaatgactcgcccagattcacacagtcatcacaggagcttgggctggcacccaggcctcctgcctccaggcctgtgtcctcttcttgcattaagcccagagcagttcattaggaaaaccgtatagagtcatgagaccctaagtctcatgatcagaatttcatcttctcttcccttttggttttttttttttttttttaacatagagaaggtaaagggggaaaatgatttacttagtttccagaccacttatttaaatcctgcccaatctgacttccactcctcacttcactgttgcagccaaagctaactaatgcatccgtgctccaggggaaggaatctcttcccatcctcagtccaaagtcagagtccaaactctgaggagggtaaaagaaacacaggaaatacaagtccctcacccccacagcctcattacactctccaataagccacaggagtaaaggaggaagatggggcggatgcgtaggtatggagcgcctactctgggtggctggctctgtattaacactctacacgccccctcattcagtcctcacaaaccctggaaagcaagttttgttcgcctcactctgcagatggagttattgaggcgagaagggtgatgtaagctgcccagagtcgcacagctagcaaagggcagagcaggaattagaaccaagtttctctagctgcaaagtctggttctccactccaccatgcccattcacttc

SEQ ID NO: 119444 - DNA, 1140 bp, Homo sapiens
ttcctggacagccaacaggggtgccgagggagtgagtccctcagccttgcctggagccttgctgatacttcagtttgcctcacaaacacggttaccttccatgacatgaaggaggcacacgcgggttgacccctgaccctgtctgcttgttagaatcacgtcgggaaccggggacaggcttagaagcccaggtcccacctcccacctgctgaatccaaatctccagagcgtggcctgggaaatcaaatttgtcagcttccttcccaggggactttgatacatccaccccagtggaaaccagcagcctcctttagtcaagcgaatgtttccctgactgtcaccttctccccctgtataagatgcagattgttagcggtaaatggtacctggattccaacctcagttctccactgcagttggggagatctggccagggcaagccacactgctccttcaggcacagccttgttcatcccgcactcacctgtgttctcttcctctctgtaggacgcacaagaccagccactgctaccgcatcacgtaccgccacatggaacggactctgtcccagagagaggtcaggcacatccaccaggccttgcaggaggctgcagtccagctgttgggtgtggagggcaggttctgatgtcaccacttcactcaggctgcagccctcttggggctccaggatttgctgaaagagaaaaagatatggtttgtgaactggggcatcaatcatcttttgataaatggatcagttttaggactttcagaaaataaaagatcgctcttgaaaagctgttgacatagcatttgtcttttatttggggaaaggaggaaggtcttttcctattccttttagaagtgctttgcccactggcattggtgcttagtatggttaattggtccctgggttccattaagcaccaggcatgatttcttgcctgacaggctcttccactcaggtaatgagtgaagccacacagagggacatcagaaattccagatacaatacaggaagctttttgaatcagcttccattccttcctcccttctcttctttttcagttttgcaaagggcaggcttcaaagagggcactaatgaaatgccagggctctcgtccaatgtgaagggaggtg

SEQ ID NO: 119445 - DNA, 1112 bp, Homo sapiens
cacagctggaaggaagcttagcaacggttaagtcagcccctctgtggcagagaaggggacacccacggtcacaaggtctgagctgtctgtggcagaatcaagactctcagacccagagtcccaggagacagccaaggacgtgttctcaatgctttgatgaccttctcgtcaccaagacactcatgtctgatttctctccccgcggaccccatgttttaaaagattttcattcaccaaaacaactgcatttattaagtaataatttattcattttcccatttttaaaattaatcaaagatacacataactgccagcctgagagccagagtctctgatcagcaggcaataacccttattaccaccatgggttgatttaatttctgccaaaagcaaagacacttgacattttagacagcctgaacagcttcattgtgcgaaagtggaggttttccattacacttagtgaaatattcaaaatagctcccagaccctggtcaataattcatggcacccttggcctccagggatccctgctgggaaccaccgcaccatatcatttgtgcaggaggtaagatgcaaagggaatctcactgtcctagagtctcagcagcaaactgttaagggatttgtagcctggatccagtcagaagccttggacaaaccactcagtcttccctgagcctcaggtttcccatcagtaaggtgggaataagatatcagtcagggttcctagttgcaaacaacagaaataaactctgcttatattaaggataaaataatgtattaaaaggatactgggaaaaatagcttggcagttcctccacaagttaaacatagaatcactatatgacccagcaattccattcctaggtctatatccgacagaatggaaaataggtctccacacaaaaactagtacatgaatattcatagcagctctattcacaatcaccaaaagctggacacaacccactgtccatcaacaaatgaatgggtaaaaaaaatgtaatatatccatgcagtgggatattgtttggccatagaaaggactgaagctctgacacatgttacaacatgcatgggccttgaaaacattcaaggaaagaagtcag

SEQ ID NO: 119446 - DNA, 1095 bp, Homo sapiens
gctccttttccttctcttgggctgggaagttgcagaaactcgacttggacccatcaaattgttctttaagctctggtgtgttattgcatagatggaaaaaccatgttctatttttgtatcagagttctatgtaagatgctttactctgatttaaccatgatgaactatgacactcatgctagttactatgtgcctggcaccattgcacttactttacaaataccaattcagttaattcttacaatgattctatttggtagctgatattaaagttattaacagacaaatgtctataagtgtgtttgacttgcatcagcttttatttcagaaaaaggcttgggcttgtgaactaatgcttggggaagacaaatgattctttttcaaattatctatgaaatgttgaattttctaattatttctctctttggaaaataatcccttttaagtgtagatattatataaaatacatgcctattcttgaccattctgggaccaattaccaaggttttaaaatagcccaggctcattgcctctttcccttctccctctcctgcccaccttctggcgttcctctgttcatagacacgtcccttgcaagtggaagaggagatgagcagaaattcaaacctgtcagacatggttggctgttacctgctctgctaaagaccaggggactaagagctggaagctaatgggatgccttgtcaggggctctttctatactagccttgtccctcctgccatcgtggtctgggacccccagaccactgagcaacaggagagccttgtttatatgacgattttattccatgttgtgagcttttccttcaatttaccaccaaaagttgctggcaagacaccaatttagtgcagtttgagtaagcgaacatgtttgctgttttccactgtgtatttttaacctatccttgtttactggccaccttctactatatggtatcactttgtgttgaatactaaaaaggcataagtcccaaactctgccagagaggaatgattagacagaacaaaacaaaacaaaaccacaagtggatacagtaaggaataaatgcttttattataactttttttgataaa

SEQ ID NO: 119447 - DNA, 2161 bp, Homo sapiens
aagaaagctaatttatgttttaaaaaatatattttccttaagaaaaactagagcagagataaatgaactggaaaatagaaaaataatacgaaaaatcaaaaaaatcaaaaaaagttggttatttgaaaagatcaacataattgacaaacctttagctacatgaattaaggaaaaaagaccactcaaatttctataattagaaatgaaagtgggcacagctgctgcacatcccggggctcctgacctctctgcgtttgcagcgtagcccaagtcggtcagcactggaggacctcagaagccatgttgaagccccatagtgaagccagggctgccttcattcagacccagcagctgcacgcagccatggctgacacattcttggagcacatgtgctgcctggacactgactcgccacccatcacagcctggagcactggcatcatctgtactatgggcccagcttctccattgctagagatgctgaagaaaacgattaagtctggaattaatgtggctcatctgaactctcatggagcccatgagtaccatacagagaccatcaagaacgtgcgcacagccacggaaagctttgcttctgactccatcctctaccagcccattgctgtggctccagacactaaaggacctgagatcccaactgggcccgtcaagggcagcggcactgcagaggtggagctgaagaagggagccactctcaagttcacgctggataatacctacatggaaaagggtaagagaacatcctgtggcgggactacaagaacatctgcaaggtggtggaagtgggctgcaagatctacgtggatgatgggctaatttctctccaagtgaagcagaaggatgctcactttctggtgacagaggtggaaaatggtggctccttgggcagcaagaagagtgtgaaccttcctggggctgccgtggacctgtctgccatgttggagaaggacatccaggacctgaagtttgggggcgagcaagatgtcgatatgatgttttcatcattcatctgcaagacatctgatgtccatgaagttaggaaggtcttgggagagaaaggaaagaacagcaagataaccagcaaaattgagaatcatgatgggggttggaggtttgatgaaatcctggaggccagcgatgggattatggtagctcgtggtgatccaccacaagccgtcgagatgagattcctgcagggaaggtctgccttgctcagaggatgatgattgggtggtgcaaccaagctgggaagcctgtcatcttgccactcagatgctagaggatgtgatcaagaagctccaccccacttgggctgagggcagtggtgtggccaatgcagttctggtggaagctgactgcatcatgctgtctggagaaacagccaaagggaactatcctctggaggctgtgcacatgcagcacctgattgcctgtgaggcagaggccaccatctaccacttgcaattatttgaggagttctgccacctggcacccattaccagtgaccccgcagaagctactgccatgggcactgtggaggcctccttcaagtgctgcagtggggccataatcgtcctcaccaagtctgcaggtgtgcccaccaggtggccagatactgcccacgtgcccccatgattgttgtgacatggcatccccaggcagctcgccaggcccacctgtaccgtggtatcttccctgtgctgtgtaaggaccccatccaggagccctaggctgaggatgtggacctccgagtgaacttggccatgaatgttggtaaggcctgaggcttcttcaagaaggatgatgtggtcattgtgctgacctggtgacaccctggccctggcttctccaccaccctgtgtgttattcctgtgctgtgatggactccagagctcttcctccagcccctgtcccacccccttcccccaatgcatccattaggccagcaatgcttatagagctcactctgggctgtagtgtggcactggtgggctggaacaccagggaagaagatttatgcctcgctgaaacgtggctgtttttagagcctgctgtggcgggagagcccggagcctggctgcccatcatgtggccccacccaagcaagagaagaaggaggaatgcagaacagaggccccca

SEQ ID NO: 119448 - DNA, 1043 bp, Homo sapiens
tgtgacagggcttgctggggaagtgttgggagacgaaggagggagcgaggagaaagagaaataaaagggatgagggaggtgagaagagggggcgatggaaacagaaaaagatacggagcgagatgcgggagggagctggaggaaaggaatggactcacctacctcccacccacccacacctgctcacacaccgacaatttgcactagacgcagcgttagctgcaggtcgggcattcctgggtcacgtctttcattcacctttaacactggcgagccccgaggctgggcgctgggagaggccgcccgatgcgatgaggccgcgcggagccagggtctcgcaggaaagggcagtgggcggcagggcggggtcgtggcgctgctgaccggtgttccctcctccccgcagcgtatctggtgcaggccgtgagagcagcgggcaagtgcgatgcggtcttcaagggcttttcggactgtttgctcaagctgggcgacagcatggccaactacccgcagggcctggacgacaagacgaacatcaagaccgtgtgcacgtaagtgtcctctctggccggctggacttcggttttgggggcgctactgaggtcggagagtgccgagcctccccgcctgcgctcagcgttcagcgccagcgcgaatccgcatcggctcactcttgccttctggctccaacccccaggcctaggaccaggcccccgggttagaacctgcgcttcccaaggggatcccacagcccggggtgggatatggaggaggatccttcaatatagacccagtcccagctctacgcggcctctcaggcttgcacagaggtgcgcatgctcgacatgctgggagccagggcaaggggcatgaaggattgctacaaaatcttggtgctgcaagatctctctgccttgtagcaatcttgatcattctttgctcttgcgtgaacgagtgacctgccaggtgttctctgaagaacagttagtttggatttgaggagtgtttggggtaatactacatttgcctaaagggaaagtcac

SEQ ID NO: 119449 - DNA, 1045 bp, Homo sapiens
ttcggtcaccttcctcttcggcgtctggcccggcgctcgcggacaggcgcccgcgttgggggccgggggattgaggtgtccggtcctcccgggacacattcacacacaagcgcagccgccagaaagctgccgaggaccaggccggcgcccagggtcgtgggcgccagtgcggatttcgattctgagattcaccctttcttccccgccctaacgctgtgcttctctggcgccctcccggcgcccgggctgctttgggccgctaggcactcagcttccagccgggttcgtcggcctcagggcggaaagagatggccacagccgcgcgcccgcagcctggtacctgtccttccagtcccgcgcctcggggtttggccgtccagaggccgggggcttgggggcttggggcttggaccttcgtgcggcctgtgtttcctcctcctcctcctcctcccgccgctcagcttttatccctgcctgctctctgcagggagtcctgagctggggccaggagccccgggccgcggcgagctcactttcagcagcagggctggcacctggagaagaacagcctctccccgctgccgtccggagtgtaggcgggctttttggcgggcgggtgggttgttaagggtgtctggggagccgagtggcggacaggggaggaggagagaaagaggcccgaggttcgtggatttggcctttgcggaggtgacccaggcagactcatccgtgaccccgcccggcctctggccttctcctctccagaccactcatcatccgcgccaggtctcaggacgtccaggctgccctctttccagcggggcgggagagggtgcatccgagggtctcactcggaatacagagtccacggtaggcaatcggttttataatgaaacaatccatttcggtaactgctggtggcttccagggactatattcgttcattcattcagcagtgtttgctgagcgcccaccaaggacagagcgccaagcctgaggcttattctcgtgatgtggcgttgggttcagctgcgtgaccccacgc

SEQ ID NO: 119450 - DNA, 1480 bp, Homo sapiens
tgactttaaaaattaaacagtatggtggcaacattcattatgtaaatttctaaaatgttgcatcttaggtttagttggcaaagaccatatttagaaataaggatgagcttagtcttccaggtagaaatcagatacactaaactgtacaaaaatagtagtttcctattgtttgaaaataccagtttaagattgtaaaaatgcatagatctttaataaaagaattggctgtgcaagagttctcccctttcacagtattcctttttatttcaaatgctagttattggttatgctgtaggatttaactattacaacaagaaaaggcaactatttagggaagaggcagatacaggagaaaggaatgtatataagtcatttttttaaggtacaataagcttaatagtgttttaggaagacaagataaaaattatttaaagatagcttggttctcactgaatgaaaacagtagactaaatactgagttcttttctgtgaatctagtgatcaatgccttggtcgccatattggtaatctctagggcagtcaccttggtactcgccatgttagtcatctgggtattctgtgtgataatcactatcactgattttcaaaccatttgtttctgttgtgaatgatagtttctgtcagagcagcacagtatttgcgaccatatacttgccccccaagcccgtgcacacccattcttttctgggaagccactttgttggtacccatctgtagagaaattgtcaagtggtctactggctgtaatgttagcttctgatagtagatggcccttctggtgcctggtgctaacatccctgcctggctgtctgctttgttagtgaccatctgcagacaaactgtggtctggtcaaaacgtttgtcagtttgcatgttgggatcataaagatgcctgtagtcccgtaagctgacatacctgcctggctggcacttcgttggttcccatccgcaatccaattacagtttcagcagcttttaattttccttcatcctaacgtcgtgtttgtttttctgtatatttaaccctgatgtccgtggttgtatccttttgtgcttgccaacctactagggccaccagagtagcctgaacttgggtcacgtttccatcctaaaaagatcacttacttcaaatatgtcacgtggcttcacaccataagcctgaatagctttaataaagttgccaatattctccgctgaggccagtttaatgaggactcattgactttcttcattgggcctgcctgcagcttgttgatgagttcacagaggaggatgccctcctttaagcccagctgacctgtgctatccagttgtgaagatcttttgtttgataatcctatttggaagcaatcttgatcctgacttcggccaagagcccgtaggaagggccctagttgaagtcagccatgatggttcgggtggtgggaagaggctgcactcgggggtcctgatctctcgc

SEQ ID NO: 119451 - DNA, 1072 bp, Homo sapiens
aagccagtccaaattgagatgggctgtaaggattaaatacagactggattttgaagtcttagagaaaaacaagaatgtaaaatgtcttactaataattttaaaaattatttattacatattgaaatgataacattttagataattgaaataaaatgtactattacaattaatttcacctttttctttttttttaaatgtgactactagaaaattaaaaatttcctctgtggcttgcacatcaggtatttttgggataaggtctagacagacagatggggcaggggtggtaaagtgaactaggaaatcatggtttactttatcagtatctggtggttattagggggtcagaagaaggaggcagaagtttgggggaggaaatcgatttcccaagggtattgtggatcctgatataattgaactccacagatgctgagtgaggtcgggggtggtcatgtgtgggagcagcactcagtcacacgagtctgaagaaaggatgaaaatctggtggttcacacaatggaagtttagagcagtacaagtgtcattaacctggatccaaggtggagtttaagatccagcatggagcatattgttgatgaataaccaatggcaggttgttttcatggacctgagaaaggaggcagaagtagaggggtagaaaatccccttccagaggcactgctggtacccaaattcaattccacagaccttgattgagaacctactatgttccagaacctctgttagaaactggtgaagaccagtaccatgctgttttggttactgtagccttgcaatatagtttgaagtcaggtagcgtgatgcctccagctttgttcttttggcttaggattgacttggcaatgcgggctcttctttggttccatatgaaccttaaagcagttttttccaattctgtgaagaaagtctttggtagcttgatggggatggcattgaatctataaattgccttgggcagtatggccattttcatgatattgattcttccaacccatgagcatggaatgttcttccatttgcttgtatcctcttttatttccttgagcagtg

SEQ ID NO: 119452 - DNA, 1041 bp, Homo sapiens
cccaaacagactccatacccgtggcataaagtggttatgcttgctggttggcaaagcataggccaccgcatattcactccgtttgtgttttatctgggcctgttgctcattgttgcccacctcatgcgtttcactgctcattcactccatagaggttgagtaagcagaattcaaactagctgcattcattttgtcatccgcttgtgttaaggagacagagttgcagctgttggagaatgaggttcaggagcagccctgtggctctaatgcgtggctcctaccctagccctgtctgtgtcatcatgggccgactgctggaatcttggcctgtaaagatgaacagatgtcaaaggccaagtgacgcctgggaattcccagtcctctgacccatgggtgcagcctggcctgcctgcctccatggtccctatttttttttttttttttttttttttaaagactatcagcaagagactgttctctaagtccactgggtgtgctgggtgctgtctcactgagatccagaacaacagtcctgattttcagaagtggaaatccttaaagctgaaaatgagagccttgttctgcagaagaggaagagtaccttccgtgtcgcttggagctggcctaatccacttaatgcctttcagcttggtcatatggagggactagccacaaagttagggctacagccccagccccgggtcccaggcagctgcccagtgtgctcatgcagttagaatgttcagagagtaggacactgggccaagcacatggactattctgtccaccgaccagcacagattaaaccctttgtagactccgagagctgtgcttctcagggaattaaaggatagcttttgaaaactatttttctttcctctttctctcattttatttacttgaaacagtatacacaatgtcctttttaaatgaggtgaagcccagaatctagggatctgttttaaagtgcagtgaggttttccagatcactcatgaggactctgcttaatcttgccagtctcctggctctcattagaacac

SEQ ID NO: 119453 - DNA, 1013 bp, Homo sapiens
ctccctatcagattcccaggacagctgctccaaatcttttccactctcctccagccctaactgaccctgctcgttcccctctccagaacagacctcttcactgcattggctaagcaaaccacccctccccactacggagattgctgacttttttttttttttaatggggataatttctcattctctttttctttcattttgttttgggggagaaatgttccttattctttctaaggctaaagcccccacccttgctgctaaccttctctttatttatttatttatttttatttttgagacagggtctcactgtcacccaggctggagtgaagtggtgcaatcatagctctctgcagccttgacctcccaggctcaaatgatcctcctgccccagcctcctgagtagctgggactacaggcgtgagccacggtgcctggtctctcttctttctctgcgatcctgctcagctgtcacttcttctcatcttaaacctccttttcctctgagccctgaatcttgagactttctctagtttccttcatcttacaaaacaaccagcagcaaagctcttatcttgttttcctcctgcctccctcctttctctgtcatcttcctcattttctcaaccccttaccatccgagttcccctgtccccatgaactagccacacggagctaatgtccctaaactatgccttgccatctccccctcccagggaggcagccggcgaagtggagaaagtcctggcattggagtcagccttgcaggggttcacatctgggctttgccccgtatgcgttatatactcctgaccctcatttgatacatttttaatctttccgaagtccagttccctcctctgaaaaatggaagcagtgatacctaatttatttggttgttgtgagtataaatgaatttatacttctaaagtgtccaacatacagttggtgtaaaattttaaaaaatgattcccatttatcccttgctttagctaatgctgattccttcatgc

SEQ ID NO: 119454 - DNA, 1022 bp, Homo sapiens
ggtatttcaaatgagagttctctctaaaggcttgatttggaagtcatagttatttttaataaggccgggcatgaaggcttacgcctataatcccagcacttttggaggccgaaatggaaggatcacttgaggccaggagttcgagaccagcctggtcaacacagtgagaccacatctcaatttttttaaaaaagttgtttaaaaaataaggtacagtcactctagcaatttgaaaggtatgaatcaactattttatattgcagttctagaatatgtttgtccttcccagtgcagtatagtcacgagtttcagtggaattgctgaaggaaaggggcagctgattcatatttctgcatcacaaatctatatagaaaagacaagttgagatggctctgagagtccagcatatcttaattttaacttttattataaagctgagatcttacattttaattgaaaaatgctctcatttaaaatcaaaatatttatcaatctgtggaagcctatttttacagtgaaattctgtgatcacaaacaggaaatttaagtattgcatgctggtacagaaatacattgttctacagtggcggccctttgctttgtcatggctgtgtttaacaggactttctgcctcctgaaatgtcagcgtagccctcaaactcatgtctattctacttttgattaccttggtcctcagccagcctcatatttgacactttcagcacgggcagtgtaggtccttcttgatgttgagctgttaatctttttattatttcctgtcacttttcaccatgattgatgctcttgagccagaggagggaaaagtgatgaaaatgactttgaaaacagctttgaaaaggagtattttaagttggacttgggtcttacctgagaccataaagcgactgaaaaagcgcacggtatgttttgtaaggcactacctgggcccttgcagtgagggagcaagtgtgctaataacgagtgcttgggactaggagtgctgagggctctcctggtgtttg

SEQ ID NO: 119455 - DNA, 1030 bp, Homo sapiens
gcattccccacagggcccttcctctgccctcattggaacacattacaacttagaaacacaagacacctattctatgatggcaatgtgaactattattcctgtctagagacctgcccatctcctccacgactggcctgtcttcaaaaaagcatttgataatacatttgggggcggcggggttgggggaggctcagaaaaatgcaaccgctaaaatttctctggatggagttttcttcagtaaacagtagaccctgggaaacataacaggttccgaaaacttaattttgatgactgaaagtcagagaaacagccagctgaatcagctccttcttgggcagtggtttagcctacttatctcatatcagacctaagggtccagctgcttttccttggttctaaagagttctattctggccaggacccatcccgagacagacacttctgtctgcagccctgaaaactagaggtcaatggaagggctcaaattaaaggcccacagttgggcttacaactctccatggtgttcaagccttctcagaggagctggtgtggtggagccagggtcaaaggtcatagtaaatagaaagtagccagctttctgcctgcataacatcatcttgcctaaccagactcaaacgcttaattctactgtagtattctttggacattcttctttagaactacgggggcgggggggggggggcgtgtttattttcaacaaccacaatcatccttatctttctgaagatgtttccaaaggctgagaacagacccctttcagaacctcggtaggagaagtattaacagttggaaacatgtcagctgctttatggaggaagcacagcccaggcctggtttctctgggctccgtgataacttggggcaaggcagccagtgcgaagcgtggtggcaggagctggagagatggagagcggctcggagaagggcccctgcttttcagagttgaaacaggagccctctgagagaaagagatactgcgtgtggcttctctgaagccttggagggcgac

SEQ ID NO: 119456 - DNA, 1031 bp, Homo sapiens
gcgaggggctgcaggggagggggcgcggtggccgaataaggtggcccgcgagcaacgggacgattgggatcgcagccagtcgcggcctcccggacccttcccctcgggcagcccggccctcccatggcccggggcgccttgggagggcgtagggcaaacctggggctgcggtggggggtggggaggggactccacctccatccatcccgggatggcaactgcggtcaccctgctaaagtcggggcgggggcggcggtcctccccctcaccccccccagtccgagcgccgccgccgccgccgccgccgccgccgcggccgctcagtaacacgtccccaggagactcgcaggagcaacacgtgatgtgtctacttatcagggtgagagggggagagcgagactccgagcgtgcgggcgaggaagctgggcggggggccgagacgggggccgggacgacggctggggcgccggggtcgccagctcctcgcccacctccctccctgtgggagaagaggaggaggggaagtgactgcggagttgatgaactttgcacatccagaaacgccattttgattccttttccggaacaagtttgcatctctcctcggtctctccctgaagcccaccggtccccaacgcatcatgccagggagccaagcgtcctgcccggccgtaagtacgtgccccggattccgactcgcggtacgccggcggcagcgagaagtctggggcacagccggagcgaccttttaaagaactttggggatggggagggtgaagtctgcagagcgcgttgtacttttgaaactcggtgtgtcccggagccggggacccgcacgccccactccgcgcagcgtgcgctcgggccggcggggcggccagggatgagcggggcagccctctcccctcgggctgcgcgccgggccattcctcctcctcctcctcctcctccccttcctccgctcttttccctttcccgagccgccggctctgccaaccagctcccagcgcgagccgccgcagcgccccgcc

SEQ ID NO: 119457 - DNA, 1062 bp, Homo sapiens
tttttaaagaggatttgctggatgtgtaatactcttaagaaatgctgccgatgcttaccgttttgtggaatatcattctctgggtttttctagatactgctttatttctcatcagaaaatcagactctaagcccttatggcagacaagtatttgttatgtgatggggaacatgcgtcttattgagctggtacaggtagtgcatccattcctaactagttacatcatccaacaagcgaccttttgattgaagggtcttttaaatttcttcgggcagactcccaaggccttatttgtatccaacacaggtacagcgtgttgaaggaagaaaataaacctacacgtattagtccagcatctgatcaacagcagtttattggttacctgctgtgtgccaggcactgtacagtgtagctgccttaggtcgtttttgctcttcaattttgaactgttgcgttattccacttctgaggtcagttaggaagtctttgcttgctatcttatgcttgcttgctaacatcatttatcaccttcagctaaggaaatgtcctagttaatgaagttttaaaatgctacccttttaggattttgctcagcataattaatataaatttaactcctataagaattggttaaatatattctttggaaacagaagtgaattcttttgatgtttctgttcattatccttctgaaaagtaggtggtgcttagaaggtcataggataagggttgctaagcagctaaacagaaggatgctaaaattaaccaaagcatttttgaaagggagtcattccctgttttacattatttactaggtttagttaatttctgaatcttctatgtcctttgacctgggaaggtaggatgttaaagtttgttttggttttgttattatatttaaataatctctttcttttgtaagtgtctttaattgaagttcagtactctatgaccagccttgtggtgtcagatggcagcttgtctggtggacttcttgactattaccagtgtgttcaggttgaaccttcctgaggatttgtgtgtatagtaccctcttatttc

SEQ ID NO: 119458 - DNA, 1035 bp, Homo sapiens
agtatgttcaagtatcttgaagtttttcattgagataaaatggttgaaatctaattgaagccatgatgagtaactatcatctcttggttgaatggtaagcctgttgtaagccaaaagtttccctgcttcaaggttaatttctgtacatctgacctattgaacaggcagtgttgagtcatattttttatgtccaaatataattaagaaattgataaatgtattttctttctgtttcttttctctctttctttcctgatttagacagtgatttttgagtagaagtagccatggcagttttcaaagagcaagggtcagacagtgatttccacaggggggtgagggttgcagggttgcaggtaccttatatcaaaggtaaaaggtacaccgtatgaaacccagagggaggcatacggtgtgctctctgaaatgcatcacttatttttcatttcccccactcccatagaaggcagaatacagaaaagaaaactactgttgttttcattactacggaggtaaaagaatgaggaaggtggagaggggtttttccttttttgttagcagtcctgtcggcaatgtcatcgactgtgctccgcccaatttctcttgtcacgttctctggtgttcagcgtggtctgaactgcagccgagtgtagctggggattgcactctgccgttggcagtggcgggttggggtgaagcggatggggaggaggagactgggagcgatcggtgcatcttatttctggtgggacttcaagggtactgaagttagccagtctgcccatcagtagaggtggctgactgtgagtaggtgcttcagacgaaagcatgggagagggtggagattgtttgttcagtgtgattcaagccagtaaagctaagagaattcgaaaacctctgtgaagtccggggactggggactgggtcctgactgctcctgcagggattcacctgagggcttgcagacatcatgagggtgggtggagaaagagaatgaaaacccccacaggcattgtcagacagccagagtgaaga

SEQ ID NO: 119459 - DNA, 1094 bp, Homo sapiens
acctcttcagttatttgggaaacttgctctggtgctgtcatctgcagcctccttcatgttctaagttatgtggagtatacctttttttttttttaagtgtttgaactagcccttacttgcttaacagttaatgtttttgcattcgtagtctcccttgttttattttctcaagtttttgcaaaattcttacataaccgtctgccgtttttatagggcagtgtttctgagccgggtgctctgtccatacatctcctcttgagagggtggatggctgccagctgctgtggttgggagggatagggagggagtaaggggatgcagggtaggaggcggtgattatttttatgttaagggaccccaggcctcagaccagaaatgtctaatatagtgtcaggagtgatcttttagccagcaagtgttaactgatctgacccttggccttcccccccaccccccagcctatcacacagacaggaggtaaggaaaccatagaggggagaagaaaacagggagacagagatcgaattccagaaaaggaagggctgccagtggtaggcagagtcacccctagagtggcctgggctcccactttatagacatgtgcaatacttgaagatagctctttttacatctaaaccagcggttagtcagtgtcccattggtgtcagtcgcactgatggtgctcagggccattgctctgcagccacctttgcagtcccatacgtggtaacgagtcctgttcctgcagaacgcactctgcgttctggtgcttttctgtcttctcgtctaacctataaactgccaactcccaactctatatctccatttacaacttctcccaagcttgaaccttttgtcaccctgatcaccctgcaagtaccttaccctgcaggtacttgtaaaaatgaaagtcctctcccttccttctggaaggtgatcaccatccacccagccttctaggccaggagtcttactgccgtcctgacgtatgtctgtcctgccccaatgttcgatcagtcaccaggccctctgcaaaaccacactccagtctggccctggcattggctgttctatcgtttctgacctaaggccct

SEQ ID NO: 119460 - DNA, 1051 bp, Homo sapiens
gtgggaaagaattttgaattacagaaattctaaaataaaagttggctcagcttaatgtaaaagtgaaaaaaactccttgttaatgcctggttgcactaaaagctgtcacactggggcctttactaattataaccatttttcatggctcttgatttgaagtttacattaaataggagagatgggcacacagatcaaagaccaaaatcatttcagagctccaatgtgtgggcccattttctctgcttagttagagttttgtttcattagtggtatgagttaataggagtgttggtctgtgtataatttagcttctcttttttccattactcgtaggattcaaaacagaataccaagccagaaatctacagggtataaatcttgctttatgtgtttgtatgtgtctgtgtatgtgcagtatacacgtggtaatagttgattttagatcatatttataaaaataatcattttcactgttttaagggagctccctttattctgacacttcagtgtaaaaaacaaaacatttctctgaatatacaaaatcaaaatcttaattttctcataaaagaggtagatatgtcttcagaaataggggagataaccaggaagatggggtgggtgttctgaaacacaaaggtgaaccatgtgaataggtttcctgtttttttttttttttttttttttttttttttttttttgagacgaagtgttttactcttgtcaccgaggctggagtgcaatggcgcagtcttggctcactgcaacctccgcctcccaggttcaagcgattctcttagcctcccgagtagctgggattacaggcgcctaccaccacacccagctaatttttgtattttttttagtagagatggggtttcaccatgttggccaggctggtcttgaactcctgacctcaggtgatctgcccaccttggactcccagagtgctgggattacaggcatgagccaccgcgccccaccagatttcctttttaaacaatgaatttttattttttatttttttggagacagggtctctctatgttgctca

SEQ ID NO: 119461 - DNA, 1011 bp, Homo sapiens
cggtggtggagtctgttgtgagccatcaaatgctttggagcaggactgtgatgtgagcagctctgtggttcagagaactgctaaccctttagaaaatttaagtcggagagaagacaaggtgtttagcaaactgcagtgtgaacttggaatttggtattctctttaacagaataacttcttccctttttttttacaagagatttttcaacccaggatatgtgggctgccttctgaagccttgttaaatgataggggaaaggtgggaacatttattttcagcaaatataattcaacaatgtttagacttccctaattgtgttgtactagttggtacttacttaaggtcattagagattggaattctttagaggagagggactcatttctcaaaaatattgaggatggacactgggagctgaactgggacaatgtattcctcgtaaccacgagtttggtgtgtcagttgggagtgactgcagggtgggataggtgtgagcagagggccagctaatttgctgtcttgatgactctgtgggtgatggctttaggggctggcagcgtctggtggaaatagaatctgttcaaaaggtggagctgccttacagcaattgccagctcgctgctcacctgcagagcatgtgccctcatctgggtcacgactctgcccctcagatgttcctggtcctctgcttggatccacccccttcactgcagctgaaacagccaacaaaggagcatcatgtgcccgaggcctgaaaagttagagtggatgtgaaggaagtcagactgcaggccccaaagacaattaatggtgtagtaattattgtagaggcacaacattgccttgtactctcaggttttcagagtcctctggggaagaaatacgaattttttatagcctgactttatacatttcaaagcttgtactcatggactaagggacttggatgggagggttgtgcaaaatgggggtaggcctcctgtaaacttggtgggttggacagaacacat

SEQ ID NO: 119462 - DNA, 1021 bp, Homo sapiens
atggcacacccgggaagtcccagccacttgggaggctgaggcaggaggatcgcttgaacctgggagtttgaaatcagcctgggcaacattgtgagactccatctctaaataagtaaatgaatgaatgaatgaatgttcttattcattgtacataataagaaggaatatgaagaaaaaacaagttatcctaaattaagattataaatagtcctaaggattaaaaattattttttcatcagaattttaattatttcactgcacctatgcccataatagaagaattataaatgaacccaaaggaaaaaacatctaatgatgcaaaaaggaaaaaggaaagtaaaattgtttatgcccacaagtcagagataaatcattgttgatactttactatttccttttaggtggttttctatggatatatacacatattacaaaaatgggatttattgtggacaataaaacccatttttgtacatgtctttataccatatgttttacaattttaatatgatatgacaagtcttttttggtgtattcaaatattcttgaacatgaaaatcacattttgatgtggcataattttggggggcagggtcataggctaatgttataattattttgcattccctgggcactcattgtgtgagtgaaggaacctatcttctaggttacatgaaaccaacatagtattaaactttttatggtaaattgtgaatatgtagttcatcagaaatttattttaaagagaaaaatactgaactgacaaaatgtgtgtgtttatttttggatagcatgtgatctgtcttattaccccaaacccgtgagggttactgatgaaaaacaaattgagcagttcaaaaagtcctttcgctagagggttggcctctcttgagaggaaggtgtttgttctcttacatagggcactgtgttgtgaatgttaggaatgatgtgatgtgtcctttatctgtggttgtatttttactggatgtttttctttaatcaatgtcatgttatttggaca

SEQ ID NO: 119463 - DNA, 1055 bp, Homo sapiens
atacttaatgactctcccttggcccttttaattaatctactgtgatctattagagagaggactgggtttgttagctaggagactaacgtaaggtcctgaatgcaagcccaaccttgattatgattaaaacagaaaaagatatacttcacaccttggtttttccatctctaaaatgggtagaattatcttccttgtgccttcttaggaggtgacacaatgatacccatgggcagcattttctttctttttaatcagtaaacgtaaacaaaaacctttgtaaggatggaagctattggaaagtaccatataaaggattaggaccgtaaatccagggaaattctaagcattctgaaagctgcttttaggcagggcagcagccaaaagaccagctggtagattgagacctttctgaaaaacctgacttcattctcttgtggttccattttcctttttttcaaatggggtctagtggcttagctgtggttattccacagctgatgcctctttcattgctgttcttctggttctgacaacaacagcattcttgcaccacttaactctccaagatgcaggcaggggaggtgactgcctcatttctgatgtgcttgttagctacaggaaaagcatcttagtattctacctttgtctaggacttgggactgggagcaggtattccgtttaagttttatgtgccatctgtatattttcaaaaacatttaacatgatctttatttcaagcttttatagccctttcaagttgctctaggggacttagcaaaacaggtagacagtaagtatggatcaactgagcacaggaaagaatgggatttgggaagatcacattgtttggattttctgctgatactaaagctggatttttactacacaggcagggagaaattactgtcctgtggtggacctggtgagagaggtggcatatgactaagcaagtcagctgacctcaattaaagggctgtgaccatctgtacaatgggaccagtacctcctccaactgttggtctcagctgagtgagattcccatgtctgaggaggtg

SEQ ID NO: 119464 - DNA, 2162 bp, Homo sapiens
cctttagtctggaggtgatagaaaatgccagttactgtggtatttaactgacatcaaactcctgtccaaataattcagttgggcccagccttctctcttaattggtgggaaggaaaacttcggcacacacccagaatagggaggaaactgttacgttgaacattttgaagtttcattctgaaggatctgaaagacacttgaatattttttaaattaactatccagttgagctttttaaaaacagtaacaaaagaatctcccctcaaacttgagctaccccaaatgattagcttttgtaagtcttcagaaaatgaaagtttagtcattgtaatccaaggtcaaagtggtggttgttatccaaagctcttatagatttatgtatctgtttggccctgttttaaacagtgctctgaaaattgacagttttctagctcacactcgtatttctttattaataccagaaattcacaagtgggttaaggcacccaccagtatacacatttaaaaatcaatatatgctagcatattgggacaaaagtgacatgaatatgattgtttcatgggagcaattagatgacactttttttgttttgtttttaaaagtaacttgttcctagttgctggagaaggtaatcctccgtaataagagtatagtttaccttattcatgagttacgtaaaacaattacaaaaataatgaaaagattttttttctaacttagtaggtagccttatttgactctaaaccttactcacttttgtgtatggtttctagccaaaggttcacacatgtgagaacatttcacttttagtactgaactactttttcgtgcactgaatgaatacaatatgttaacactcctgtaaggcccagaattgcttggctgccccttgccctgcctgcctggtactggctgaaaaggtaccattgtttgttctgcaaacactgagtgatgtttgtttccaaggtgactggttctattgctgccctttaagcaaaggtgggaggggggatgggggagagagaaagttggcttcagacacctgagagcatcctgttctgggtacagtgtgtgtatgtatatgtttgtaagttgaaattttattttaactgaggtaattggagaaaaagggatagtgtagaaatgggaggaaaagacagtatcagtaagttaaaaatatcagtaggttctgatgtttaactcaatatactttgagtgaatgtaatggtaaatgttaaaattaaagatctggtttgactgaagttaactttacatttggagttaaggggagaaaaatagataactgttgaaatgttaaatttatttttgcataaaatagttctgctataacctatgtgtagctattcaaacaaataaatattcgacaatataactgaattggttattgatcaggtagttgggccttcaaaaaaaagtatgagaatatgaaatataaacagatttaagttctgtaaaaacaaaatctgtaaaatcattcaggtatatttgtgttcaaaattttccaaaaagattagattaaaagtatcttttaattggtgatatatattgactccattagactttggaaatttatattttatcagtcagaacttttagattcagactagaaaaaaaattccttcttggtcctttcccccacccaccctttttattgtacatagatgctgttaacagaactttgcctttttcattcctatcaggtttagtacagttcatgcgcaggtttcagtaaacattaactacttttatcagagcttgcagtgtgctgaatggttagcaaagagagtgtactgcaagagacagatgaaaatgagagagtccaaggtcacatggattttgaattttttttaattattgagaatttaggggaaagaccatcaggcttcacactttaaatctctttatgtgggcctgccacacggcgtctttgccagcttttgtatgtactgaagctaaaacatttgttcagatgctgattggcaaggcaagtgactttaaaacatggtttttttttctttcaattaaaaaaagttttattcagggctgccttctaggatgaaagattctcaaggccctatcaaagacgtaatgcaacacttatcgtggtgattcttaagactcctttgaattttatagggat

SEQ ID NO: 119465 - DNA, 1035 bp, Homo sapiens
aactctgacagttttcagggatgctgagtagctggtaccagatgtttcttttgttaagggcatggagaggcagtgtcacaggtaatcaggctatggtcgttcactcccttggtctgagactatgcgttttgtggtgctgaatgttttcttaaaccaagaagggtgtggggaggtgcatgttctggtttctagttgggctttcccccgacactggctcttgcagtattatcttaggtagaggtgttgactcaattatcattagacccagctcctgttggaagagagtaaatggtgcttggggcctctttatctagaccgttttgccaccgctgaagtgacagcctgtgcttctaactgaattcagtccttttttttcactccctttctgtggaacaacagcaaagtcggctgctcatcattcgggtgcagactttacagcctctgaacagcctctgcttttgcagtttatgaatgcaccatttgttgttttgagcacaactgttagatacaactggcctctgcagcccactctgccggcgaccagtgtgcatcactgcagcctttttttctttctttttttttttttttttttgcataggccaaatttttgctttaaataccaccattttgtccacactagaatttctttgacccaacttacattttttcaaatgtaagtttcagaaataaggttttaatttgctcaaactgttggtctagggatcctgaataagtgcaagtattttactttattaaagggggaattgtttttgtggcttggttttgcacacttttttttttatattctcaaacatgtgacttccaaattttcctttaaattgggttgaagttagaaagttttattatttcctaagtcattatattttttctttttgagctttatgcacaaataatgttttcagtttagaacttaagatcttaaatgttctcataacaaaaaataaatatatgaggttatagatatgttagcttgatttaaccatttcacaatgtatacatgtatcaaaacctcac

SEQ ID NO: 119466 - DNA, 1029 bp, Homo sapiens
gagatgggaggggaggaggcgaggtggggacggagaaggaagtgtgtgcacacgcagacagcctgggagggcagtgaggtggagtcactgcaactcggtgccagcaagtcaggagacattactgctggaagtatccacagttagctctgacttaggggacgtcttgtggccataaatgtggaggaaccgagctctttaaaagccagtttgggtctgatataagttctgcttcgtgtttgtgtccattcactccgtaaacataccatatatagtcatgtttgagctcactataacacacattgcaagggagccgctcatagtgcacacatcctttggctgttagaagcagactcacataggctatttctggtgtgtcgtggctttcttctttctttttttttttttggtggggaggaggtggtgggggagggagaggaaaaggagctctttttccttccatcttcacactggttggaagatgtttctgattctagtttgtctggcactctgaaagctaaggaactgtattgtcatggcagaagaaacaattctctgtgtgcatctgttttagaatgaaaccgtacttttcttagtatcttaacatcacatgcattttgtagtttatggtctccagtctccagctgtttttggagcaccttctaactttgagagggtgagctctagcctgtaaaatggactgtgggtggctcgtggagaaggtgccctggtgtgcttttctgtgtcctctctggattctccctgagctgtccacctctgaagcctgcttcaccttcagactgccagggcaagacatgcagcttctgcagaactcatggcagccgttttccacttggccgagctgggtctgtgaagcagagaggaatcagtaataggaaagaaatgtagttgtttttttcccccttagaatacctaccatactgcatttcagcttggagtgcgcagcatgaggcatttgtggttcagaaaagaggtcttcctttttcctcctcctgttttcttttccttcct

SEQ ID NO: 119467 - DNA, 1003 bp, Homo sapiens
ttattcattaacagattcagatgatgtccaaataccataccaggttgtctgtattccctttattttttgagacagagtcttgctctgttgcccagaatggagtgcaatggcatgatttcggctcactgcaacctctgcctcccaggttcaagcaattctcctgtctcagcctcccgagtagctgggactagaggcgcgtgctaccacacccagctaatttttgtatttttagtagagtcggggtttcaccatattggtcaggctggtctcaaactcctgacctcaggtgatctgcccgccttggcctcccaaagtgctggaattacagttgtgagccaccacgcctggccatttgtctgtattcctaatgtgaattgtgcatatttatcaccaaaagaatatataaaatgtcatggatttttaaaagcaaatgataccaaagatccctaggtaccagagaagtcatagacatcctggaaaacatagtctctgtagaaaaggaatactgaacttaaaggaagtctcaagttaaatttaaaccatcaaatggtgaattggaaggaaggagtgccctcaactaagacttactgtaaaaaaccatagaattttagagctggaatggacttgagaggtgacttgttctgtttttatgagtttgtcttcattttacccagtgttcttccacaattcatgtctgtgcccagaattgaacaactcacctggaatagtgtccacatggctttttggccatgaggaataatcctaacttggaaaataataggtatttactcagcagaaattattaggttttgggttttgtttgttttttgttgagacagagtttcgctctggtcgcctaggctggagtccagtggcgcaatctcggctcactgcaacctggcgcctcccaggttcaagcgattctcctgcctcagcctcctgagtagctgggattacaggtgtgcaccaccacgcctggctaatttttgtatttttagtagag

SEQ ID NO: 119468 - DNA, 1858 bp, Homo sapiens
aaaactccccagagttgctaatacctgctactggttctcaagtggtttgatattatatacataagtgtggagcattgctggacccaggttttaataatcagattaatagatacatttgaaacattgtcatattagcttttaatactactgaatttaagtcttctgtgcacttaggtttgctgtaacgcatggttaacatatataggttggtataaatttttctgttcctgattcagatagggtttttgtgtgttttgggttttttctccataagagaaattgttccctttgaaattttaattagttttgaaattaaactatagttgtgcatatgcatggcagctatacctcctgattgctatgctgaaggtagaaagtattctcttgttgtatagacattggtcatactgtcaggcaagggaaatgccactaatttctgtttcttgaattgcataccagaaataggaattcgttgtctgactgttagatgctcagggcagatggaaaagtaagaaaaaccaggacttcccaggaagcaagtggcagatctgtgtgctgactgtttcagggtggggatggcacagagggggcttgcaggagagatgtggccgagggtggaagagcttgtcttcggtgccttgtgataagcgacctgcagcctgttgcaatggcgactgcatttgagatggtgtgcttgtaacatccgccgggtaggcggagcctcaaggacacatgttgagaggttggggtggtggagccaggaggtgcagtgagcgaagcatccaggcgtggatttgaacagctgctggccgcccggagatcagcctccatgcatcagtcataggcacagagaactcatccgtgcggctggaggctgaacatggagaaggagggaagggagctgctttttcagttaatactcttgatgcttccagagcagtttaaagatactgcggaaatttgttgggtggttcattgtttgttttaaaagctttgcccccttcacgtaatcctatcttttatttaatataaatgcaatcagtctgctttaaacactgactaaaattgcttttactagatattgtattatgtataaggggggagctgaggcccaaagagaagaatttgatcaattgatttaaggttgttggaggattgaaatgttacttgattgctggtcttatccaggatttcaagatttcaaggaaaagtggacaatgcctgcttttatctaagggatttcagcagtcatatgatctacaaaccagcccccaggagcagcaggccctggcaacctctgtgctatggagtccacgcagaacagggacttcaaagtgcttggggtgtgctggcttgggagtcatttcgctgagaactggttttggtcatggccttaacatctgcatagatgttgcacattgcaggcacatgacacttgaatgggctgagatttaggtgcaagttggtagagcttaaaggggaggtaacattagtgaggccaatgggcagcagccccactgctgagcacacactgcagttccctgcagggtcagggagaaggtggccttgccaggttgaggctaggagcagagatcatcttgttaagttctcacaaatcaattactgacacgggaacagtgtgtaaaagtctgaaaccacaaatctttttggacattttggctgtataaagcatatcatttataagctcccaggaatttacttatagtttgagtgtctcttgtgatgaacaggactatgggggagaaataaaccaagcaagtgaaatcacagaaactatgtgaaatcacttttagatggctttcgttttcaaaacgttggatattctcactatatttcc

SEQ ID NO: 119469 - DNA, 1075 bp, Homo sapiens
ccttttccatttcatctccataaggttctctatgcacataaactagatgaagcttaggcctgaagcctagaacataatgacactttggttctcaaagtgtggtccccagacaagcagcattagcatcacctgggaacttgttagaaacacagattcctaggccccactccagccctgctgaatcagaaatgtggaggtggggcccagaaatctgttatcataagctctccaggtgcatactaaagtttgaaaatgactgcccagtgggagtacaatgtttgtagcacctgttgaactcatcactggggacgtgaaggactaatagacacttgctaatgtgaacgtacagtatgtgtgctcaggtgtgagcatgtatatgataataaaaagcactgagggatggtatcatgtgtgccagacaggttttagcactttatagatttgactaatctatttctcagaacagtcatatgatttcagtattattattgtctccatctcacagatgaggaaattgcagaactgagaggttccctaactgtctaagggtcaggccacttaccactgctggcaagtggtagaggcaggatttgcgatgtggttccagagcctactccttaactaccatgcaattccgcttgttcatctttgggtggttacccaccgggccttaaggtagtcttttcattttttcttgaatggagacagtctgtcagagttcgcaggaagtgtggtgtgctggtgacagttcacattccaagttaagcccccttaccacgagcttcattcgttggtggtttacgtgtggggggtgctggtgacagtgttggtcaatactagaggggcatggctaggcagcagctgcccagtcatttaaaactgaacaataaatagaacggggttgttaggggcggaacgaaggggcctagtgggaagtggtttctcagagggagatagttcagtcgcactagaagaatattttcttcagttaacctatgtgtaattttcaggcttatgagaagaaaggccctgttctcatcaccctcccttttgattcttctttggtctttttcca

SEQ ID NO: 119470 - DNA, 1029 bp, Homo sapiens
aagtaaattacgggtggtgagcaagacatgcctcatttttatgatcacaagcgtgttgaagaattctgagaagcaggacttggtttcaaaagtatgccaaaacaatttcatgtcatgaaaatactggtagaggtaggcttttgattgagaatgttcccattacatactgggttacattaaataggcatcagcttggatttacaaatctgtgtgctacagagattttccctgttaaggtgtgtctgacccatggggactgggtgggcgtgtccagctgcccttggactgggcagatgagcaggcagggcggctgtgcttctctgaagtgtgcgcatctcctcttagttgtgcttctggtgttgacccaattattgcccgggtatgaaagagtttgaaggaagagactgtcctgctggtgtctatctccccttttcagttttccttcctgttctttgtaacatttggggggagtttgggggcttgcaaaggggttatctgtttctcagggtggggcttgtaaacatgaacccacacttaagagcctgggcatgttcagtgccctgtgtgagctcaatccaaagcaagtgaacaagtgtgcttcagggacatgatgcttgtttcaggccccgctgggccgtggaggggcggtggccctttgtgcagttagaccccccagggagtgcagttgtgaactaatcaccgcctggagagcctgtgtgcctcacacttcctccaggactgcactaatccccactcccacccccaactgccagcccctggccttggccccctccttccaaggtgcctctgctggtccaggaacatgccacctcctctcccagctgcacatgggctttccaaaaaggcccatcctgcctgctagtcatttttggtttgctcagtttactttaagaaaacccatttgcttgccagtgtttttggttggctagcttgtgataaacacttatcaaccacttatatctcagagcatttgttttccttcatatgcacagtagtaaatacttttct

SEQ ID NO: 119471 - DNA, 1026 bp, Homo sapiens
attcttttctgttttcaaattcctcaaccaaggtgtgttgtggaggcctcttcctaccctttcttgcacctgggtctacctgataagccaggagagcagatcttagggtgggacagggcaggggagctgctcaacttaattccctgtgggacatctttagccttggcccaggaaaccctgccttgccctgggggtaggtgagggtgccctgtgggccctctgcccctgtggtccagcatgggtgcttccttattagagcatagtccaccttgggcacccagagtagagacgatacatgtttctgctaagttaggcaagaaagtgatgaaataccagggtcctggcaggcaggctgaaaaacaatgtttaggaaaagtctggcttttttggggaaagggccagggactcaactcttcccacagctgagtgccgagggctgctgtgtcccctcccaggggagccgggtgctgtgtgacaaatggctgccatttagcagctgtgtcttggccttgcaaatctggcagtagttagatcctggcaggaagacatgctccctggagaagagctacaagaagtggagtcagcttcttcatagtcctcatgtactagcaggaaagcttatcactgggactgtgccccatttccttcctttaaagaagcacagagccttgcagagaggtgcaggaagaagaatggggtaccacaggatggttttatctggcattgtccagaaaatctccctagctctcccgtggatcatgttttaaatactcaatctgactgacgtagataaatttggtaggcagggaccctgtctccccagtcaatgtgtgcctccctgctgaagttatatttaatgtaataatttaaatgtccaagtgatttttaagagaagctgcttcctgcatggaacctattactctgcattaagctgctccttcccccacactttacaaaatattgaagttttcctttacctaagaacaaccgacattgcttttgaaaaggagcatcagtagcttgtgt

SEQ ID NO: 119472 - DNA, 1423 bp, Homo sapiens
aaaagaactctcaggtttttgcctataatcccagcactttgggaggctgaggcgggtagatcacttgaggccaggagttcaagacccacctgggcaacatggcaaaaccctaaaaacccaattttagtctcaactaaaaatgcaaaaattaaagttagccgggtgtggtggcacacacgcctgtaatcccagctacccgggaggcttgaggcacaagaatcgcctgaaccagggaggcagaggttacaggctttcagccttggcgacagaaaaaaaaaaagggaaagaaagaaaaaaaaggaaagaaaccctcgggtttttcagaagctgggatgcagcccttatctttcatctcttcattgctgtctccttagacctggagacctgccccttaatcttctgtttctggctttacatagcattgtcccgtatctcccccggggcttgggggctggcctttccctcctcccacagagggacttccgccctctcttagtcctcctgcctccgttgactttgcgtaaatcttgtgggagtgcaaatccagaaattcagcagcctccaccaacaaccagacccaggctttctgtcacacttcacctacaggagtcatctttagggtgctactagtctttcctttttttttttttttttctgaagcattgttgatggaggtaaggggtgtcttagagtttcttctaataactcttttgtacttttccgctcttcaagctctgtgactccctcaggcctaatagaacccaaaacaaacagcctcgtgaactctggctttatattgcaagacattctcaatattcaaatcatttacacccaagggcaagaggatggaagtttcaaggtcaagtctctcagcctagccctctttctctaaaaccatcctctccttgctgtcctgtgtgcttccaggacgctacccggtggacctttttttaaggtgtctttttaaaatgaagggaaataaaataaaatgaaatgaaggggaggcagcagatctaaattttaatggaagtcttagctacatgctagaaaatcttaattctagacacttgtttagactctgaagtgtgtttatttattgtatttatttatttttttgagacagactctctgtcgtccaggctggagtgcagaggcacaatctcagctcactgcaacctccgccttccgggttcaagtgattctcctgcctcagtctcccaggtagctgggattacaggtgtgcaccatgatgttcagctaatttttgtatttttagtagagatggggttttgccatgttggccaggctggtcacaaactcctgacctcaggtgatccacctgcctcagtgtccctaagtgctgggattatagatgtgagccaccgcgcctggcctatttatttatttatttattttaattttt

SEQ ID NO: 119473 - DNA, 1053 bp, Homo sapiens
ttacaggtgtaagccactgtgcccggccccggctgatttttattttgtataggtggggtcttgctgtgtttcctaggcttgtctcaaattcctggcctcaagccatcctcccacctcaggcttccaaagtgctgggattacaggtgtgagccaccacacctggccttattttataataataacatatattattactaatattggagtgatgtcagggagaagaaatgttgcagaagaaagaatgaaaagtctaggattgtaaatatccagaaagaaaaaaatgctttgtgaatagaccataaaaatgttagtaatggtcttttattccccgagattgagtatcagagggtttaggttggttagtttgggctgttgttccaaaattgtccaggatgtggttatagggtagataggaccaactaatactggccagcttgctctggttcgatgatcttgtagaagagcccgcatgttatggtgggttttttctaacgtagaacaatgagctccattgtgccttgcaccagcttcttccccttcttccctgctctgtggtcctgaaggaagaactcaaatagaagacataagaacaaactgaagtacaatcttgtcacagcccaaggggctggttgttggttccttctggaacagattctcagggatgaggccagtgactcttttctttttttcaaacagtgtagctatgagtttcattttattaattacgctttcagattagagatgagtctctatttttttttaattgttatttacttaaaataggaaaaggaagtaaatgtaagtgatcttggtgtcatcagtgggtagtgtcacactttatactttatccccaaggaagaaacatgtttagcaaatatcttcctgtccagacaaaatggcaaacaacaaggcttttctccttttcaagtgggataagcttttgcaattttcagcccttacattggttaactatactgactgttgctaggctttctgtgtttaagacacttaggtagtttgcaagaatgtatctttgataacatgactgaaaag

SEQ ID NO: 119474 - DNA, 1032 bp, Homo sapiens
cagctcagttgctgagcagaagagtaggttaccatcaagtacaaaacatgtagcacggaaacatcactgtggatccagcttttaacttcccagaactctttatcagttgctcccacgttgaaaatttggattgagtggtgctcgtcttccaaaacaaacttgggaaactgagccagagcacgcctctgggagagctcaatgtaggaaaaagggcattgagctttgcagtttgcaaagcttgttccaggaagtgctgagctgcaaagctgtgaagaaatgatacttgaaacagaggatagaaatgtgcctcatttggaataaagcctgtctctaaaactggtattttccttttaaaattgccttgggaaaataggaaattaattttcactttgctccttattttacagactgtagacttttaattctaaagagttgtggagcatgtcttacatttaagggcatgcttaagaccctggcaggggcaagctttcatgactaacttcactgattctttgaagagtagggatgtgttctgatttcagctgtcattagaatggtgaagatgggccagtactttgggaggccaaggtgagtggatcacttgaggacaggagtttgagaacagcctggccaacatggcaaaaccccatctctactaaaaaaacaaaaattagccagattacccataatcccagctactcaggaagttgagttcacttgaactcatgaggcggaggctgcagtgagctgagatcacgccgctgcactccagcctgggcaacaaagcaagactttgcctcaaaaagaagggtgaagatgaagaagggaaatccttggaacatcatctagttgtttcgttgcaggcttttttcctgcagccataggcacgattttttctgttgccaagtatgggagacataggccctgaggatgcccctggacatcaggataggcttcaggaagaggcttatatgttcctattatgcttgaagaaaatattagctgcgcagaaatgtgacctgctccatgaca

SEQ ID NO: 119475 - DNA, 1085 bp, Homo sapiens
ttgttgaggtatttcagcagctcagtcttaccgggtaaaactggtggatggcagcagaatctggaacatcgtgcttgcccacacttgaacagcaggcagtggtgagagtgagaaattaggttagggaaggttagggatgggcttgctgggggtaggatgactagcagagagctggcctctgctccggaatgcaacatgcccaggtgtcctctcccaccatgcccctcgtctgatgcactgagaactttgaacaggtcctgagtgtgtgtccggtttagtttcataactcgaaagtagcaaagtcaagagggagcctgacttccagcattagatcacaaaatgaaacctgcagggagctggcagcatttccaccgtagcacttcacagggctttataccttacatttttccgcctttgtttaaatatccaacctgtccgacctgttcgggctgaacaagctggtgctagcaaacactgaagcgtgcccactcactgtcaacctttttctgatgtgttaaggaaggtgattagtggcaacattgtcccccccccccaacccccatcccaccctccccactgaaacatgaacaggaagcactgaagtcttagcctgtgtattcatgacacggatcctcatctcacctttggcatgtctgtgtgcctgtgggccatcctcagcttctcttggggctctgggatgcttagtggaaaggttgttggccttcagtggagacagattttgtatttccttaaaccggagattcagttgcataatgggttcattggtcctgtggtgtcagcacttaattcttccttttcatgcttatataacccagcttgctcaagaggactgctgttccaagtttatgggtgggaaaactgaggtctgccatgctgcaggttcttctggggccctcctctccagtttctgttggtagatggtgtactgttcctccctcgacatctctggagaacagaggccatgtgtgcaccatgtccatccgttttagataaaagtggctatagacggccttggtcatacagaagggctctgtcgcctggttggtcttgggaggtgacatttc

SEQ ID NO: 119476 - DNA, 1016 bp, Homo sapiens
cacttcccttgtgggcgcatggccgaccatctgggatggccccacccgtgcatttcttgttcctcttttggaactggctgaggagtagcagtgacttagcactgccctatcatgaagatagtcatctcttcctcctgcacagaaagtgagtaagtaactaggtcctgccttcttgaagacacctcaagtgatcgcctttcaagctgaagtgggaaatggcccgtgacttcagcacttccctcctcctacagagcttaggtgtggggattggggtgtatgattttagtcgttgccctgggaagctggtctctggtggccggcgatggcttccctcagaggggacagctctgggctcttgagatcactttgggaatgatgacttcagttggggcaccatcacctcagactgtaatatggggatattcagcatccctgctgggagaggccagccatgagtgtggggatttggaccccaggctgcatgtaaatgttgaggaaactgagggaggttagcctggggaagaagaagaggccatggcaacacagcagctgccctgaggtatctaaggcctgtccgtgggaaatgagagccttccactgatgtctctggactcacccaggaaggtcctagctggccgattatagctctatgttaatgagagttctctttgggtgagaggaacatcaattcatccaacttctgaggtcttttgtttgtttttaagaatgtctgactttgtatggacatattactatgtatttttgtggattttgtaaatagatatggggaccaaataacatgaaaatttattttagcaaaacacaagcaggcaagggaaaaagacaagcacaggaggatgtagggtgttactgattcaagggtagggcagttaggaatcatgtctagagtaaaagatttttaaaaggttagtgctggttcatgtggactgccaacacctctctaccccctactggatctgaaagtcaggagaggaggaaggagctgtagaagcagc

SEQ ID NO: 119477 - DNA, 1743 bp, Homo sapiens
atgaatccttatatatggatctttgcacatttgttcagttattagaccttaagacagatttctaggagtagaattactgaggcaaagagcatacatatttaaaattcatatctctagtgctcagccactttgcagaaaggcagtcactcatttctactctcaccaacgatgggagagtaccagtcttctgaaccacaccaacaccgcatattgttaatgtaagactttctcaccctcgccagtctggaaggtgaaaagatgcactgctcaggtgcagaatggaggagatgtggtttgatagcagtaaatgaaggaatcgtggggattgtgattgacaacaaacttggtaggaactgagggtataaacacacccaatggaacccacccaggctccctttatgtaccttctggaggtcatagtgccagccatgtgccctgagctgtcagatcacatccagactggagtttgcatctggatccagcatttcatgaaggatacctgtacgctggagagcattccaaggttacttaggaccagtataattccacagacttgcaagcagagcttgaggggggctgttcacttttgaaaagagaacgcattacagaaacgcagtagtcctcttacactatttgaagagctgccacgcagatgagaacatggactgatgttataacacagcatctcccttgaggacagatagacagaatttctgactcaatgtgagggagatggttttaacaattagaacagccagtgaaaatggagaagtccttgttggtggaagtgtccaagcagaactaaatggtgatgcctccagtctgctgtggagagggactttctatgcagagtagagggctgaatcccatcccagctcccttccagttcatgggctccttgtcatttattgactctcaggatgcgtggaaattagacaaattagcccttgaaatcaaccctgagagaaagacaagacccaagccttctaaggattggaatactctctttcccaccacccctaatttgttttggccacagcttgagggaaggggtcattagtgtctcatcatgatgatcctggctgcacttcctgtgagcttttgggaggaaatgaacagctccagttgccactcctgttgttggaggctagggaagcagagcaggggtcagagcagtggggagaatctctcactacatcaaatccatcgtcagacctggccggacccctccaaccctgcagttcacccgtgggctgaattgaggttgtcagtgcagcttttgctcatcaagcggctggaaggacaaagcaggaacttcccatgttgtacccggtagctggggatttcaccctgaaatggagcggtgcttgtgcttttgcacctggggctccggggctcagtgggagaactggagtgagccgctgtctgtcagactgccttggcctgctttggtcactctgccacttctaggagtgatgcagttcaagggcagccctggttttccagactaagccagaggctctgcagtccttgagcaaaactggaggtgggaatgttctatgcctgagctgtgggctcctcaccctcttcactttggtagtaactgtgccaccttgggccacagtccaccagagaggaagtgtccaggttcaggttatatccttaagattccagctggtgatccagaacagagttaactgactggcgtggtcttgggagataggctgggtttgggggaagagc

SEQ ID NO: 119478 - DNA, 1184 bp, Homo sapiens
taatgcttcatcgagtataccagtatcatcaaaatataatgtcaacacataatcaatagaaaaatggtgagtgatgtggttcacattcttgcttccatgtactgactctttgaaatctggtgtgtgtgacgtgaccccagcccgtcttggctgcaccacaccagccacatttcaggtgcttaacagcccacagagaggtttcagatgagccacctacggcagggagggctgcagctttgacgcggagccatgtcttgtgtgtgaagaaggcccaagggcggcagctggatggtcaccctgttggcacagccactgctgagggtgaaactcggccaaagttattgtgtaatcttagatggccccctgatgaaaggagttcgggtaataagtaacgttaacatcatttcagttaaaatgtacccagcaaatgattgagtttgtactgtgtgccaggcacttgcccaggcttgaaggaaagagtgatgtttgagacagggtacgggctaggcacaaaacaagctggttggttataaaacaaagttcaggggtgagttcagggcccaggagggcacatttccctcagattccaggcaggcagagggatctggtggatgcaaaacttctccttgggattttacatcagaggctgtggtgcttcacttaatttcctctgggtcagggcccaaccgggtctggtacttcattgaccctggtcatctctgagttcaaggtgatgacattaaatctctgttgggaattggtacatagggagcccaagggggctctgacaggaacctcggctccatgagtagtgagggcagctgagaccacccccttcctgtatcttagtagtggggccaccaaagggaaatgccttctttttcctgcattctccactgttccaaggaatgtttatctcccttcaccacacgcctaccacctacagagaccccaagactcctcatgtacccgggattgatcccacccttgtcaaatgtcatcctaaaaacagggaaaagataaaatatttgtcagcatcttctgttgaagagtctgtgagtctgaggcttgggcaggcagaaacagattttaaacacttccgggggctatgaacagaggtccctcaaggaggggaagactgcccccacccctcacctgacaggtacagaagccttggtcaggac

SEQ ID NO: 119479 - DNA, 2198 bp, Homo sapiens
gctaggacacaggcatgtaccaccacatctggctaattttcttatttttttttatagagacaaggtcttgctatgttgcccaggctagtcacaaactcctggcctcaagtgatcctcccgcctcagtctctggagtagctgggactagaggcatgagccaacacacctggctaatttttttttattttttgtagagatacgggatcttgctatattgcccaggctgggaactctttatgttatggggaaaggctgtgtactgggataaatgtacaacaaatactttgtgcatctccgtttagtgattattttttcaatcttcacatgtgttcccttgcttttaccggtgggttctatataggcctggtgcgaaacaaacctgcggaggtgcatcagcgagcaacaccgttttgtctgcgacacctgtgacaaggcgttccccatgctctgctcactggctctgcacaagcagacccatgtggcggcagaccagggtcaagaaaagccgcaggccacgcccctgcctggtgacgccctggaccagaagggcttcctggccttgcttggcctgcagcacaccaaagacgtcaggcctgcccccgccgaggagcccctgccggatgacaaccaggcaattcagctccagacactcaagtgtcagctacctcaggaccccggctgcaccaacctgctgagcctgtcacctttcgaagctgcttccctaggcggttctctcacagttctccccgcgaccaaggacagcataaagcacctgtccctgcagcccttccagaagggcttcatcatccagcctgacagcagcattgtggtcaagcccatctctggcgagtcggccatcgagctggcagacatccagcaaattctgaagatggcagcctcggctccccctcagatcagtcttccgcccttctccaaggcccctgccgccccactgcaggcgatcttcaagcacatgccccctctgaagccaaagcccctggtcacaccacggacggtggtggccacctccacgcccccgcctctcatcaacgcccagcaggcttccccgggctgtatcagccccagcctgccgccaccgcccctgaagctcctcaaaggctcagtggaggcggcctccaacgcccacctgctgcagtccaagtccgggacccagccccacgcggccacgcggctctccctgcagcagccgcgggcggagctgccgggccagcctgagatgaagacgcagctggagcaggacagcatcatcgaggccctgctgccgctgagcatggaggccaagatcaagcaggagatcacagagggggaactcaaggccttcatgacagcgcccggcggcaagaagacgcccgccatgcgcaaggtgctctacccctgccgcttctgcaaccaggtgtttgccttctcgggggtcttgcgtgcccacgtgcgctcccacctgggcatctcgccataccagtgcaacatctgcgactacatcgccgccgacaaggccgcgctcatccgccacctgcgcacgcacagtggggagcggccctacatttgcaagatctgccactaccccttcactgtcaaagccaactgcgagcggcacctgcgcaagaagcacctcaaggccacccgcaaggatatcgagaagaacatcgagtatgtgagtagcagcgcggccgagctggtggacgccttctgcgccccggacaccgtgtgccggctgtgcggcgaggacctcaagcactatcgtgccctgcgcatccacatgcgcacgcactgcggccgcggcctgggcgggggccacaagggccgcaagcccttcgagtgcaaggagtgcagcgccgcgttcgcggccaagcgcaactgcatccaccacatcctcaagcagcacctgcacgtgcccgagcaggacatcgagagctacgtgctggccgccgacggcctgggccccgcagaggcgccggccgctgaggcgtcggggcgcggggaggacagtggctgcgctgcccttggtgactgcaagcccctcactgccttcctggaaccccagaacggctttcttcacaggggccccacccagcctccacctccccatgtctcgatcaagttggagcccgccagtagctttgcggtggacttcaatgagcccctggacttctcgcagaagggcctggccctggtccaag

SEQ ID NO: 119480 - DNA, 1056 bp, Homo sapiens
gtggtgagccaagatcacgccactgcactccagcctgagctacagagcaagaatttgtctcaaaaaataaaaaaattagccaggcatggtgatgtgcacttgtagtcccagctacttgggaagctgaggcaggaggatcacttgaactcagccaggagttcaaggctgcagtgagctgtgatcatgccactgtactctagccagggtgcacacaggcactctagcttgggtgacagggtgagagcttgtctcaaaaaaaaaaaaaaaaaaaaaaaaacctccaaaaacaaacaaaaaaaattagccagtgtttactctcccagaacagtcaagaaacgaagaaggacattggggcaagagaagagtgaacagtgagaatagtttgatgaggagattggggccttggcctccaagataaaaaaaaaaaaaaacagaactgaaaacatttctgttcatttttcaaagacaatcagggttagaaaggtggggtctaactagcatagaaaaccttgcagttgcttttctttttgtaacaagatgacagcctgagcagcccagccttctctccattgctcctccacccctgcaggcaggtttctttcttttggtattttctctctgtatttggcagaagtgtacacaggactgggtacaaacggccaaagctgtcttttaagaaagctaaaaggagccaaatacaagtggtgtcccaggtgctttccacacccaggtttggatgactcactgaccgaagctctgaccctcactgccagatagaagcagggaggaaagggtgtggggggaaagcctgagccggctcaaaaaaggcgctcaaagcacccatgagaaagtaagcaagccagggaagcccggaatggacaccccatagtcccaagcccatcactgtgggacaaggaactggagcaaagggaagggggaagaaaatgaggacagaggctagaacagactggctgtgtttcctggcaccctctcctccacctgtggcctaaaaacacacgagatgctcccgaggggtaaaggcaggaacagtgcact

SEQ ID NO: 119481 - DNA, 1065 bp, Homo sapiens
taggattacaggtgtgagcctccgtgccggccttttttttttattattatttgttatagagacaaggtctcactgtgttgcccaagttggtcttaaactcctgggctcaagcgatccacctccgttggcctcccaaagtgctgggattataggcatgagccactctgcccagctggctgatggtttaagcgctcgcgttggggcttgcagaatgctgtaggtcctgagtgcgcaggtaactcactgtggttacaggtgcttttacaaatccccttctaaagcagttattcgtggcagctaccaaataaatagaatcatttgctactttctatatagatggctggccaacaagtgtttttgaaacctgcgttattataaaatactaaacgggcccgttttcctgcatccctgcaatccagagagcccaccactatgtaaaaatgtcagacttacgcagtgaaatgtgagcttctaatgactcatgtgagttgttatgtcactttgggagcctttgtagtttgatgcaatactttcacatcatggattgttttctgaatttagcattaatagggaccttctcatggggacgtcagcctggcagtcctaaccaactgtaaaggtgacgcacttaccagtgtgaaaattacagagtaaaccatgtgacaggggggagcgagaagccgattgttttctttgaaatcaagaatcctatcatagtagcttcttacttgttttcctcttggcccagttcttttctcaatctggccagactcagagaagcagcagtgttaccttttgacaataaaatgttaaaagtactttatttttacttgaaattattaaatactgtgttcaattttaaatgaaaaacaataagtaatttttttcattttattttatttttgagacagagtctgtctgtcgcccaggctagagtgcagtggcacaatctctgctcactgccacctccgcctcccaggctcaagcaatcctcccacctcagcctccccagtagctgggattaaggtgtgcaccaccatgcctagctaatttttgtatttttag

SEQ ID NO: 119482 - DNA, 1638 bp, Homo sapiens
ggcggccctggggcaggacctgctggagccgcgcagcaagaggcctgcccacccaatcctggccacagctgatggcgcctcccagctcgtggggatggagtgacagcctcagtccccctcagcacagacaaaagccagcagagcaaagcgtctatacttcatggggtttcctcagtgccctttggctgttgaggagtgagagagagagagagagagagagagagagagagagagagagacaagcaggagcgtggctgctcgctcagtgccatagccttaccgcagcctgcgcgggaggccacagcccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtccatttccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgcacccaggtccccgtgttaacgtgtgcctgcggttgtggttggcaccctcgggtggtagctcttctactgtaatgagacaagcctttcttctgtcactgcagaatttagaaggggccgtgagcagtcttcccaagcatggtccaggagcagctcagagagggtggagtgaggatgcatgcatccagggaacaggcatcaagaagccagggccgtgcctggagcactgcagagatgactttggagaaagcaaagcagtgacccagtgaccaggcacattactcgtgagcgaggtattcccagtcttcctgctaagcctaatccaagccttacccagctgtgctactgtcatttgcaaagcaaggaaatactactactggtaataaaactacacatgcaagatgtcagataagaaataggtttatatttaccttcctgcgatgtggggttggtgcttgaagataaatgtgctgtttctagtttcttaaatagcccacacccctggatgcaaaaaggcagggttatttttacccatgagcatcctgtgcaggcaatagacttccctcactgtctccgcctgcagggaggagaatgtaccccactgcacc

SEQ ID NO: 119483 - DNA, 1113 bp, Homo sapiens
agaggttgcagtaagctgagatcacgccactgcacttcagcctgggtgcttccgtctcaaaaaaaaaaaagttcacacatttttagacatttcagtgatgttttagaataaaggtgatttaagattggttttacaggcactcttgggctgtcagctagttggcttttcagatgatgatcataaagacactccccctcacgcaggtatatgagtaagtaaggtctaccccatccacactcccatactgactttccattcccaataattgcacagactgcatactctgatcgcttattaaacatttctaaggaagccgagatggatctttgatgtaattttctcatctgtatacccagccagtaagtcagtagcacctaagatttctttcccttcaagattgtattctaagcagtagaattaaagtgttcttcatagaaaaagtaacttttaattagaggctgtgcaaactctggagaatcagtctttgttaccagataataatgtttttagctttttctgctgagaggaaaaaatgctttgaagaataaaaaatactagagcataacaagcttggggagttaggaaaaaatatattagggcagtaagaaccagcattacgtcttctctgcaatgcttgaaacattcagtattaaactttggattaatccaaagtctgaagagaaatacaccaaaatgctaaagccgtttttggttaggatagtggactttttttttcttcttcagaatgtttgtaatgagcctatattttataatggaagcaataaatgcaaatgtgaaatttatctgagcctcctacaatgagtataataaatccagtggttgtggatagcttatttgtggccccaaaagaaacggagccactttttaaaacttggatgcattgtcactacatagtgaaagaaaatcaagatattcttttttttttttttttaaacggtgtctcactctgttgcgcagctggagtgcaatggcgcaatcttggctcactgcaacctccgcctcccgggttcaagcgattattctgcctcagcttccttagtagctggtattacaggaatgtgccaccacgcccagctaatttttgtattttta

SEQ ID NO: 119484 - DNA, 1505 bp, Homo sapiens
gcatttgatatgtcatccagttcataatcaagttgcctttttctggctaaaacataatgattatgtatttttctcatttggtcctacaagctgctggccctttgtccctccactgtgggaatcagatctagaggaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcacttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctggg

SEQ ID NO: 119485 - DNA, 1142 bp, Homo sapiens
gagttagtatggttcgtaagtattcctggtgatacgctagtattggcaattctgtgaggttgaacaaaggggtggtatggtgtgctagcgtgggaattaggagacctctgggtcttgacagtgccctggccactaagcaaaggcagttcatccttggagtctcaatgtgcttttttgttaattgagatatgcttgaagtatcagccctaaatagtctgattctgtgacctacaaacccttacttaattcagtgttactataaatgattcttcccttaaacctactttttacttagcaaaagagaaaaaaaaaaaaaggaaacgctcatgtcaggctgcctgggtttgaaccccagatcccctcttagttggaggcaagttgtatgatgcttcagcttttggttcctgcctcctaaggttgttaggagttactgtgtgtagctgcttagaacattgcctgggtctcagtaagccgcttaagtgactgctctcattttcgctgtaaagcaccatactgtaataacatcccatgaagcatggggcggggaagagtatatggtaccttatggactttgatgtggtggggtagtaggtaaattctgaatatgtaagctacatagtattctttttgtaactaaaggataaaagttttaagatgggcatgtaatatggctagcactggattttaatgatgagccagagtaataaggctggcaaggggagtttttgttttgtaataaatctcttacacctgcacatccagttctttttaaaaacacgtttgaagaggctccatatttctcagtgaagctgttggggttcatgttatttttgaaaatcatcttgcaatttatttcagcatcagactgaaccacccaaagaaaattagtctatttctgaacagttttttcagaaaccatattggtctgatcacccaacatttatagaaataggcgcttaaggcctagaggcatttcagaaaggagaatgagaaatactgtggtcaagagtagtgttcagatggagaacatcaagcatctgctctgcccttccacacacatcctcatttcatcttcacaactgccctaggtaaccttgttatctgtaatgaaacagcctcaaggagcacagaggcactcactc

SEQ ID NO: 119486 - DNA, 1034 bp, Homo sapiens
tgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccac

SEQ ID NO: 119487 - DNA, 3388 bp, Homo sapiens
gtgcatagaattgttttagcattgaaatactgatttcctttattctgctgcttattccaggtaaatttatgaaattgaaaaattatgcaaactgcatgactgcatttgtaaatacaaaatcagcagtttttaagcgtttacttatgcatgtataaacttggttaagttatagaattgaagattttgcatggtgtcttcagcagtacaataaccaagtttaaatctcttacccaccctaattgcaaaacactttcattttaattggggttacctcttgaaggattatgttaaagattgtttttaaaacctagagctagataggaggcattcattattagatggtgttcacccatgtgtgtgtgtaacttagtggtaaagttgaaggtaaatactttttaacatgtcttttgaattcaatatacttataataggcaagcttaaaactttctcttttcttccagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtggcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattt

SEQ ID NO: 119488 - DNA, 1051 bp, Homo sapiens
taaagggaaataaagtcattgtataaatagatactcttatgtggtccaccagtggtacataacatgaacctttatagcaaggggaaaggtctttaaagcctgaaaataaatgtgatgaagatttattctttatcatcagtactagacatgattttctccttccctttaataaagtatttgagtagaagtatgttctaggaagactagaagagaatataacttgtttaccaagatatttaaattaagtaatttgataggtgttttaaaaattagagtaaacagctggtcatgatagtatgtgcctatagtcccagctacttgggaggctcaggcaggaggattgcttgagcccaggagttccaggcagcctgggcaacatagcaagacctcaactcttttttaaaaaatattaagtaaatggtgtaacggaactcctttaaaatatgtctttatgttcttttagcgtaagagacccatacagaaagtagaaatgggtacatcaagtcagaatgatgttgacatgagttggattcctcaggaaacattgaatcaaatcagtaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttcttatgctttaatttggaaattcttccagatctgcagcttatttatgaatgtgtgaattttctgtgttcctaatccatttcctgtctcttttctttctgttgcttcagtgcagagtagaagaggtgaggcatttaatttttttaatggtttttgctagagaattgggggctctcaaatagcacgtaaatattttacgtcaagtttaatgagtaatggaacaatttttcttactacattttattagaaaaactacccagtataacttgaaagaataaacctaaaatattacccgacaatttattttacagatac

SEQ ID NO: 119489 - DNA, 2023 bp, Homo sapiens
ctgagttaaatttctagtgctgcaatcaagttttcttttttctgattacttagtagagaaaaggaagtattttcatcctgtcctcaaaataataacttacagttattacttaactctatagttaagtagcttaaagaattactgattttagcttgtttttgagtagaataaaatttaatccaacaggtatatatgaagttttagttccttcttttaaattcacctgtaccactttttttttaatctgtgtattattcctgaaattatcaatagaggaatgcaaattgaaggatcttgaagtaaaacttacataattacagtttagcaataagtgacagttttgacaatgtactacctttgtgaagaatagctgtgtattgccccagtgagtctaatgcatttgaaaactgaaattgtgaactgataaaattatttcaagaccacaacataaaaatattttcatacctaaagtgaccatcccatttattatgaagaaattggtttccagcccactgtctttttttttttttttgaggtgggagtttcgctcttgttgctcaggctggagtgatctcggctcatcacaacctctgccttctgggcacaagtgattctcctgcctcagccacctgagtagctgtgattacaggcatgcgcaaccatacccggctaattttgtatttttagtagagagggggtttctccatgttggccaggctggtcttgaactcctgatctcaggtgatctgcctcggttggcctgccaaagtgctgagattacaggtgtgagccaccgcacccggcaccactgtcattttagaacatgaatttaacttttgttccgatctagttcttaaaatgacctgcttctgcagctgccgctgtactcttccttccttgttttgaaggattgcaaacaacagaaggtaaagcttgttggcgtaagaatgctgtgagctttgtttctttctgcacgttttatctcatttttattttactctctgggtcctcacaccaccacccctaccccagaagaaaattcaggggacaactttggcaaagtcggtgactttttttaaaggggtgtggatctcgctatgtttgctaggctggactcacaagtcctgggttcaagcagtcctcctgcctcagcccccgagtacctgggaccacaggcatacgccatctcacctggcccagagactttatttcatgtgagaaaataacaatgttgagtccctgccacagaatattgcagttacatatgaatttgttgagtcttctaagtgatgggaaggctatattcaatctgttagagtaactgttttaagtaatgttacatgttttacttcctttattgcatttagatttttctgattattttattttcttaaacagggcaatgtattccaagatgcagtcttcaatcaaacagttacagttattgaaagagaggatgggttagatggagaaacgtaagtgaaagttgtagtatgtagatcttgattttgctcgtaaagtaagactggaaagcttgctctgtttcagcattgttttagatgttgacgatggaatgaactgtatagatttggtgaaatccttacgatattcattcatacttcagatgattcttataactataaaagtcaaattaggaaagatagttgaaactgatggaagaatctctttaaaagttagtattggctttctgtccttcctctcatctaaattttctacctcatgcttataaactgttcaccagcctaaactaagtctcgtgcctctgaaattactattgaaaacataagttagaagattttatcttgaaaaatgtaagtgttctttctgaatgatgaatctttttttactctaaacttatatataattcacttaaggtaatttttaaattggattgtgcaaaataatgtaatattccagggagatgaaagctaatgcaattattttataaaccaagcttttgaatagagcataaattgtaattctattttcaatcatagagttt

SEQ ID NO: 119490 - DNA, 1260 bp, Homo sapiens
tcttcattcttctatttacctgcacagataacactaagctggaggtgaaggtgacttcaccaacacacgtaaccctgctgcttgattatttcactgccaaaaatacgcaactcttttttaccacatgatttggatgtgatctggtctgaaattgagacgcttattgaatgcttatgtgggagtgctagcgtacagacaaaagggtttcagcctatacagcaacttgaaccaatttctcgttagtaggtgactggagtgctctattggaagggattctgacaccaaagtccacaggaaagggtgccagaatccattagtaatgcctttttaaatattttgtgctctttccatgtgttctaatttttttgtctctattttgtttctcagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtgatgcatactagagataaggggaataaggtgctattgtgtgggagtggaagtgaaaatggagatgtaagtaaagctatgagccggatcttaatgggaaaaggagcagtaagacacacaatggagtctacagcttattcagatgttaagatctgttgctgggtacagtggctcacacctgtaatctcagcactttgggaagctgaggtgggtggatcacctgaggtcgggagttcgagaccagcctggccaacctggtgaaaccctgtctctactaaaaatacaaaaattagctgggcatggtggcagtcgcctgtaatcccagctactcgggaggctgaggcaggagaatcacttgaacctgggaggcggaggttgcagtgagctgagatcgcacca

SEQ ID NO: 119491 - DNA, 1005 bp, Homo sapiens
gatctgcaacatccccaaagaattggtaggcacattactgttcaagaggcactgctccaaaagttctgttttaattaatgaggtatgatgaaattcttattgctaatcccagcaaagctgtagagaagcaatatttcttcctaacataaagtgaagtctttatttcttttttttgagtcggagtcttgcattggggcattctcagctcatacaacctctacctcccggattcaagcgattctcctgccttagccttccgagtagctgggattacaggcatgtgccaccacacctggctaatttttgtatttttagtagagaacggggtttcgccatgttggccaggctggtctcgagctcctgacttcaggtgatctgcctgcctcggccaagtgctgagattataagtgtgagccaccgtgcccggccaaatctttatttttaaataatgatttttttttctcccatagtaatctcctcttaattgttctttttcttaggtagaagataaagaggaagaagatgtgtctggtgaacctgaagcttcaccgagtgcagatacaactatactgtttgtaaaaggagaaggtaatacagaagtattagttttaattcagatgtaggcattttaaaacgatgagcttgttcatatatatctgaatacccatatctgtaaagtaatattgttggcatttaaagggaatacgtaggtgatatagacacaataaaaaataaaccaaggggaaaaaataaaataaatactacctagtttaactagaaattgactgtccttttcaaagattttgtttttgagacagggtctggctctgtcacccaggctggagagcagtggccccctctcgactcactgcaaccttcacctcccaggtttaatcgattttcctgcctcagcctcctgagaaagatgatgttttaaaacttctttaaactgccacagcaaagtaactttgtcttttttttttttttttttttttttttaagatg

SEQ ID NO: 119492 - DNA, 1532 bp, Homo sapiens
aatttaaaatcccaacttttagaggtttgttaatgtgatcaaagtgaattgaagttgggagaataggcaccagtcattgagaacagagcataagtattttctggaacagggaaggagacatgaaatagttaacaattcaggatcgtggtgacatgagtctagaagggtaacaacatagtagaaatagcactggacctcatggtttcatagatttggaatacctgctgcttccttttctgacttatctctgtgggtctcagtttctttttcgcttgcttgcttttactctgtttttattctttttgcttgcttgttgtatttctgaatccttatgtgccaggcactgttcttggtgctgggtgggcaaaccagatattttctctgctctttcagacttttttttggggcagttatatgtgttttaatggcagggggtgagaagcagacaacaaacagtatgtaaaatatatctggtgaagaataagggggttagagaagatctcttaaaagttgttcagctctgaaatgtttactatgtaatacaacagtaagaatattgggctggaattgggatcattgcagcatgcatctagttaattttatttcctctctggaacgactataatccatcctacacagctttttttctttctattttcgtgtcatacttgaacctggaacctctcatgattccagattttgtcatttccttcaaaattaaaccactagttccctattttcttatttcagtatcaaaatatttattcttatatatagatttctgcttcttttttgacttactttcatttttatggaatatgtcttccaactaagcaaatctgttgctattttattggtgtttttgagttatcatttttatgcttctgcacctactgttttatctggataggatgtccctagtaatttgtgaactctcctaatttccccctctttaggaactccttactgattatctgtgagtcaagcctttcatatgtatgtatacacatacctttagggtttatgttaagactccacgtcttcaacccagcctgcattaagtgaatagctttaactagattaatacatttctgctgcattgttgttaataaatatttgactagttgtggtaagataacttagagtgatggttggaagggaatccatctaggaatttaggattaaagatggtatttggggcactgaaatttgggcatgtactgaaatttattgatgaattatatcgttgttaccaattatatgaaattacttgtgctctctggcactagaatgtacttattgtggaggaagagggtagaagagagatgctgaacgccatgaggcacgcctgtaatcccagcactttgggaggccaggacaggaggatcacttgagtccaggagtttgagaccgcctggccaaaatagtgtgacaccatctctactaaaaaaattagctgagtctggtggcttgcgcctgtaatcctaactgttgaggcaggaggatcacttgagcccagaagttcagtgtta

SEQ ID NO: 119493 - DNA, 1105 bp, Homo sapiens
atttgcttaacaaagttgcttgaagttctttgtgcttcaaggcatctttagtttgtgccattcatttttccatctgttgggcactttttgaagttaaaccacatttcccattaaaaataacatggaaggcagggaacagtggttcacgcctctagtcctagctacccaggaagctgaggtggaaggatcacttgggcccaggagtttgaggctgcagtgagctatgactgcacaactgtactcccaacctaggcatcagagcaagaccctgactcttaaaaaaaaaaaaaaaaaattgatatgcagttgttaagactactagtaaactaaaatataaatattcttcggtgcattgtaattggcatcattcaggtgaactgggagattctgttagtccaagggaagttttttttgcctatacctgatgttaaaaaaagaaattagtatttcagagtaaagggtaactgctttttctgtattttatcattaggcttgttagcagtggcacaagatcttacagaggatgaagaaacagtagaagattccataattgaggatgaagatgatgaagccgaggtagaagaagatgaacccacagatttggttagtgttacatactatttaatatatgtaaaatgtatgtaattgtattcatctgttctcatgctgctaataaagacatacccaagactgggtaatttataaaggaaaaaggtttcattgacccacagttcagcatgactggggaggcctcaggaaacttaccatcatggcagaaattgaagcaaacatgtccttcttcacaaggtgacagcaaggagaagtgcagagcaaagggtggggaaagccccttataaaaaccatcagatcttgtgagaactcactttcacgagaacagcatggaggtaaccgtccccgtgattcatttacctcccaccaggttcctcccacgatgtgcagattatgggaactacacttcaagatgagatttggttggggacacagcaaaaccgttatcaatagtacatctagaatttatccttacttatttatttttagagacagagacttgctctgttccccaggctggagtgcagtggcacga

SEQ ID NO: 119494 - DNA, 1154 bp, Homo sapiens
gggaggcggaggttgcggtgaacagagatggtgccactgaactctggcctgggcgacagagcaagacttcgtctcaaaaataataatttaagaattgtcattacttaaccatgggagagggtgtgggcagacaggggacaaagattttccactgtgtattttcatggtttttcctttgaacaatgtcctctcttccaacaaaattttttgcttttaagtgccacataaaggcagctcatgttccttacatcgccgttatcaagaggatcgtcattcaaataaagtaaccactgacaatgctaattaattggaagtaaagaactgggcggaaagaacggctaaccgcaagctgccgggtcgcaactgcggcggaaggcggactctcgcgggagccacaaagaggcagcagccggccacgtgacttcccggtggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggtgaggctgggggagtgtgcggaggggatggccaggaaggagatgccagtgatggcaagtttgaagttggaggcggtggccgctccgggtcctggggtccgcgtccaccccgctggcctctctccgccctctccccaagcctaggctcgtagcagcaggggtccccgcgggcgctggagaccccgctgcggcctgccccttgcacgcggagcgcggggccgtgcccgggcgaccttgcttcgtggccggccgagggctgggcttgctcctcttgccctggaccctcgcctgcaggagcggccagaactggagggtcctcggctgcaggaggaggcgctggacacggctgcgctccgagcgcgccgcagccgggctgtttcttttggccacctccggctccgctccacccccagcccctcgcgctcagggctgacgtgtctttagct

SEQ ID NO: 119495 - DNA, 1611 bp, Homo sapiens
atcttgatgtaacttcttttattgcaaagtgttatcgagttcaaagtaagactgccttagacttattcccaaattttttgtcagaaagcttttttttttttttaattacaattttttttagagacagggttgcccaagctggagtacagtggcacgatcatgactcactgcagccgtgaactcctgggctcaagcaatcctatggcctcagcctcccgagtagctgggatcaaaggtgtgaaccgctgcaccagccttttttccccctttcttttttcttgttttacagaaagattttcctagagattttctaaagcagctctgcgaatgattttcctagagtcaagtctggtatactggtctgagttgtttattcagcagagaagataacaatataatttctaactttaacaaggcagaagcagatttaacttgatgtgcttcttgaatagtaggctttgggcatggagaatgagcaaacaactgcaacagaactggaaaacaggagaacatggttttaaggagatggagcttatcggaaggtgtattttatataaatatataatcttttagatttatcaatattttaatatcttacatcataaatatgtgagatcagttagggtatgtggaaatattgttatgaaataataaaacattgttatttctagtgaaaacagagacttgaagacagtcaaagagaaggatgacattctgtttgaagaccttcaagacaatgtgaatgagaatggtgaaggtgaaatagaagatgaggaggaggagggttatgacgatgatgatgatgactgggactgggatgaaggagttggaaaactcgccaagggttatgtctggaatggaggaagcaacccacaggtattttataaaggatcctgcacatctttatgtagtctgcttatgtctacttttttaaaaggctgttttgtgattctgaaattgaataactaaaagattttcttcatgttatattgtcctgtagcctcagcctttactgattttcacttttcatcctttctgtatttctgataatttcctgggtgtggattctttccagaatctgtaaatttaaaaagagttataaagattgtgagcttaaaatcttcatgggaaagggcatggattggcagtttactacaaatagttaagaaacatggtaaaaaagttcagcctcattggtaattaaagaaatgcagattaaatttgtagagatgccgttttttcacctgtgaaactgttaaagacaaaacatatcattgatggtcaagtaaataggtgcacttacttgtaggataagctggtatgtgataaaaactttaaaagcttcaaaatactttgacttagcgattctgtgagtgtgccaagacttagttacaagaatgatcctccaggattgtttatggtagaggaacattggaagcaaccttgaacgggattaaacctgctatgggactgattcgcacaatgaggcattatacagccataaaagatgttgtaatggaagactgtattaatgagataggaatatgtttgtgattatttaccatgtacaaaaaaaagttaccaaaccacgtacagctgctgctcatactg

SEQ ID NO: 119496 - DNA, 3542 bp, Homo sapiens
tttccctctcttgagacattgggcccaaaatgaaattctgaaccagcttaatgctggtcttagctctttattatatactttgggggtaaatgaacattctcaaattttaagtctataaaccagtcaaattagaaaactacacttaattttaatctgttacttataataagaggaatcatagagaagttaaaaaaacggattatgcagactcttttagtcagtaattttaaccttctgtttcaaatgctctttaaaaaattttttgagccaatttgattgactcttacctttccttaagatactcctctaagtattgatgctttaatagctaagtatgaactaaggaaatgtgatgatgaatcttaggtttgtttttacagctagtgccttagactctggaattcccttctaggcaaatcgacagacctccgacagcagttcagccaaaatgtctactccagcagacaaggtcttacggaaatttgagaataaaattaatttaggtgagtttacaaaatacatcactgggctaagaggacatttttcaaaaaccatggagtgttgtataattttattagatcaagaaatgaaggctggccgtggtggctcacgcctgtaatcccggcactttgggaggctgaagtgggtggatcacctgaggtcaggagtttgagaccagcctgaccaacatagtgaaaccctatctctactaaaaatacaaaattagctgggcgtggtggcacatgcctgtaatcccagctacttgggaggctgaggcaggagaatcccttgaacctgggaggtggaggttgtgatgagccgagattgtgccgttgcactccaacctggacaataagggcaaaattccatctcaaaaaaaaaaaaaaagaaaaaaggaatgaatgtattcaagtgttactaactcaataatgtttagagaaaataaaaatcgtaatttaaaaacataactttaggaaaagacttaagcttatgctattttggttgttttcccacttgccataggaatgtaatgttacaaaaacccatttaagtattgtctgttcggttttaggttttttttttttttgagacagggtctcactctgtcacccaggctagagtgcagtggcacgatcttggctcactccaaccctgatttctggggttcagacgatcctcccaccttagcctcccaagtagctaggaccacaggtgcacaccaccacacccggccaatttttattttctgtagagacggggtttctccatgttgaccaggctggttttgaactcctgagctcaagtgatctgtccgcctcagcctcccaaaatgttgggattacaggtgtgagccactgcgcctggcctgttttagattttgtaatagggttatctcatagtaggatgttgaaaatactagagtattgaatatagttacatacggtttcactagaggttttttgtgtaggtgttaattatttagtgacctgttcgatgccaggcatcagaatgttaatttgaatcatcatctcatagaaaatgtaagagggatggagggaaggaaggaaggccatctttctattcttgtggatcttcactctaaacctaacacagtgtttctcatataagctgtcaatacatgctaaattaatataagtattttagggccttctttgcctatcatagacttataacttgaagtgaaacaagtttttagaattaaacttgaaattcaggcagttttattagtcatgtggagtactagcaagtgtctgaaatttattatgcaaattattatctttgaagaatttctgcatctagaattctgtggctcaaatattatagctgtagtgatgaaagtgacacttacgaaggaaacgcagtttagtgcctacttttaaaaacattacattgttttcattactaaactgtattctatttacaataaaacatttagaaagtgtagaagagaaggaagaggggagaaataccctgttcagcaactctgttaatgtcttttcgtcttacatattgtttacattgtgggtttcttgtattttagataagctaaatgttactgattccgtcataaataaagtcaccgaaaagtctagacaaaaggaagcagatatgtaagtaatattttaataatatgcatgggtgataaggactaatctagattaagcagcaccttgatcataattcttttacagaggatgttcatttgtatacttaaaccaatcattattttggtgtgtgtgtgtgtgtgtgtgtgtgtgttttccttagcttaaattaggataacctatgcctttgtgaattaaaaatattaatgaatcttggctgggtgtggtggctcatgcctgtaatcccatcacttcagaaggccgagctgtggggatcacttgaggccaggagtttgagaccagcctggccaacatggtgaaaccatgtctgtacaaaaaatacaaaaattagccagacatggtggtgcacgcctgtaatcccagctactcaggaggctgaggtgtgagaatctcttgaacctgggaggtggaggttgcagtgagccaagatcgtgccactgcactccagcctgggccacagagcgagactccatctcaaaaataaatacataaaataaaaattaatgaattttaagaaatacatggtaaaagtgtaatctcatgaaatttacaaatgtgttcttatgaggggaacagtgtttgtagatttcagtttaaactaaaatgtgcaaaaatgttcccttaaaatttattaagaattattctttcccatgaagtatttttaaaaatttaagggaagactatgaactaatgatataactgagaactgtttctgtttacacttctgttctcaaagccaattgtttaagatctgaataacttctcttatatgctaataactctaaagtattatcactatattatagaaaacgacactaagatcatacaactaactgtgagaattgaacgtaaaagccagctttcttccaatttattgctatgtccaagaggtatcagctttttgagatacaccatagttatttgttatttcactggtatctgtttgaatctttgtgtttaaacctttattagtttaggttagtgtgctaggtggagtcactcagtgtataagcagaagcaaatcagagtctgcatttgaatactgtcttgaaacgattttaaaaaacaaaactgccaggtgcagtggctcacgcctgtaatcccagcactttgggaggcagaggcgggcggatcacaaggtcaggagatcgagaccatcttggctaacaaggtgaaatcctgtctctactaaaaatacaaaaaaattagccgggcttggcggcgggcgcctgtagtcccagctactcgggaggctgaggcaggagaatggcgtgaacccgggaggcagagcttgcagtgagccgagatcgtgccactgcactccagcctgggcgacagagcgagactccatctcaaaacaaacaaacaaaaacaaaaacaaaaaaacttgtatct

SEQ ID NO: 119497 - DNA, 1038 bp, Homo sapiens
tatgtggaggctggggcaggaggaatacttgagcccaggagtctatgcctagcctgggcaacatagtaagatgctgtctctttaaaaaaaaaaaagaagacaagactttaattgtgtgctaacagaatcattaaagatgtgaaggacagtacaaatatactcaatgttttctctttttcagcatagttcactttaccctggcggctctttgatgcttctgaaataggaatagatttttctttttactgtatacatactccttttgccaaaatacagaattgaattttggtattcaggggaaatgaagaaagtttcactgagtaatgaaaaatctacaatcatatcataaaatctgttatttagagaaactacctacttaggaattttcatgaaattatctacatttagaagattttggcttctcactgaattttgaatgtgtcaactatacgtttttgtttttggttaggtatcgcatcaaagataaggcagacagagcaactgtagaacaggtacaatttaaatgtgttgcaaactcttctttttaattagcatttcttctctctttgaattgtagtttgcttttatcctttttgcttaatgctaatgttacctaaaattactcctatataaaattattcctttttatagtttcgagtttagagacctacatcttgcttttataggactattggatgaattagagtcatggtccttcagtggccttgcagagccaccatgcgatgctttcccttcttggagagattatcagaccagcaatcttttagaaaaggtccgtaggaattttgtgagctttcccagaagataggtagggtatctgccacaaagcaggaagtgtgggtgtaaaagagagaggggcagataatgtcttcaaatttccagttaggaatcctttgtttagaaattatgcttgttttattctttctattcaagaatggggaaaaattggcccctaattttcccacattccgaagaatgtgattggatattagccttggcccagatttttgatgtgaa

SEQ ID NO: 119498 - DNA, 1180 bp, Homo sapiens
cattatgcgaagaacattatagagcatactcatacaaacctagatagtatagcctactgcactctcaggctatacggtagttccgaatctgtacaacaggtttctgtactgaatactgtaacaattgtaagacaatggtaaatatttatctatctaaacatagaaaaagtacagtaaaaatacctgttatagtcttacggaatcacctcatatatgcggtctgtcacctgtcagtaactaaaacgttatgtggcacgtgactgtatttgtatattggagctatgtttactgtccttttgatgtaatgttttacattttaattcacatattcaaaagacagtggtattccttatgcatgttatttcagttcacttgacttttgaggttagaatcaaatagattgaaaaagtggttatttaacataaacttcattttcttttttttttgacttaatataggctaatgtataccatgctagcacagcaaatggagagagcagagcaatcaaaatttataaaacttctattttggtgttcaaagatcgggataaatatgtaagtggagaattcaggtaagttcagatttttccctccagttggtttaatttctatttcctaaaacattaaaataataatggaatgattgaaataataaacatttttcttattcaagatttcgtcatggctattgtaaaggaaaccctaggaaaatggtgaaaacttgggcagaaaaagaaatgaggaacttaatcaggtgactgtctgggatgtgtgtatgtctgtcctatgccctgtacatgaacatcagcccttcctcccagcagatcccagtgtggttctgcccaaatgtagggacttgttagggcctttatttctattaggtctgctgaagtaagcagaagaaacacatgtctggacaaatagagattgtttcctattctgttgttttctattctgagaatccatttcaaaagaatactgccacaattcatatttattccacgaagctagatcatttggaaggccttgtaagccattgaaaatgtttagaatttatactgaggataataaggaactgctaaaggattttaatcaggaaagtgacacaatcagatggttataatgctctgtcatgttttcgtaggtattggagttttcgactaatcttgttaggtcgtgaa

SEQ ID NO: 119499 - DNA, 1051 bp, Homo sapiens
cgtctcaaaaaaaaaaaaaaacaactaccaggtggctggttggatttggccagtagatctggtagacagaaataatatcaatattataaacttcctgtgttacagtgagattaattttagatacctttttataatcataggagacattatttaacccacattgttcttaatagtgcaatatgcatatttcattgtctagttttatgttgatccttattttttttttttcattttggttataagattctataccagactgttacaggattgaagaaagatttgtcaggagttcagaaggtatgaagaacatgtgttactgtttgtttatgtgaaaacagttttaaaggatataaactctagtcatactgttttttattattatttaatattattagaactaaatgttattttatattgttaaaatgttataattgctttcaaagtctgtggacatcttcagaaatgccatttttgtgttctttctaaacacagcactgaaatttggaaattaatttatttttctttctgtctctgaattgttcagtgattgcaggtgaggtatttatctttttgtatcctggtcgtcatttgtggagctcttaatgatagccattgtgcttcttgatggttttacaaccagcttaggagaactttggaatgtagtctcctaccagggtattacttgttaaagaacaatctcatgagttcagcaagtcctgctgtgctggattcctgtgatgttcttttttcttaaaacaatcttgttttgttttacattttagaagggcagggattaagtaattctaacttaggcagtcataaaagcagtctttatttttttaaatcttcctaattgaagacttaaataaaggatcacagtttgctttcttaaaatcatgtcttttctgtggaaagaattgaattaggggaattctggtattttgcatttctgagttataataacaggtgtcataaggaagttatgctttggattccagagcatgaagattttattgcagcaagctagaaaatcttgttgtacaattgactt

SEQ ID NO: 119500 - DNA, 1055 bp, Homo sapiens
tggggatacagcagaaaacaaactagacaaaaattactacctttgagtagtttacattttgataggaagataagacattaaccaaagtaagtaaaaagcagtgtatcagcaggtgataaattctatggagagaaataatgcagagatgagagggcgcctatagatgaaagagtttgcagtttaaaatagggttcttggaaaggccttactgagggctgatatttgagcaaatacttgaagaaggtgaattgtttgcataacaagaaggaagaacatgccaggcagaacaaccagcagttgcaaagccctgaggcaggagtgtacgtgacatcttccagaaacagggctgagacatcatcatcaagggagaaagtagtagatgcaatcagatagtgtacggctgtgggagggttttggcaggggagtgatatgatctgacttctgttttaaaaggattactctggcctctgtggagaattgatcaggaagcaagggtgggagaccagtgggtatgttcattgaagtaaacccaagcaagagacgctgatggcttggtataggatggtggcagacatgagagaagtggttgcacattctaagggaagagatgagattgcgtggagtgaagggtgacttcagggtttctgacctgagcagcaactgagatgactggagttgccacttactgtgatgggaaagactggacgggagcaggtttggggagggtaggagggtgagataaaaccttacatcacaacatagtacagatactaaaagaaattaccaatttaatttttttaatgatatactttatgttggaagtgactcttgtagtcattgcatttagaaataatttctataaatcaacccctagttttcacttaaactgaagcttgcccctgcttatttgacagtgggttatagggggaaatcatttgagctctttatgtttattttgactataaagttcaaaatatgaaatataatttcaatgaaacacaaaaataatccctctaaaatagtctacagttagcacaacaaaagaaaaagcaaaa

SEQ ID NO: 119501 - DNA, 1067 bp, Homo sapiens
tggaaatctatagccttgaaaggagtgtaggcccttccaaggaagataagtacacgaagactagcacgcaaaagcggaatgcacaggaggggtgtacgtgacttcagagacttcacaaggaggtgagagaacatctgtcgtgggggcactgggaagactttataaaggaagtggtgtcgaactagactttggagtatttcagctgtgtcaggatgggtgggcagagagccttccagagggagagaagagcatgagaaaagtctgcgaagcctgtggagtgatctccttttagagcattctctctgagcagggaggcagtaagatgaaaggaagaagcatccttttttgaccaaggcattggagaccttgaatgccccggagagggatttggataggcagagggaagctggtgcaggttttcactgaagccattgaaagtctcctccattggaggagcagggaagtgagacgatcataactgagcttctggactgtttaggcgttggcttaaggaagccattgcaccagtgaaggagggagggaatgaaagtctgaaccagggtgagggcagtggatggaaaagtaggtattgccaaggtggagtgacagcttcagctaagaattggatgcgagagacaagggagagtctgagaaaacaggcccagagctcgagtgactcatagcgtagatagtctaaacacttttctgggaaattattgcaaagcaagatttagtttagcttaatatacggcaggtaacatttacatggttattaaatttaacttgtatattttataaaaatatcaggtctgtggttaataatagttaccattacccagcaaatacctgtgatgtgccttgtataggatgtttgttatctcaagcctcataacaaacttcccagtttacagatgggaagctgaggttaaaatatttaaatggcttgcctaaggtcacacagctagttaagttgttaagctagatttgaatccagtataccacaatgacgcaagagaagattaaacctgcagtgtgagaattcaccttttctacttgtaaaccctttt

SEQ ID NO: 119502 - DNA, 1776 bp, Homo sapiens
tagtgcagtccaataatttatggctcaccaccgacaccttgggctggaagggctcatgaatgtgaaatctacatttcatgaaaatgaagacagtttagtgagaagctgcagcaaacagatcaaaggttctgcttggaattacattttgtttgtttgtttgtttgttttgagatggggtgttgctctgtggctcaggctggagtgcagtggcatgatcatagctcactgcagtcttgaccactcaggcttaagtgactctcccacctcagcctctcgagtagcttgggaccacaggcgtgcgccaccatacacaactaattaaaattttttttttttttttgtagagacaaggtctcgctatcttgcccaggctggtcttgaactcctgggctcaagtgatcctcccaccttggccttccaaagtgctagaattacaggcaagagccagtgcacctggcctttgaattttcttaccctcaataagtttctttcatgctgctaaagtgtatcactctctgtgaattgtctcagttatttttgagtcttgtagggaacctgaggaactcctgaaatgcctcacacttaatacccaatccatttcttccttttcctctttctcttttttttcttatcaccccgcctccattttgctgcaggacatccttaaagttatggactggggcaaagacaaaacacaaaaacgaaatttctgccgggcgcggtggctcacgcctgtaatccagcactttgggaggccgaggtgggcggatcacaaggtcaggagttccagcccagcctagccaatatggtgaaaccccgtctctactaaaaatacaaaaattagctgggcgtggtggcgggctcctgtagtcgcaactgctcaggaggctgaggcagaagaatcgcttgaacccgggaggcagaggttgcagcgagctgagatcatgccactgcactccagcctgggcaacagagcgagactccgtgaaaaaaaaaaagaaagaaagaaatttcagaaccataacaacagcagcagcctccgcaagtaagagctatcactaagtgaggtctccgcctctgcagtgcccctctgagcctcacctcagccccaggaggggggtgttctacctgtcacagaggcagaagctccaggcactgccagtggatgtcactttaagttgctcaaggtcacaggctgtataactggaagtggctgagctgggcgtggactccaactgtgccctacttcaaagtccttctgaagttaatgatatgtgatcagttttccactatcccacaaacacaatctgccaaacacacagtgtgaaaatcgagaaaaccgcctggaaaagaagcagaacttttattagagtactgtttctgtagctgctgggcgaagacaaaatgcaggatcaaaggaggctgtctttctaaaatctatagagacaaaaaatccaccatgtttgctcactgctggagtgggaatggggaggggagagctgtgctctctggttgagcttttgaaatcagggtaatgagatgagccataataccctcagatgggtcttttgtttgcctttgtttttcttccactttactaagccaaacaaacattcattaagtaccttctgtgtgccgaaccttatttatgttgttaggttaagtgtttgtaggagtccaagatgactaagacatgggactttgctctccaggagcaggtagccaggtgtgtttaaactaatgcaagagaggagaggatgcagaggtgtgatatgg

SEQ ID NO: 119503 - DNA, 1052 bp, Homo sapiens
gagatgtgtgtcttcttaacctatttgtaatgttggtttaacaatgagaaccagctttcagacagttccccgtccccctcccaacaaatgtttacactacagattgccacctttttggaaataaagcaatttatgatttacgtgactttttgatactttcccttctgagaaatgcaacctggcatgtttctgttcctgggttgggatggatcttcatgtgcaccatcaatttagtatgattttttttttcagagaaaatgactatattgagataacaattctatctgagaaacagaaaaatggggaaaaataggcaatggaaaattgaggagaaatggtaacatttctgagaaccttgcgatgtttcttaagataactgagacatcctaggatctcatcgaatccagattagaaatcatggagttcgtggtatttgctgtgtgaagtcttcattttaaaacactagcattcacctttgctccgagtttgctaaaaacagaatagagaatggtggggccgtagccatcttttctatccctttcctgagtcactgaatcttttcagcgaagtctccctaatgccgacactggtatcaaggttacatctggcatctgcctcttcacaaagtaccccttctaaatagcctacatttgaaacagattttaaccagatgaatttacgggctctgtttagataacattttaatattctaatttcttaatttagatattgtgtgggttctagttctgaatttcttcatccagttaaaaaaagaatgtcacgttagtccatgttcagagatatttggggctcagcaaactagcttggctccagttctagttgtttcgagtgtctgatttgaaacatactccttgaaatgttcctcgcagtggcccgattcctttacacaaaacaaaatagcagacaccagtgacttaatagtgaacatacacacacacacgtcatttgtagtgactatggatacgttttacatgtagctctgaaaattttgcatggcctcatgttctcagtttatttttgcttatatgcat

SEQ ID NO: 119504 - DNA, 1154 bp, Homo sapiens
caccacagtcaatgtctttgatctatgaaatcagcagctatggaacaaaagcagcagctctgttctgaatcatatggtagttgtcaataacaaggacagtagttatttttagaacttttaaaaattcgcaaggcttaatacttttcttctagtatgtcaaagttgtctgtgatcactctcatctttaaatttctgataaaagaaatgagaaatgatgcttttatgttgcatataaagtgaatgtctctcactatgggtgacacagtgagaccaaataaataaataaaatgtagctcacttcatgtataccttttaggctcacatgtattatttaaagcatcggtattgttgggttgtatgatgatcagcttcatttgaggggaaaaacgtaaaagctttaataattcgcatgtgttcatctctgtttccatcattgagaaaaaaaataaaaacacatacttatgaataaagccaaaccctggggttgcttgccttacagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagtaagtcatccaagttcccaaagccacgcatgcacgcatgaatgtgagggcagaggaagagggcaggtgtttatacctgaagcttagacacacgatgccttgccataataaacaccttctaaaaaaaggaaccttgtgaaggtcaccttcactttgtcttgcaattttatgttgaatagacagtcgttattgaagaataaaagggaatatctggccgggtgtggtggcttatgcctgtaatcccagcacttggggagaccgaggtgggcggatcacctgaggttaggagtttgagaccagcctgaccaacatggagaaactctgtctctactaaaaatataaaattagccaggtgtggtggtacatgcctgtaatcccagctactcgggaggttgaggcaggagaattgcttgaacctgggagggggaggttgcagtgagctgagatcgtgccactgcactccagcctgggcaacgagagcaaaactccatctcaaaaaa

SEQ ID NO: 119505 - DNA, 1022 bp, Homo sapiens
cagttgttatacatgtagctacaaatataaaatgcctttaatatcaatattcactcattgtaggaagaacattcgtttaacaggttgtccatggcagattcctttaaaccatttagtatcgaaatcttcaaccacacactgaatagggagagtagtgtagtaagctgctgtgtgctcatgaccaagctttgggtcattggcatctaatgcacctgccatcctgccttagacctctgtcaattacaaagttgccgaaaaacaagacaacaacaaaaagttgtagtatatatgtcagccaataatgtagataattcagaatgtacttttggggagtaaatgaatccaaatccatgaactgttttcaaagttatacctctacctgttactttatcagtgactgttgtaggtttttgtgcagtggtgtgagcgtgtccaggtttcccatttgggatgaagtgtgaaagcctggctctagcatgttttccctttgtgcctcttaggattgagcagtactacgaagccatcttggctctgtggaaccagctctacatcaacatgaagagcctggtgtcctggcactactgcatgattgacatagagaagatcagggccatgacaatcgccaaggtatgtcctcagggccacttaggctgcctggagggagggcagcgctgccccccgcagtgcctgtgtccaacagttcaaccttcttgctgtgtagcagtgcttttgtgtctcgtcaagcaagtcagctcagccctccttagaggttctggtctgtccaatagagaacaggagggattagcatatggctgattatgagagaaagaagcaatactaattcaggtggcctgacaagcaagccagaagtgcctgtggaaaagtcatgcactcctgtaagattctggaccctatgctcctttgatgtaatggaaagttaggtcataaaggattaactgggtatcacaaaagtaaaaggtgggatagaattcttggaagagcacccaaagcattacttactc

SEQ ID NO: 119506 - DNA, 1059 bp, Homo sapiens
gaatgtgggggacattatgctaagtgaaatacaccagacacaaatactgcttgatttcacttatgtgtaaattctaagaaaaaagttgaatgcagggaaacagagagtaggatggtgattaccggggtggggagggaggaggaaatgggaagatgtaaaggatacaaacttgcatttgtgtgggatgaataaatctagagatctaaattcagcgcaagactacaggtagtaatcttgtagtgtatattgaaattttgctgagagtagattttaggtgctcttaccacacatacaaaaaaagataaccatggaagttgactgatgtgttaatttacttacctgatgtaatcatttcactgtgtctatgtgtattaaaacagcatattgtacaccttaaatatatacagtaataaaaagaatcagctaaatcaaaagagctttccttcatttttgacagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaataggtaaactcagctaacactaatctcatattttccttttctcaagcttctttttctgggtcttcatttgctttagatgcttgccttacagtttctctgttactagagatttacttacatccttctgtggtttggagagcatgttaattccgctagcctcgcatgttaattccactattctgaactataatgttatcttagaactaagttatgctctaagggccagaacttgagaattcttcagcgaatacaaaatgttggtctgaatcacaatagaccaaaaaacagacaaaataaatttttatctgctttgacgttgttccctttcattactagctgtgagaggcaaatcttcacagactaattatgtcactggcaattttatgtgcttcttttgctctttccagcttatgcacagtaagggcactgctccaggct

SEQ ID NO: 119507 - DNA, 1868 bp, Homo sapiens
tagctgttttgagattaattgggtgtaattcatgttttcctctggtttttgtatcagtgcctaggtttgaaatgatgaatatttaatattactaacccattttgtgaaggcttaaagaatgcccagaggaaaagcaactgagatgtttacaaggaaatgcaaattatgaacatagaaataacgtgatattgttctcttcatgttatcataaattatctttataaattgaggggataggcccagaaaacaggctgactagaaagtaacctcttacagatagtaagttaaagggcttgcttctcttctctgaatggaaaaaatgctcatctcctaagctgtaactataaaaatatgagacaagtacatgtagtaataaactgaaaaaagggtacaaataacagtggtaaaagagtgaaatcacatttatttaaaaatatttgtatgcattaacattggtaaatatttcactttttgtatagaacttgcacagtgaaatatctggcaaacgagacaaatcagaggaagtacaaaaaattgctgaactttgcgccaattcaattaaggtatgttggtttcataaagaatgttggtatttcaccaagattattattaactgcatgacttgctgatttgttgtaaagcgtatacacttcctgaggatagcaattacggtctgtatatattcttttctgaacaaaccataaaaattaaaaatctattagcttgaattcattccacattggcagtatccatttgaatggctggtttctattctttgactggtggtaggtgctgcattctccatttagcatacaaagatgtactgcttggtttaataatggtgtttgtttgtttgtttgtttgtttggagagagtttcgctcttgctgcccaggctggagtgcagtggtgtgatctcggctcaccgcaacctctgcctcctgggttcaagtgattctcccgcctcagcttcctgagtagctgggattacaggcatgcaccaccatgcccggctaattttatatttttagtagagacagggtttctccgtgttggtcaggctggttttgaactcccgatctcaggggatctgcccggctcggcctcccaaagtgccaggattatgggtgtgagccaccacgctaatgtagtattagttgcttggccactagtggcgcaaagtctttggagtgggcaattagacgtgcagcccaatgatttaaaactgtggaactgtagctgttagtgatgctttttaagtctatgaaggacacttttcttaaacttcattatgctgcaggattatgagctccagctggcctcatacacctcaggactggaaactctgctgaacatacctatcaagaggaccatgattcagtccccttctggggtgattctgcaagaggtatatatgtcatcacatatctcttaaaacctgcccctccttctgcttcttcccttttccctgtctcctgcctcttcccttttccctgtctcctgcctgtcttccttaccattgctgatttcatcccattacagggtaccactttaagaggtttaatagcaggttatgtgccctccagtgtgagtcattgatgtatgatacattttcagaaatgatcaggaatgtgttatttagagtctttgtagaaattgggcttaaatttctgggtttgatgagagagacttctaaaaagtggaaaatacagaaatttctaaaagacagcctcttctcaaagatgtcagagactatcgtacctgtcagatggtttaggggaaacagcctggagagatgagaatgggatacatttttggccctttgttttgctgtactttcttttgctgattttggaatgaacacactaa

SEQ ID NO: 119508 - DNA, 1757 bp, Homo sapiens
ggtatatttgaattttttatattcagtgattgttccctttattcctcatttatgatacttaaattgagattatatgtaaacttattttaatgtaaacttgaaataaagggaatataatttatgaaatcataagcttttgattttgaaagaaattacctcattttacagatgaggtagctcagactcaaagataatatatcatttgctaagagcatatgagcagctggtgcaagaattatgatgagaatccagatttcttgaatatttgcctagtcactctttgcatgtatgtccatgtgtgtaaagagaaataagaatgcacattggtctgggaggggaaaagtactgcttctttcttggaatgtgaggtgtttttcttttgacataatctctgatttcattccacagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccagga

SEQ ID NO: 119509 - DNA, 1060 bp, Homo sapiens
gggtagcctgtgtttggccctgcttttaagaacactaatacatgtataacttcctccgaatgttccattctacttcttagaagttagctcttatttagtgagctatgacatacatttgtaatgaaaattttcttaaatagaagccatactaaagtgtttccctatgcaatttttaaaacactttttcttttgcctgcttagatgatttttttgcatggattatttagtgttcgcttttgatcatggccctagtgtgtttccttttgtttgactttccttctcctaacccttaatttaaaaataacttatttaacttctacagacaatatttgtgtgtggctgggttggtgtgtgtgtgtgtgtgtgtgtgtgtgtatatctatatattatatatataattatataattacataatatatatttatctataatatatattttatataatatatatcttcatatatttgtattgcttcattaagtatgttcatctagctgtaacaggtgagatgtaggtgtagcaggtatgataacctgaaacaaaactccccacattttttcaaagcataattattgttaagagtaagacaggtctgcaacttacagttccttctatagaaaaaaatagtaagtatgaagccatttattgaagtggcaacatatacagaatttttcccacaaatttgtaaaataacaagctcacagtgtatccagggacaatatagaaagaaaaaataagcaaggcttttttttttaaagatagatacacaaaagaaagttaagtcgtgatagtaatatgatatgattcaaaacattattttttcccatttctttcttcttcaattccaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacc

SEQ ID NO: 119510 - DNA, 1027 bp, Homo sapiens
gaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtat

SEQ ID NO: 119511 - DNA, 1039 bp, Homo sapiens
aatcctagcactttgagaggccaaggcgggaggatcccttgagcccaggagttccagactagcctgggcaacatggtgaaacctcttctctaccaaaagtacaaaaattagccgggtgtggtggtgtgagcctgtggccccagctatttgggaggctggggtggaaggatagcttgagcccaggaggtcgaggctgcagtgagccgagatcgctccactgcattccagcctgggcgacagagcaagaccctgtctcaaaaaacaaacaaacaaaatccaggaaggtgtgttgagtgaggagggaatggcagatttggtatttatttagaaaataagtgaacgtgtctcagagcgctgcagagggattggcggtttgcattgtcatctgtcatacggattccgcagttgcaccagattcggtgtcaggagagctgggagtttgccagttcgcctttctgtgccttaaaattggacacttctgactgggacagcaccaattctaggattattaaaggttgtcaccaagaggtggtaactggcaactcctgtggacattagaattgcttttttaaaaatgtaggcaagtgtatttagagtgaacattcgtgatttttgtttttttgtggggtattttcggtggaatgagaggaagggaagtgctccaatgtggggtaattcattatctttactattacttctgggtttaccatgctgtgataatttctcctgggtttaagttacatgactgattcctcagaggcatttaaaatatatttgatttctgtatataccattcattgtttattgtattaaaagcacagaggaaattaaaaaatctttaatattcatttagaggggtatttgaagctgggaattccactgagtggggcttaccagacccttccatacattgtttactcagcattgcggtaacattggattccttgtattaacgtttaaatagcactttgtttgccacttacattacttcatttaatactcaaaataaccctatgaggtaggtatctttggccacatt

SEQ ID NO: 119512 - DNA, 1853 bp, Homo sapiens
atcatgaaagatgtgactttcagcgaggtaattaacctgtttgttgcctaaatttctttataaaatggagatggttataatagcactttgcgaagattaagtgatatatatatataatattcttagaatagtgtcaggcacttagctggagtcagctagagggtcacagagttgtgaccattacagcacaggcttcaagaatgttagctattattggtcagtaaaatttgtcgctgctactgctgcgtgcctaattataggcatgaactgcttgaagtctgattacttactgggctgtagataaatctgaaaggattctgtgttcagatttcatagacagggatgtggatgtttcttaagattctggaaggtttgtccacgtgcccaaagggcttggatcagaaaccagttaataatttaattgtggtcactgatgattcatattgtatttatggatttttttttttttgacagataaggactcacaattccagataattaaacaagctagaactgcagttgggaaagacagtgattgttataatcaaagtaagtggcattacagtttaagtgaattaaagaatgaaattattatttttctcataagcatgttactaattttcttcaagaaaaacctgtgaaaactgttacatgggaaaggtaaagttttacatttaacattgggctaatttgcttcgtttcaacttcatttgttagatatttcctgttgagatacaccagagtctcactaagacactatcttagctaggggttcatcctttggaattacctggcgatttataggtgagattgtcttgtggctaattaaaaaaattattatttagtaaatacagatggtcccaacttaatgatgatttaatttaggattttttcaattttatggtgttgtgaaaacaatacacaatcacaaggttttagactttaagtactagtgattcttttatcagacgctgggctgcattttcaacttaacggtattttcagtttatgatgggtttatcgggatgtaaccccatgtaagtcaaggaacatctataaatgccactgagtgaggctcttttactcttgagatttcctctctttagagtgttgaaatgcagtgtaaagaaaaggcttaggctaaaagagattagtctccacagctaccctcagattgcttgctacccagtaagtgagttggtttgaggtgatgaatgcttgggatccccttctcagaaaaaaagtacaaacacaaaagttttacatataatttcagaggattcatattaatagatcctttcatgcccagctttagagctgggttaaagagtttctccctgggaacctcagcagagagtaggttagaagttttaagcataagcttttaggaaattgaaagaaaacttcatccatcaaaaacatagacataggccagacacggtggctcatgcctgtcatcccagcactttgggaggccgaggcaggtggatcatctgaggtcagaagttcaagaccaccctggccaacatggcgaaaccctgtctttactaaaaaatgcaaaaattagccgggcatggtggcaagcacctgtaatcccagctactcaggagaccgaggcaggaagaattgcttgaacccaggaggcggaggtttcattgagccaagattgcaccattgcactccagcctgggcaacagagcgagactccatctcaaaaaaaaaaacacacatagacaaacgagttaataaaagtttaaatttctaatgaatgtagatatgacatctagccaaaacctgaacagcttctcttgtaaggatttctgcattgtcttctttgaaccttctgtaggtag

SEQ ID NO: 119513 - DNA, 1012 bp, Homo sapiens
gacagttgactctcattttatttattcggagagattactgagctatgactagtcaagccttttttggcctctgctattggttctgctcatatcccctggtagtgtacccataaaaaagttgaggtttttggtttttgaaagggttaataatacttaaaggactttatttgagtcttaagtggttagatttactgaattttagagttgaaagagaacttggagatcatctaatccagtgtctgcattttacagataagaaaaaccctgtctgatagagacatgataaagttctagtgtgtttgttctaaaggttctccgtatttttattttttaaaaggttatttttttaaagctcttttatgaattacatttctctttcacaacaaacttgtgataagttgaacgatattttcccctccataataggtgaagaaacaggcacacaaaagtgaagtaactcacctctgctagataatatcaaagtggatccagaactaagttctgaattttgacacaaactctgaactgagttgtttgattttctgttagaaaccctacatttagtaaaatttgtggaccaggattctagatattgctcaaatttatttatgatgtctttcatgattaagtggaagaatatcacaaacttcatatctctgcatactaatcgtgactatcagtgctgttcattgtttattctgctttgtgtaaacctgttttaaagaaataaaagtagctgcttggccatatattaatgatgataactgagtttttgtttccttatctgtaatacaaaactctcatagagttgttgagaggaacagagataatggatgctaaacaagccttagctccaaaaattggtagcttctatggtctaagtgaaaattaatatacagaaagtaatattaagataatgaaatggatgagttttatatatatgagtaatttagaaaatgttctgctttttaatttttataatagtaataagggagatttggacattgagctt

SEQ ID NO: 119514 - DNA, 3228 bp, Homo sapiens
ttatatgtatgttttcatttcatctgtcatgtcaggcctaaactcagtgtacagaattctcaatcttaaactttatgaaagctcatacagctattcaatctatatacttattttcagatatagttacttcggttaattttttaaccaagatatttcaatcataaacaatcattttatgtttagtggtttatctttttctttcaatattaaatattcaggttgtatacttcagtattgtgaagtgtgtttgagtcatggccatgatatgaagatcagtgtactatcaaagaaacttaaaaagacagcataggatgggctttagatccagtctgttcctatcacttgtgagactttgggcaagtcatgttacttctatgacacttaatttctttatctgtaacgttaaggaattgactctgaatgaattctccctaaaattctgaatttgtatctttgtgacaacacctactagtactatttaatgttgaatgttatatgtttaagatcccctttgatgacaaaagtaacaagaatgagaattggcattattaaaacaatagattagagtttcaatttggggtgacgaaaaagttctagagatggatagaggttgcacaacgtgaatgcacttcatgtctctgaacagtacactgaaaaaatggttagaatgttaaattttatgttatatatattttgccacaaaaaacctgcaaaaacaggcagccaaagggtcttagagttattataattacagcacattcatatgtacctttaaatcatttaaaaacatgcattttgaaaatttacattttatgtaaatgtaagtttatttaagtatgtttatcctttttgttgtcagaaatatctatgttccgaatgaattgaatgcagtttgttgcttaacctttcctgtactttttctttttcagtaattggggtgagtataaagaggaattaggaacctgaatgtactccttatttaaagatatgcagtatcctttttgcaaatgatatccttttaaaagtaaaatttctaaactttatcttaatacctgtcacatattatagtcttgaattggaattttggttgaattacaaggaatttaagtatcagtcttcatcataaagaaatttaagatgaataaattgaagaaaaggctaaaataatttaagaaggaaattatatttctttgtttaaaaataacaggcaaaggtttatatgaagcttgtttgtaatacatcattattttctaatctgtgttttcctcccaaatttttatagcctaattcaaaggaattaggcttatcaaagctgtttttataattttgtattatgaaatgcctactataattagaataaaattgattgacttgaaagggaacccttttttccccattaattcaaaaccctttgacgagtaaaaatggccatatattgttatgtatagccgtgttaaaccatggcctcagattcactgcagctctcctcttaatatgtagacaagtagtacctcttttttgttgtaatgcttagttcatagtatgctcttatttgaattctttttgcctctacctaggaacttaatgaggttagactttatcaaatataagtatctggaaagagctactgattttatgttgttctatgaaccagttactactttagaataagttagcaaacaataaaaggattcctttagtagctcatgttctttgtttgcattagtgagtaatgaagtctagaaagaattgttttaaattgctttttttacagttccaatcatttttttatttgagaaaatttgaatctcaaaacaaaaattttcttcaatgtttaatacatcatatcaaggtattgtatttactttttttcactaatgagcagattttagaaaattctgtaactaccggggggcactgctattaacttttttcaattaatttggttaagccactatgcttcctcctcaggaaattaaaatgagtttaatttaatctgtgctttcctggcgtgaggaggtgtgggatttctgctacttaattattttgtggcccctagctctaagtccttgcacaagtgggatatattttgaatattgaccatctagcttgatgtctcatacaaaaagatattttttacacagtttttaatatttccatagtttattttcaaagggactgtaatgcatattacttattaaaagcattttttcccccaactttgatggggaaaagcatatcaacagatacctacttttgtagatggctataaaaattgttacccaaaaggctttcttagagcaaattgtctcttatgattattcctgcctgcctccatgggatctgtctttatattgttggagagaatagcaaacatccataatacattttttttttttttgtggatataacattcaggatagaattgtttgtcatttattgcttagattgatattttgtatacttagggattatgaaaaaagtttgtgttaatattgcattattaaagcacatgtttaaagataattattagattttaagttcacaatgcttcatgtattgtttattcttgtgattttatttttactttaggaatttattcttcattgcctgttgaagttcctttgaatcacaaacggtttgtttgtgatctaactcaagctgatcgtcttgccctctatgatttcgtagttgaggagacaaagaaaaagcgctctgattctcaaattattgaaaatgacagcgatctctttgtagacttggctgccaaaatcaatcaaggtttgagatgcacatcatggctttacatttcttcattatcattttattctatgagtgttattaagatgatttaattcttgggccactttgagttagagtaaaatggttttgtatcatttaatattgacatgaagttggccctctgtgtctgtgggttccatatccatcaatttgaccaacggtggattgaaaatatttggaaaaaataaaagtgtgtggttgcctctgtactatacatgtagagactttttattcttgtcataattccataaacaatatattaacaactattcatgcagcatttacatcgtatcaggtttttggtgttttttttgttttgtttttttgagactgagtcttactctgtcacccgggctggaatgcagtagcgcgatctcagttcgttgcaatctctgcctcccaagctgaagcaattctcgtgcctca

SEQ ID NO: 119515 - DNA, 2528 bp, Homo sapiens
ttaagggccaccatttccatgaggtgctagttgactaatctatcactagtttattgtactaatactctgtaccacacagcttagctctaaattttatgctgttctttttacagttaaaatctgtgttttagacttaacttagcaagtagagacctgggtccctgtcatactaccttggtgattctcatagtccctaagatacttggctcatcagttatttcttctctcgtctcataacccttgtaatcaagcttaaatgttgctgctagcattctttacggttttatagttgatattttattgtggaaatattcaaacatatactaaagtggatagcatcgtctaaggaatgtacccatcacccagcttcaaaaattgaaataaaagattggcaagggcttcatagagaaaagcatttgagggaaagggagaagcaaggaggaataaaggaatgtctgctattgactcttgcctatgtggtggagcctgagctaggtggattctgtgcaaatagcaggcttcaaggcgcttacatagagctgctgacagggaggcttgtaggcctgccagggaagtgcgagagctggaacttgagataggtgtgtgtgactcatgtcactccgctaggttggaccttggcatatcttaggttttccatgggagaatatagtggaggaggagaagtggtggataaggattttccgggtggaagaactagcattctgaaaagcagatagaagtataggagtttttcagagactcattagtaacccagggtggctagagcttagggcttctctgttgagagatgaggctaagttctatcttatgtaggaaaatcctggagggctctgaaggcttcattaaggagtttggatattgttcgattttactttgagagccattgaaagtttctttaaggtggggagaaatgcagtcaggcctgaatgaatagtgtttctgagattgccccgtgtcccctataccttttttctgaaaacattttctatttaatcatgagggaagtgtaaactcctattttagttttgtctttgcctctgcagtgactaaccctgtgcttggtggcatgggtaaataggaaaggaaaaactttcaagtggtttttacctatttgaaagtttctttatagagtcattcagaaagtatctgtgaagtgactgtatgtttcatattttgtcttattaagtcatatgattaagtcaagatgacttaattataaggttttaaaaaaatcatttgtaaataagctctaatagagagataaattgcaaaactaaaaatagtaccaagaactcccatattgtctttacccagatcacccattgttagcattttgccacatagcttctcattggcactctctctctctctctctgcacatttttcactctctcgatctcgatctgtacatatttttttcccctgaattctttaagggttaaattacatacctcataaccctttatccccagtatgtatttcctaagaacagagatattttctcacataaaggtagtacagttatagcaacttcaaatttaatattgctgtaaaacttttatctactattcatattccagtttgaccattgccttttctgtgttctctaaactgcacaagtcccacagtcaattatgtcatagcacttagtaaatatttgattgttagcactgatttttctagcgttacagtcttaattttttgagcagttttcttacctgaagttcggtgcttacctctcccaaggtgattcgagatgtgataaatgtgcacatggaagaactcagcaatcattggcaagaagagcaagagaaggcagaggatgatgccgaaaagtacgtcattatctttattggtgaaaatactctctctttgataacagataacaattaacttataattgttaaattttagcatttccaaaacccttgatagcacacagtaaactcgtgaaaatgctttttgtttttcgttgtcagtgcccagggttattgtaccagagttgttctgacattaccctttgacagttttcaggggatagccatattagtgaaatattcaaatagcaaaacatactaacatttatgcctagtattccattatgggaacaccaagcatgtgggagttatttatgtcctactgctcaaggtcatcgccaaggtctcattgcaaaaattaaaaaaattgcaacctcaggcataaatgggttaagagctgtgtttatttgtccttttatatgggttataagattgtgcatatttagaccatatctaccattggtttgatatagaatattacactttagactggtgtgtctgtgtacgtatactggagaccagtggtaacacaaactgattaacattcttttctgtgttttaggaatgaagaaaggcgatcagcttcagtagattcacggcagtctggtggaagctatttggatgctgagtgttcacgacatagaagggataggagtagaagcccacataaaagaaaaagaaacaaagata

SEQ ID NO: 119516 - DNA, 1037 bp, Homo sapiens
gtgaaaccctgactctactaaaaatacaaaaaatagccaggtgtggtggttcgcgcctgaaatccagctgcttgggaggctgaggcaggaatcgcttgaatccgggaggcgaaggttgcagtgagccaagatcgtgccatttgcgctccagcctgggcaacaagagtgaaactccatctcaaaaaaacagaaacaaacaaataaaaaaactaagagacgaaactgaaataggaataatcaaagtgatttttttttaattacgctttgaaattctgctttaaaattaactttgagtatatgtaaatgataaccagaaaattcttttcaaatagaatgttaaagtagcatattactgttgaaagtggtgtattactgttgaattattttaaagctctgatattaaaatgtccatcatttataaccatttttttatacctcttttatttcagggatggggaaagacaccatagtcataaaagaagaaagcaaaaaatataaatgaagtacttgtacctatattaattatgcttacgccatgataaccaatatacagatatattaattggaattcctttgcataggagaatgtttttatgatctgtttagtgcttattattttttttatgatctgtttagtgcttattattttccagtaaatatgcttcaaaccatgagtacactattaggccctacaactttgttttccttatattttattagatgatttgcttcctataactgatgttgttttgttcgttttgctaatatatgtatctcaaaattctttaagtcaatatttatcatatgtaaattaaacatgaatacattctcatcttataactacatcttataaataaggctaataacccttagaacaccacctgcggttctgtcctcaccccagtggtgactactgtttaccactacactggtgaattgtagtagggaaaaacaatctaaatattgaagaggaatggcctaattaaaatatgatgtagtcataggatagattattgtattggagttaaaagaaataa

SEQ ID NO: 119517 - DNA, 1045 bp, Homo sapiens
gcccagatcagttaggtcagaatcttttgagggtggggcacaggcatcattttttttaagtaccttaggtttttctaatatgctaccgtggtcaggaaacactggcacaggagatcccaatgtctgaaggaaatggatacattgtcccagtaagagatgaagagcaaagctttcaaacattgctacacattagaatcacgtgggtgttacgtgggaggtaggggggaacgccttaaaaaaacccagatgcccaggtggcactccatatcaaatcagaatgtgtggaggtggaaaccaggtagcagtatttttttgttcaaaaataaagaggatctcccaacgttgcccaggctggactcaaaactcctggcctcaagcaatccccctgcctcagcctcctgagttgctgggaagatagaagtgtgccaccatgcccagcagtgtcattgttttgtcaagatctcaggtgatgtcagtgtttggaaaccactgccttagatggtatttgaaatttcaagagctgggcctaaggcgaatttgtaaagtatagtcatatttactgtatttagtgaccctccaaattccccttattccttgcttctctgacttttcgtgggctacagggacacactgcctctgagtcacactgcttaaagctggctgtcagctaatccttgctagggtgatggtttaacatagtatctccctagggatattgacatttttcgtaaaggattttgaaagatctaaaaaaatcccctaaaaatttttaagagaactcacccagtagtgcaattccaggccccaagacaggctgacacagaactgaaagagaattctaggatgggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatgtagcaataggaaa

SEQ ID NO: 119518 - DNA, 1048 bp, Homo sapiens
ggcaatttaaaaaactcaaattgtgttcagaaaagggaatcagtatatattagtacaagcagcaagaaacttgtgctaaaaatactggcaattttctgaacaaaattactcttgggaaacataaataagaagaaaaatggaatactccctacttgtatttgtaactagatataatgcgctatctctttctcctaaacatagcatcagtagtactgtttttcatttaagctacctgtacttaagaagatttttgttagcagaaaataaatccatgcctgcaagctactcacagcaaaaacagtttggagaatttggttgcaagagtgtgattcaaagaagcagtagatgttcttctaaagagattacaaagagtaaatttgaaattcagtggcatttcaacaaaaaaaagttgtacaaagtgttcttaaactaagatcaaagggcaagcagatactattgttcagacctcagatggtgtttcctctgggtgtccttctaagaatgggtataaatcctttttaaatgtgctgaatcatggttagttcctctatttgagagcttacctctgatcagcttggaggagggcttccctgggataagaatctgtttaaatacaaaaacaatgctcagtgcttgctttagcatataatttgttgcctctctgtgtcttcagagagtaactactttatatgttggatttcaaattgatattttacttgactatgaatactggctaaatactggctatcaaatgtagtatatcaaacgtagtatatcaaacgtagcaaactaaaagatagcagctctgctgtctttgcctcactcctatttacgaaggtgagttagacaaggaaaatgaagagggtacaatgtcttgcatcatgaagcagctttctgtaactttttcacaaaccaatccttcactttctgcttcccatcttatatcaaaaatgaactattctagggaatgatttttttttttttttaagacagtatctttttctgtcacccaggctggagtgcagtggcgagatctcggctcactgca

SEQ ID NO: 119519 - DNA, 1879 bp, Homo sapiens
ttcaccttttactacaagcattagaaatcagtaacacattgtgggtcactgaaatttatcagattttgtgttcagtcactagtgttttgaagattttgttgtctatactttttttccaatgtgaatatgtagtatttcagcaccctatgcataaagttaagggtctgaagccaggctgggaacacagctaccatccctaacatggtttttctggggacacgtatgccccagcaacagaaaacccatttggggtttattggttaaatgagtttgggataactggtgaatgtatgttcgccatagatcatagaatttagagcttgaaaagttctcgcatatcatctaatctgtttgttcgcagttaaatttgttagatgttttcaccaccattttctctttactgctgttacctcttaagattgagggacaatccatgaaaacacacagagatcctagtgcatcagagcaatagggctgttggccaggctggagtggataatgaaggagaaattacaaaagcaggcaagagcacaaccctggaagagccgaggaaacccaaatctggaattgttggggttttctcttagtggatagcatcttctccaagaactctacttttagaaaagaaaatgctatgtatatctataaatgtccaaaggactgttgactccaaagaattgttttctgctccgaaattgagttgaaaaccacgttgctctgagtggcattgttccactgatatccactgattctcttcctgcccttcccatctccattattaaggagattgggaccataatagagatgatatctaaattacatcagttaattccttgatgggtccccacggtctcgttatctcaagcacagtcccagatgactgggtcgaagaatctccttcaaacatttttgcaggatgaggttctggttccaagtgggagagccttcctgactttcagatttataggcatacgcccttgatgactgatcctcctgctggccaggtcaggattgtcctaggcctaaaatgtccttgccacacagtgccgattatatgttcagattgttttcatatcaccaaagagctcagctggccacggggggaagtggagtggagtggattcacagggcgcagaaaacagtgcccctcggaggcagagccccggagcccgctccaccctgacctccgatatccgccacgggccttattatcactctcctgccgcttgccctttcaccgtccagaacgtctgcgtttgttgattgttgttgctgtgtttacagtcctgttggtttcctgtacgtgaacatgggctggaaaaaaaattctgatttgtgtctcagcagagcatgagtgaaccatatcattggtaagagctgattaggccaggagatttcttataatattagccttgcttattctctgagaccagttattttccctccctccttttgaatctatgaattacatttaaatagtccaaagactgagttttgtaaactacaaaattaaggactaaaagtttttacttaattttgatttttattcagattttatttgtagactcccatatcggaataagttaacaacggagaagctgtacattttttagaaagagagggtttttttttaagatcagtttgaggttcacagcaaaactgagcaaaattttgcagagatttcccaggtaccccctgccccacaggtgcacagactcctccattatcacccagcagaatttggtatctttgttgcaattgatgaacttatatggacacatcattgtcacctaaagtctgtagttacatcccggttcactcgtagtgttgcagattctgtggatttggacaaatgtgtaatgatgttatccaccgctat

SEQ ID NO: 119520 - DNA, 1053 bp, Homo sapiens
atgccgaggagttgtgaaactactctgccctacaaatcctctgtggagaagctgtacattaaacaaggaaaaacaagtcaatgaaagtataaaaattcaaaatacgcagagttcggggaaagaattataaaatacctcagttgaagaatattttgtttctggggttttactaaagtggtccctaaggaagtaattttgatagtctatgacaatgtgggatttattttatagtgcttctatgtgttgacaacaaatccatcagaaatctttcttttttctttctttgtttttaagtctaggagtttaaaaatcttttttcctccgcatagtttgactgaggtgtctgtcaccatagtacctagacaatccctcaggcagagatatgagtgattaaatttctccctggcttgtgccctgtttgatccatgctaggcaggatttgggggagtaaaataaagaagcctgaagaatgaacaagaattataggaattttgtgcttgtgaattattaaaatttgggggggttattaggggagaggttaaatatttttcctttctgaaaacttacattaaaacttaatgtgactttagaattgagaaactgacaaaatatcgtactggccctaagggcaggatcagaggactttaaaaggcttcctcaggagagactatttagatcagagtaaaactaaattaacagagactccatcaattcagaggtctttgtaagtgatatatcgaataggcttatttgcctttggactgttttctatgacaaagctacacaggttaatggtaaataaatatgagaatacaataatggagacagaaatgtggtaactgaagagcagttcgtttgagggatattaggggtttgtgtttattcctttacaaatattgtgcaggtgagacatttagtgaattctctccatctctcttcacgtcagttactcattgtagtggggtattactgaattccagctaatttgcccgcccgttatctcccaccctattctgctcccttacagaggaaacctcttaaaaatggggaaga

SEQ ID NO: 119521 - DNA, 1059 bp, Homo sapiens
cctccccccaagtgcctagcatggtgcctttccttcatcgatacccaataagtgcacattgaataaatgtcagtttctcaaaaataaaactggtgtatgccgtctccttccattctctcattacaaataacatcaagcatttgaacgagagaattacaaactgtgaagcatgtgtgctattataagaaatgcttattaagttctgtatgtggcagtggttataaaaagggaaaagagaagttaccttcttgcagggtttatgttctgtgactttctaaatttttttaaaggctttgggaagaagaaatattattttccttctatctgatgtcattatgactttaataagtatgaatacaagtcagaaagacatgccgctgagtctcaatttaaatttcctggttgtgccaggcagaaagcttcgagctttcatgcatgcaaggaggcacgactcttcacgcaggtgccgttgcagaatacttatcttgtcagcttccacttcaggctggtaggcttggcatacattgtgaaggtgttagacattctgtttacataaggactgaggggtgacataatgtctattgaagcaaagtcacttagctccccgctaggcaacagggagcatttaaaaactgaaaactgatcaaagccatgggcaggattgagatacctttacccagggggcgggtggtctcttggttcgttgcccgaaacagatgtgcattattgcttcactgtatttccagaccattggtgaaatgaatcaggcagaattaaaccctgagtggccaatccggagagcctgcttaagtgggcacaagtgtgtccaaataggttggaaaaaatgtcaaatcagagtaggcgcatacaagatgtgatgtttctctttttatagactgctataaaagttgtttaaaattaaacaacccttcagtacttaaattatgtataatgagacaggtaggtcctggaacagagatctttcccccccttcttatcccacttaaattttgcactccctaccagagtatgtgagatataaacactttcatttccagg

SEQ ID NO: 119522 - DNA, 1346 bp, Homo sapiens
ataggaagctgaactcagaatcaaaacttctcctgaggtgccacctagcatcactaaccccagagatgaccggggtagccctgttaacactacacaaataaaatatgtcaccagaacatttcactgagatgaggaatttatttccatgattctctaaggttcaactatagtacatgctgctttttcctactgggcagcaaacatgttttactaaactcttacctaagtgctttctgtttacaattccacaatgaattcctgtcttccttcatgttgatttctacaaatattgtgatttacttccacacctttttgaggaagcaaattccaagttgtgatgcatcttttaacttttatcagcattttattgtgaacaaaatttcaacatatggaaaaaggggaaggttttacagcaaatatctgtataccctccacttagattctatgattaacatttactgtatctgctttatcaggtatctattctgtttatccatccattttcccattcagctgtccatcttttttcttttttgatacatttcaaagtaaagttgcagacatcaccggacacggttgctcacgcttgtaatcccagcacttggggaggccgaggggggcggatcacctgaggtcaggactttggtctcaaacatgaagccttgtctctaccaaaaatacaaaaattagcctggtgtggtggcgggtgcctgtagtcccagctactcgggaggttgaggcaggagaatcacttgaacccaggaggccgaggttgcagtgagctgagatcgcaccactgcacttcactctgggcaacagagtgagactccatctcaaaacaaaaagttgcagacatcagtacactgctttctaaataattctgcttgcctgccattaaagttcaatgtttatagatttttgaggtaaaatttctatacaatgaaatgcacatttcttaagcataccatttgatgagttttggtgtgtgtatacaccactgtaacccaaacctctgtcaagatacagaacattactagaaagttccctcaggctgcttgttatctgccctgagcatgggtggtccaggagtcacccagaatttaggaccataactctcttcatctttcctttctgaggttcccttcctttctgggatgccccagatctgttctctgattctccgggcagaaaggctgttggtttcctgttggcattcctgctggccagcctggtgcagaccaggccctccctttaagccagaagtcatgaaattgggaaatacatacagtgctgtttcccgcctccagtatcagtgcccagaatgtgcctagttttggtcaatctcc

SEQ ID NO: 119523 - DNA, 1040 bp, Homo sapiens
gatggtatctatgatagaggtgaaaaaaaaaagaggccgggtgtggtggtgcctgcctgtaatcccagctattcgggaggctgagacaggagaatcacttgaacccaggaggcggaggttgcagtgggccgagattgcgtcactacattccagcctaggtggcaagagcaaaactgtctcaagaaaaaaagagagagagagaatattgagggagcaccaaggaaggtatggttaagttcagggtacatgacattcaggctgagcgtggaaagagaatttggatttcccttggtaggtatagaggcaaaggcattcccgccggaggaatgcatcaggggcagtgttgattcgatggtgctgcgggagccctgagaggtccgaggtgcctgaatccgagcgtgagtggctactggtgctggcacagtactcggcaggggaagagattgcaaaggtaggctgacgccagatgctgagggataatgaagccagtctaaggagtttggactttattttgtaggcaatgaggaactatttacaactttttagtaagactgtggaatgactgatgtgtgctttgggagatattcctggctgcagtgtggaagaggcctgaaatgggagacgaactggggcatttttgcaattgtctaggtaacatcccccctcccgtttaatctgtatttacagcatttgagggtctttttgaaattttaaaatagtttacattttttctttcctgcaattaaatttagactgtttaaccaagaggggcaattaggtgacaaatttgtgaattgcacccaagagatgaaaacttgtggaaaaagtactaattccagtaactaaaatctgaaaggttacgatttaaatagacatttaaatagacttaacccgatcctcctggaactctttccctcattcctccttacaattaaaaacacacctttgtgagctggttgcttagaattaggagtgtcatctgccgtcacggtgcagacggtattcgcgtctttgaagctagttggcccacgggaaacttc

SEQ ID NO: 119524 - DNA, 1034 bp, Homo sapiens
cttcaggaaggtgcttttagtgttccatcattgagctttctgggatgggaggtggcaatctggaggtgagaaagatacaggtgaacaaaaatctttgccctaaaagtgtagactatttttatggttctgaatacagccctcctttcagatccgtggattataatttagatatcagcacagaatagctatctgaagcattgctcatgtgttttcccccttttctcttggctcttctgtagggctgtggtagtgccagcttattatctgctgggcataataaacacctacacctagcctccagggatcaagaaactgggtcagccaggagtcagcctatcatgctgcagaagctggtaatattaagcccagaaccagcctcattttaagattttacattatataatggtaagagcaatgctgatgttaaaaaaaaaatactggttggagtccaaagtaattttagacattaaagaaaggtttcagaacattttaagtaatgtttattaaagctagccctgacctcaatcaagcacctgctacttaattgatcaaatggtcactggtaagccctgtctcttctaaagtgacttcgccccaagtcatccactgacctttgctcagcactttctccagagacgagagagtgcacaagaggaaatgaaaaaacagatttggtgggaattgttgttcctggttgaaatgaaatgtatgtatccctgctacccaaatgtggtctgtggaccagcagcagctgccccactagggagcgtgtcagaaatgcagcatcccaggcacctttagattagaaacctgcatttacaagacccctaggtgattcataggcacagtaaggttcgagaagcactgatccaacccacagccctccttctgcacagcggtaacccagcagggccatctttgtttcagaagcacccatattacaaagagcttgagttattctggggaggtaaggtaaaggagagaagtcatacttcaatggcagtgagactttgcctagaaatctacaaaataac

SEQ ID NO: 119525 - DNA, 1047 bp, Homo sapiens
taaatgatagtttgtttgttttttttttttgagacggagtctcgctctgtcacccaggctggggtgcagtggcgcgatctcggtgcactgcaagctccacctcccgggttcacgccattctcctgcctcagctctccgagtagctgggactacaggtgccggccaccacacccggctaattttttgtatttttaggagagacggggtttcaccgcggtctcgatctcctgacctcgtgatccacccgccttggcctcccaaagtgctgggattacaagcatgagtcacagcgcctggcggaatagtataatttttaaagatgttttatgcttattgtgctttttataaaagatagcaacaatcttccaatgaggtcattcatttctgttggtacagttagaatgtgtgtctctgggttggtctctttgagtttcttttggcatagagcagtattctcaccctgcatgatcatcagagcacctgagatgcttcgtaaagtgtaggtctgagccccaccacggagatttggatacagtaggttatgaggggggagcgtcgagcttctcaggaaacctagttctcagctgtttttctccagatacaaatctgtaactttttgtatttatcttagggtgaagctttcatactgtgagctcattcaagccagagataatttcttatccaggaaccagttggcaaatcttttgtacctgcagttagtcctacttattttaatttcctgatttgataattccaacagccctgctacgtctgagtctgcttttggtgcttgctgtgtctcttgtgttttttgctcttagtgtgccttgtaatttttgttgagagctggacatgatatcctaggtgaaaggaactgctgtagctaggcctttggtgaagtggaggtaaggtgttgtggaggggaagccctctgtggtctatgattaggtctgggtctctaatgagcctgtgccctggtctcagcttttttctttaatgaccctgtgccctgggctcagtgggtctcaggtttttttctccccgctt

SEQ ID NO: 119526 - DNA, 1009 bp, Homo sapiens
tcttaattgagttcattaggcgttgattttaaaatgcaattttctgagggcaattttctcttatttccagagtcttggaggggactcttccaaggccctccaagggccctatgtgccattaacagtcaggaaaatggcagaagaaaaatgcttagatgaacgtagcagatgctctgttacgaaattttgcccaactgatgcctgatgctgtttctgtagtgctgtttcttgtacctgctcccaaatggtgcacctaacaccccagtgtgaccctccctctgcccttcatctccatgtacacacatgtatacacagcccaggagaactagttctgtagattatgccgttttaggcaaagccagatgagttcccatattccaaaaggaattagggaagggccagaagagcagagaacacctgttgttaagtgttcattcgccccggtgcattttcctagtgaaggtggttaggcagggttctagggagagactggaaggcagaggtcactgtggagagtatcctatagacaagatcagaaataggggaagggataagccagtctctatgtcatgcataaacataggctcagaaaggatatgcaaatgactcatacaatagcagaatgtgcacagtagctctgtttccattcaacgtattttctttcagaaaaagcatccaaaagttttaaaaggaaagggataaagaaaaatgtgaacaatggttaaatttaagcacaggacttaaaaatttaaatattctaagggaagccttctagcttaattgaatcatgtacatggggccttttcagaaacagctcactagattgcttgggatttccacgcgtttactacctgacttttggtcatcttgtttaggctagggttaatgggacaggttctcttcctcatttctccctcttctgagtgagcctattttcctaggctgtttggagtttttggataatggcattttatccacttggtcgttattccctgggaatgtatgaaag

SEQ ID NO: 119527 - DNA, 1118 bp, Homo sapiens
ttgcaggccttgtggaattctggtcactgttgccctccaaatgccacacatgagccctcaggatgagccctacagagtttcatccttgtagataggaagatgtgtatttgggaacgaggctaaagccatggccgatttccccaacatgctttctatttctattttcgttaatctttttaagttcaatttttaaaatcatctaaatgaatctaaacattctttagcaatttgcttaaatcatcttgtatattatatagaaatgttagatgcatttatttctagcctgcttactctgtatttcacataggaaccaaaaatagtctttccttcttcccagtttccttttgtgattgttgacatttttttacgtttcatcattaaatttatgacttatcttcttgtacctctgcccttcttattatctaagtccatcctatctatttttaaggaatatgaaagtatgaaagtaatcttcagtaccagttctttccaaatgaatcgactgtcttttcatggtgctcgatgggtctgtgtgtaggcgtctgagtgtgtgtaggcgtctgagtgtgtgtaggcatctgagtgtgtgttcggatcacgtgatagtaaagtgttcacagtgttatcacaagtgttattgcaaaataaagcttctctgtgccaggataaattttttaaaaattcatgtctcaattcagatattttttccagagttgctttaaaaaaaaattaacacatttggcaaaattcattttttcttgcaaactcctttgaactttaaatgacaatgttttatatgagcaagggggaagatcaaacacaaaagagaaggaagtgtagtaagttgatcttggaccatactttgaagtggtctgttttctcagtaggatgctaacctacagctaataggagcagctgaggaaaggagggaccagctgtccccaaggagcttggcagccttctaccttgggattgcacagtcacctcctccttgctggggctgcagagtttacgctgaggaagtgaaagaaggttgtgtgtttattacagtttgaggtgtacttttcactccaggaaggggaagcccctagaacttttcccatttggcaaggggtaac

SEQ ID NO: 119528 - DNA, 1028 bp, Homo sapiens
gcagaatgtttctttgcccttgtattaacgaatgtgcccctgaagagtcttgaaaatgcaggaggcagaagccccggcctcctagtagagggaaagcacgtacacgcgtctttggtctctaagctccatctgcaataaggaaagatttcctgatagtgaagttttctctggatttttttttccttctccgtgacttgctgtggtaaaggacagttgtgctcagtggcttccagaaaagctggacgtcccaccatgatggcacatctgggcacaccacacctctcctctctactactgggaacactggagaggactgactgcctgtggcatatgctttgtgcttggagtgttgcttatgaaagatgaggcccctttaaaacctcatgctcacacttagagaattctggtcgtgtgctacagatgttttacagtttatttccaaacagctgcttttcccttctttagtctgtttttttttttttttttttttaaataaaatccctctggaaacctttcagctcacatccttggcaatgcttccttagtacaagtccttgcattctatgccatgacattctcccaaccagcacctgttactacaggcaggccatcgacttagctgttctgtgagttagaagtactattgtgtatgtggatcagaactgtagattcaatcagcctagaacagacagcccccagtgacaagccctccctagcacttcatgagaatacacagaaagaagaaggaaaaacttgacttataatgtatgtctccctcggaacatcaggtagaaaagccccatgcaggtgactcaatccagggtcaaagcagggagggtttccctgagggcacagcaatttgacaagtttgtcccatttcaaacttccccagcagccagctgtcaataatatctttgaccttcagaggtaggaagagcaggaataattaagatccacagatgatccccgaatcctggtaatgattttcacatccttctttctcatgatccttttccccagagctgcca

SEQ ID NO: 119529 - DNA, 1021 bp, Homo sapiens
gtgttgaaggtgactcctgggcacccatcttgaatgtatgggtggatggaggcgcctctaaatgagagagtgaggagcaaaagtagatttgggggaaaacatgatgagttcagtttgacatatgttgaatttgaggtatccttgggagatagcaagtacgcagttggagtcaaatctatcatttgtaagaaaggtgatagagatttaggattggaagtctatagcctggagtaagagttaacaccatgagggcagatgagattgcccagggagagcacccagggtgaaaatgaaatagttcttgagatagacaaagaagcaagcagtgaagaggatcctggggaggaggttggacacaatcagacatctatggaatctcaaaaatggaggaggccagtgggatcagtaatgtcacattctgcagagaagtccttaaaaagaagagtgccatctggattgccagagggaacacattggtggcccaagggaggaatgttttggcagattttatgaggatgaagccaaactgccaccctcgtggccaagatggccttgatcctgtcgcaggaaagtcccttctgtgcttggtagaagaatagtacttttttcaccctgttccccacactgttgcattaagcatgctaaatagcatcacccccttcctcatctataggaatattaattttaggctttgtcttgctgtcacaatattttaactaatttttcctaagttcttatcaggtacataatggacattctaattagaaaaaaaccatccgtatgccctaaaccttacctctgagggtatcttcatagtgaagaagtttctattttgccagaaaaaaagcgatacttataaaataaatgttttctcttttactacttagtagaaccaatacataatggaattttagtttcatttcataaaatatttactctgtaagcaaattaaagtgactttttttaaacaaaagaaggttgctgtattcaccattgaatcaaatctttagatttccaaatt

SEQ ID NO: 119530 - DNA, 1037 bp, Homo sapiens
atgctgaggtccaggacagttgggtgctgccaagtcacgtttcatccacaggcttggcatcaccttgtgacctcagtgggttctgtgaaatagctcaggggctgaagaagtctgtccagataatagagtagtgtcagagaaaaaatttcccaccacttttccctcccagtctgggagatgtgtgccaaattggggtgggtgggaagctgaagtggcttgcagaatgcagcatgaacacagatgccttctgcctctttgcaaggtttatggagaactgagacatgggggtgctgctcatgatttagtgggctcctgagccacagtagacacaacagatgttgttcttgttggcagaagcaacggcctgatatcaagcaatatggggtgcagatggtcctatactacaattgatgaatccggtcagcttgctctaggtcagggagacataggcactgcccagaaattcatagaaggccccttctgtcagggagatgtggagtgcccccagccagacagagatccagagggtacattccaaatctgcttcctgaacacagaggacctgccaacaggccatttagaaggcatttggtggaatgctcaagagaaatgcagcctggatgagaaccttatgtgagccatttaatttgctacctaactcagttcatctctttgtgtctgttattaaagaaaaagctctaaagaaaagcttacagatattttggatttaagagaagagtatgattgattatataacggagcccaatgggaagagtgtcttatttgatgttttccctcattcaatcattaaatgttaattgaggacctctgttctcagcaccagctatgatggtaatgaaacaggtatgatccctcacctctcccttgaggcccattcagtcatatgatggagcagcattcagagaccaatgatgggcccaatagctgttctttattgaactgtttcccagacgttgtaatcctcacaagtaaggggtttctaataaggcagtcaaaattaatggaacaggcccacc

SEQ ID NO: 119531 - DNA, 1019 bp, Homo sapiens
aagaattggagcaagtttcacatcagtaaattaggataataattgggattgagagaaataaatcagatgtttataaaaagcttatcactgtgcttggcacataataaatgtttaataaatagtacctactgttacttttgctaagttacttttgctaagaattaacatggcagtggcaaaaccttagtcttggttgaaattacagtattatgaaaacattttggaggttaaaatgatcatagaaggatcacacagttgaattacaaattcaaaaagttttaaatactaaaatttaaaaatacaaaataccaaattttaaaaaatagagaacacacactgtaattagacccctaagaagggaagaaaatggcttaattcattcccgttataattaacagtgggcgtttaacagtaaagatgtgcttcgtgttaacattttcctttgtctccagttgctggacttcctaatacaacccatttatccaaaaatagagcaagaggaaacagaacatagtagcattgtagaaataaatagtcgttctggctggaaaccaaatggttggcaggggcattttactaatcactggtgtattgatatggcctaagctgtgcttgttggcaaaattgttacagtctgacttggtgactctttaggatggggttgtaattttattttagaatatttcacacagtaaaggactaaggaagtccggtctcctaggttgcaaagccatcagttagtaggttagaaaattgctggagaggcttgtgtgtgtacttacaccattgttcagcattaattgagtatgtattctgacaaatggattaagaagggagcaggaaatagtggaaacagagaaatacatagaagtagtggaagagaatggagtttacatttgtgtaacttgtgggctcttcgtttaatcccctccgtaatccacagaacagatatcctccctgttttaaaggtaagcagcttgggggtcaaaaaaactcttcaaggtcatgctcattgataa

SEQ ID NO: 119532 - DNA, 1114 bp, Homo sapiens
tgcttgagcctgggaggttgaggctgcagtgagctatgattgcaccactgcgctctatgctgggcaacaaagcaagaacttgtctcaaaaaattttttttaattttaaaaatcttagaaaaataaaaaaccataaaagtctggaatgtttacaagagcccctcttccttggtggactctgtactcgattttttagctcctcagcactgtgagactgccaaaccctctgctttgcttttgagcctctaaacagtttctttctacttgttttctcaactcctcgtcccatataaacacagcttaatatctggtaaatacctcaagtggaaatgttggagttcaaggaggccaggacttgaagagccagagtcctagaggaaagggactacacagaagtgacccaggcttctatgagatcacttttatgagctcatttccatgcagccccctttttttctgggactttagctcttctcacgcactagctgccttgaattttgattttctccccagctggtgatactgcgtaaagctctaggccgctaccaattgctgcttggtgtctgtgcctcgtactagaaattatcaaatgccctgaaaggaaaaggcagcagcaaacacaaggctcaccttaatgcatttcctttctccctgaggtcttgacccatctagtgttgccttgcttggttgctctaagagaacttcaaacaagtgtgttttttagttaattcagtattttttttagtgggaatgttagtttgatacatcatgaccagaagcttaagtctttgaagtatagtgtgttttatcattttcatttggaaatctttttaatgaatcccgacaaatgttgacatttgattcagtaatgaaatggcatagtcctggaaacaagatcgggacccaatgttgatccatttccaggatggaggagagtggtttctttagaaaaacattacctatggactgattgctctataaaatctgttggattttcagtgttgcctgctgaaatgaagacaaaagttcaccctttttagatacctgagacgggtttcttttttgaagagaagggcaaatttgagaaagccaggatgggagaacactatattata

SEQ ID NO: 119533 - DNA, 1057 bp, Homo sapiens
gtgtgatatttgcctatggcctttgcccgtagcatccatgttctggtttgtattggagttatttgtgtgtctgttttacaccaccccttcattcactgagttcttggagggaggaaagccatgtctgacttaccgtctattggccgtggtgccaggcagaaggcatgtcacgtaagagtcgctccagtgggcctcagtgaattggggcacccccagtgctcttgctggtgattcagttaagccaggctagtggcccctgtgctgcacagggtgggtacatgcacttcagcagagtctcctgaggaacccctggcttagtgttattgcatcagcacacaagagctcaaccctggcagtgaggtgggagtacagccagagagagcattgcccctgcgtggtgtctccctctcccccgttcctgggcctcctggtttggccccactccaccattactcttccttcaggatactcttctggcccggcagctgtcttgaaagcccctgtgcagtttcaaaatgctccctgtttggactgcagcaaatcctgcctagtagcgttgtctgatcatgtgaatgtgatgccttcccggtctggcgcctctggggtgtactgggcaagtcggcccacgcctccataggccttgcatgcagcagggctcacaacacacctctgttgcttaagggtgtccattcaagtcaccctgctcccagtactgaccccagggtagacaaaacggattccgtaagacattcaagccaacagtcaggaacctgatgtagctgttgggtgaccatacttgtatctaggaggctatcctgagcctagcacagagcctggcatgtggtaaactctctatgaaggaattaatgagttgatgggtgcatcttttgatgggtgcatcttttgatctcctccaacagattacaacagcagtgaattgaaaacagcctgcaggaagcatgagctgtatgtgagtttccaagacctgggatggcaggtgagttctctggacacgggggataaaggtcctttctcagcagtttactctcatctgaat

SEQ ID NO: 119534 - DNA, 1079 bp, Homo sapiens
ttttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaactgtttgcacttacagctttttttgtaaatataaactataatttattgtctattttatatctgttttgctgtaacattgaaggaaagaccagacttttaaaaaaaaagagtttatttagaaagtatcatagtgtaaacaaacaaattgtaccactttgattttcttggaatacaagactcgtgatgcaaagctgaagttgtgtgtacaagactcttgacagttgtgcttctctaggaggttgggtttttttaaaaaaagaattatctgtgaaccatacgtgattaataaagatttcctttaaggcagaggctggtcgagatgctgctgttatcttctgcctcagacagacagtataagtggtcttgtttctaagattcctaccaccagttactttgggccaagtatccacatccccttgcgtatgggagg

SEQ ID NO: 119535 - DNA, 2032 bp, Homo sapiens
gagttgccactgaaacatgtatcctcaagaggatcttgctctcatggtctggtctgcagaccaccagggcatcgccagggaggtcattggaaatgcagactcccaggcctgctcaatccaaatctgcaccttcagcagatccgcaggtgatcgtgtgcacagtaaagactgaaagcgtctgctttagggtaaagtcgttcctttgaggctgatctttaatgatgtcattttgaattcagaagtgaacacacagccccacggctgtgctttctaaacagtagtctgctcctgttttaatggaatatacacctttaaaaattagccacagaatttttccagccacaacggtaggagtgtatctggttttatttaggaagcaatttgcatgtgatctggaccgctggtttgcaaacttttttcttttttgttttaaggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaa

SEQ ID NO: 119536 - DNA, 1164 bp, Homo sapiens
taaagcagactaccatgtagcacctttcccttaaattctccagccagagcttccatcagcgtttttcacattgacttagaacaggctgctttccatttttatgttcaatgtaaaacaggtatcattgcctttgctattgtaactaggttctttctgttgcatagagaggatgtcacaaagggtgctaggagaatagggtggccagtgagaaaagcggctgaggatgagacttcagtgggtatcctggagactccaggcttagaggtgcagactcaagtgtcagacacccagggctgcctggtccacaccacagcgccctggagagttttcaacctgcctcatccccaaaagacagtccccctccccaccttcatcccctgtacagtgtccagccacctcctcaccacatctcccaggcttgggacccagggacttgcattgatctctctgcccttcagaggctgccagcctccctttgtgtgtagcctatgaaatgcagattgtgtaggtatttctgtgtgaccttggagcctacgtaactgcatttttaaaaaattactgattcgtgtatctgcaatcccaaagcatggccctgctcaactttaagggatgtacttgaactgtggctttttcctcccttgaagggcactgtgttggcactcactgaaaataacttcgatgacaccattgcagaaggaataaccttcatcaagttttatgctccatggtaagtggctgtttaattagaaactactttgtccatgtgtactaagtcacatcatgtttttcagctcatctgccacccctccagactcaatgttgggcacatgttacatttatatgtaggtcatgttgtaggaaataaggaaccgttatcatgctcctatattcaaatattttaaacttcaatggccttaattatatatggagaatgaggctacagttatatcaactttgattatatatggagaatgaggctaaagttatatcaactttggagaaaacataaaaatggaggcaaattatgatggccatattcagttttgtggtatctgcacttttccaaatagatggcttttctttttggctaaacaatgagtgtcatgatgtagctttgctcctcggttcttttaagtactcggatttcttttgtagagaaatcca

SEQ ID NO: 119537 - DNA, 1030 bp, Homo sapiens
ctctctgtctaaacagaatttagattgggcacagtggctcatgcctatcatcccagcacttggggagaacaaggtgggatgactacttgagcccaggagttcgagatcagcctaagcaagaccttgtctctacagaagattaaaaaaaaaaaaaaggctgggtatggtaagcgcactcctgaagctgaggtgggaagatcacttgagcctggaaggtcaaggctgcagtgagctgtgatcatgccactgtactccagcctgggtgacagagtgagatcctgtctcagaaaacaaccaaacaaaacccagaatttaatgacaccgttataacatgaatcaaattagttactctttacacttaaaagatctttctataccacatcccattttttgcaaatggtctcctaatatcagaatgatccccataaaatttccagtgtgaatacataagtctccctttattcacacatagatgtgtttcagaaaacttggcccaacaccgaatgacttgaaagcaattttggcttcctggccggctcccattaccaaatgctaccatggagagaaatccccttagaagactgggttggaaacgtgagaaatggcttggattgcctctggccttgtgacttgtgcctgctgggagtcagagcccctcccccaccacacttactgtccacagtaacttatcgtgaggccttcagccttttcccacttttgctaaaagttatttcatccataccagcgccctgacggcagaactctagcatgctttccgctacgggaatgcattttcagctgggattgtcttgggctctgagcagggtgtgtttcccaaatcacctgttacggaccgactccggcaggacagaccgactccggcaggcctagccagcgcctccctaagtgggtcactgccacacagctgtgtcgtgtaggtaccatggtggcttcctgcccttgctggcttcccatcagtactctgattaggttcccagagagcctgtctccaccttacagtgcaggatct

SEQ ID NO: 119538 - DNA, 1030 bp, Homo sapiens; identical to SEQ ID NO: 119537

SEQ ID NO: 119539 - DNA, 1030 bp, Homo sapiens; identical to SEQ ID NO: 119537

SEQ ID NO: 119540 - DNA, 1055 bp, Homo sapiens
cccttgggcattgttttgtgtgggtatttagcactttgaaagtcttgacgcgctggcagcagaagggaaactttgtggttctttatgattccagccctgcacagctttgaactgtcagcacctttaaagcctttaacaacttagcttggatattctttttaataggaatatgaacccccagataaaagctgagtaatatacacttaatgtgtctgcagcagaacactgattccattatctttccctcatttctggttactttggttggaagccacagctgtacctggtctgaaaagttgagaaatgtaggattgtgactagacagctgcacacattgctgtctgcttgggtcctggcagaagcatcttttgaaaagcccctttccccctctttctgtatgagacttagtcatatgaattacattctttcttgaaggtgcagcttatgttcatgccatggttttctctctgttgcctttcattcacctgcattttccttctcatcacctccttttctctctgatcagtcttccacagttgtgtcttcctcacagttttccctgtcatttgtgtaaagtaaggataaccaggccttcctggtccctgagtttctcattctcagctttgtccattttgctaccctcgtgtctgtttgtgtgttttttgaggaagagtctcactctgttgcccaggcaggagtgcagtggcatgttctcagctcactgcagcctccaccccctgggatcaagtgatcctcccacctcagcctcccaagtagctgggaccacaggcgcacgtcaccatgctcaggtaaataaaattttttttttgtagcgatggggtctcactctgttgcctaggctggtcttgaactgctgggctcaagcagtcctcttgcctcagcctcccaaaatgctaggctgtcacctaggctggtcttgaactgctgggctcaagcagtcctcttgcctcagcctcccaaaatgctagggttacaggcacgagccactgcgctgggcactctggtgtctgcaagtgctgaccccttcagaatac

SEQ ID NO: 119541 - DNA, 1055 bp, Homo sapiens; identical to SEQ ID NO: 119540

SEQ ID NO: 119542 - DNA, 1055 bp, Homo sapiens; identical to SEQ ID NO: 119540

SEQ ID NO: 119543 - DNA, 1975 bp, Homo sapiens
tcacagtaactggatattcaggccttgtaagagttgaatacctgccaggtggcctggaagaataccttaattgcaaaacaacaccgtgtctgctccagtcctaatttgaacacagacaacaactgctgaagccgggaaagcataacagtagcttgcagggaaggcccgaggctgctgcagaggagcactgagtactgtagcttttgaggcctcagtcacagcagcgggctggaagttttcacctcattttagttttccttgaataaaaccagaaacttctgaaagtttaggattaactgaatgtattatctcctggaacgttatgtttgtttcctttttatcagagaggagcagatacatgcctggctgcagccccttgacagctcattttctgattgtttcactaaatgagtttgctctctgataagacaactttctttttgctctgtctaatcctttgttattctttcagcttaaagcttttcaagccaggccaagaagctgtgaagtaccagggtcctcgggacttccagacactggaaaactggatgctgcagacactgaacgaggagccagtggtgagtgtctacctccttccctccctccctccctccctccctctctccctgcctacatctttggggtaatatgtaacggggcagaggccagttgaggttaatgattaaggctgccattttaaagcaactctactttttttggagcttattggtattacaggtaaagatgaacttttacagaaactttttggtgtggaaatacctaaatgtgcacaaaagtcaagagaaggctaaaccctgagtttcagcagttaccaccattttggtgtttgtcttccccaccaccctgcgccttgtttggctgtagtcagtcttcagggaagtcacttgtgtggcctcacagataagcacttactctttgttaacactgccaccctgccactgtcacaggtaatacagttcacaactgtaccccagcatcagagactgactctggaccacctggggtcagggctgggcccagcctagaatctcctatccaagccagcactggagcctcctcccatccccccgacctttgccctccaccacctgcagccctctggctcgggcctagcccgacagctgtacccgtagggtggatccttccttttcttctcggtgctcagtccccgagtctctaatgggctttgcttataacatcattttgtaccattaatactctgtgtcttaatgcacttcccttactaaggctaatatcaggagattgtagactcttagaatattatgtactaaaaaggatttataatcctccccctccccagttgatgttggaagtcttcacttttttataaatcatcatgatcataaaccactggttaagtgttcctttgtgggtggtgccttctgattaatgccgagtgctcaggtccctggatgccgggtagacctggtgggtcatgctgctgtgttggagagggactggaaaaacactcgtgttcctacactgtaggatcctgatgagctaggaagagcatctgaagtctttgtaatttcaatttcaacaaatacctaagactaccttcttgtatcagctaagcgcccactgatttgaaggtggtctgtggtggtccttttggagctttgccgcttactgttgccagtttccagtgtgtctgtgcggctcttccgctctgccccatcttctctgatgacctaatcagaaacttggctgctgattcagtgcttccatccctcacctgcaaagactctctcaactcggctgggtgtggtggctcatgcctgtaatcctagcactttgggaggctgaggcgggtggatcacccaaggtcaagagttcaagaccagcctggccaacatggtgaaacgtcgtctctgctaaaaatacaaaaattagccaggtggtaggtgcctgtaatcccagctacttgggaggc

SEQ ID NO: 119544 - DNA, 1037 bp, Homo sapiens
agcccggggagtcagggccaacttgctagaggaagtgacacccaaactaaacctgaagggcagatagatttagctaggtggagtttagggacgaagtgtcagagagaatgtgtcccagggccaagccaagctatagtcctttgggaacactgcagatgctgcagtagggctcaggagtaggccacaagggaaggagggtggactctgggatagaagtcaagcgggaggtcagcagggccagaacaactaggatccagaacaacactttgctaagtttaatactggaacaaggccaagatttcatgctgagaacagggcagtgactctggagggatgggagcaggggagagaggtcctggagtactggtccaggagctgccatctgcaatggtgtaaagaaaggactgagagccccattgtcccctggacagagctgaagttgtgggccagctgccctgtgacctgatactcaatgtgcttgtactcttgccttgttccaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccacgtaagttggaaggaagggggcacacttcctaggtggctcctggctacaaagaaagtcctagttaaacttttggtaaaggtgtgaagagatactaaatttaagcaggcagtccctgtcattagggagaaactgcatttaatgctgtgtctgttttagatggcttttatacttggataacctttaattcatcagtgttgggttttcctgtttataagagaatgtgtttgcaagagaaaaatgacggtcccgccatgctagatgttcaccggtacattttacacagtgtgcatggactgtcatcagttttggcttgcttttgctggtgacttattcgcaaacacccttcctatagttccttcccgtgtgactcccacagggctgttcctg

SEQ ID NO: 119545 - DNA, 1013 bp, Homo sapiens
cgcgggattggggcgagccgtcccatggcgggaaggcaggaggccggactcggaaggctctcccagactcggtccctcgctccagcccttccctgccggtgcgcggagccggggctcgggcgggtagcggtcgcgcgccggcgcgggcgggcggggagaggaaggggcgcggcctctccggggcggggcgcggggcgggcgctgcgaggggaccggaggccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtaacgccgcgcaggccggcgccctgccccgcacttggcgcttcgcggggcgtggggcgcttgggcgccgcgggcggggggtcccggggccacgtggacgccgacggctctggtctgcggcgtgcgtgctacgggcgcggggctcggggctcaggggtgcggggtgtaatactgggggcgcggggccgggagcgcggggaccctgcgggttcggggctccggctggcggggagcggggggcgcgggcgccgcggctcggggccgggagccggggactgcaggggaccgagggcttggggctccgggtcgggaggcgtgagctcagcgggccgggcactggcggctgacgtggcgctcggcggccggggcggtgcgggaggagggggcggacccctaggggacagccgggaaaagcccgccctgcgccgcgctcctgaattcaaccgcctcttgcacctcggcaccgagggaggggaaggtggggtcgtcgccctttcggg

SEQ ID NO: 119546 - DNA, 1051 bp, Homo sapiens
agggacgtgtaggtggcgctggttcgttagtttatgtaacccgttttctttgttttttttcatcttgcttgttttccctattagatgttagggcttatacaggtgagagtggtgttacaggagactgggcaaaaggcttaatgtcaggacctgatggttacgtagaggtcactgcatcttgtgtggtttttcaggcagaacagtcatatgatggaagattgtaaaatattattagttatttgttatagttaatatatatgttagcaaagaagtgaggaagaggactcctacatactcctacatactctcaaaggagagtataaattgatgtaacctctttggagggcgatctgaaaatatctatcaacatttaaaatgcacatactggctggtatgtgcttaacaaggtatggcacatacttgttaagatgtgtacagaggtctttgttgtagcttttcatatgagaaaaatactagaaacaacataaatatccattaatatggaactggttaatcaattgtgtggtatatttgaatgggaatactatgcagccatgaaaaaggatgggttagcactaaacatgataatatggaatgatctccaagatgttattatgtgaaaaagaaagatacattttaaaaggagaaaatgcacacatgcttgcatttggatatttctagagtgtataccagcagctggtactgatgactgcctcagggtagggtctgaggaatcaagggtctgcaggtctgcaatgggagggatacttacttttcctttttctatttattgtagtgcctaaatctttttttttttttcgagatggagtctcgctctatcgcccaggctggagtgcagtggtgcgatctcggctcactgcaaactccatctcccaggttcacgccattcaccggcttcagcctcccgagtagctgggactacaggcacccgccaccgcgcccagctaattttttgtatttttagtagagatggggtttcactgtgttagccaggatggtctcgatctgacctcgtgatctgctagcctca

SEQ ID NO: 119547 - DNA, 1051 bp, Homo sapiens; identical to SEQ ID NO: 119546

SEQ ID NO: 119548 - DNA, 1051 bp, Homo sapiens; identical to SEQ ID NO: 119546

SEQ ID NO: 119549 - DNA, 1070 bp, Homo sapiens
gaccgtaacgttacataataccacatcaaagactatgatatgctaagcaggcagcgtatgactaaaataagtgagtcccaagtaggaactgtctttgtgagttgtggtcagggaatcatttgtagtaaagataaaacttgaatgcaataggatttgcgttatgaaaaggatggcagaatctttccagctcagtctagttcagtaagcacctgtgttccaggaactagggctaagaagctgactaaagcttggtttctgcccttgtttatcaaaaacacaggtggacatacttttgggaaatttagacaataatccatagacttctttgatgttgaagcagtagtggatcagtctggaaattggaaagtgcactggaaattggaaatgagagaagacttgcattttggtcatgcttccatcactaaatttgtacagagactttaaacacatcacatagatggttttcacatcatttccaactttaataatttgtgcttatcctgtaggtaatgggactcttactgtaagtggcacgatgaaagtgttacaggaaggttactctgtggactcagatgtatgactgataggttgaggaaattattagcctgcattaggattttttttttagaaagtagctgaaaatagcaatttctagtctagacagggcagggatagagatgaagatcttggcttggaagttaagattatgggaatttttaacatccatatatagatatgtctatggactgtttgtgttacttatgacaattactggcatggcttcagatttagataatctctatttctcttttatgtaaaattgtaattcttagcccaaagtgactgaatttttgcttttgagaacaccattactataagtaggaaatcaagaaagttattaaatggcctttgtcttttaggtaagtattttgctttttataatcagtgcgaaaatacatcaggttttattaagcagctacctctatttaaggatttcccatttcctttcccagaagactgaattattcaaggaaaagaatgttttatgctgttttatatcccatgcatag

SEQ ID NO: 119550 - DNA, 1070 bp, Homo sapiens; identical to SEQ ID NO: 119549

SEQ ID NO: 119551 - DNA, 1070 bp, Homo sapiens; identical to SEQ ID NO: 119549

SEQ ID NO: 119552 - DNA, 1055 bp, Homo sapiens
attatttatcaatttaaaaaaggagccaagcacagtggctcacacctgtaatcccagcactttgggaggctggggcaggaggatcacttgaggccaggaattcaagaccagcctgggcaacatggtgagactttgtctctaaaaaaaaaataggaaaaaagaaaaagaatataacatgaatgtaggtaagattaagatagaaagtgccaccctgggaagaggccagtaaagtgccaccctgggaagaggccagtgcatgattcaaggacatttagaacagacaacaccaagctcaagtggtgcagcatttactgatagcaagagaggagagagtgtgtacacaagatccagccgtttgcgtcagtgccctgtggccagcaggtccactctgcagaccatgtggtcagtactgtatttttttaaaacttgaaatgaatgaggatatgtgcattccatcattccttggagcaattgttttccccttttaactttaaaaaagaaaagtttggttgagacctggcaggcattgaaagttagcctccattgcaagtattatcaccatttatgagtgtgaggttttaccataatagaagtcagtgtacgaggttatctgtgttgtgcttaaaattttctctacatagacctgatttttgacttttgtgaaattgtttatattgctaacatttatcattcagagaaaatattctgtaaatgttgatttaatgtaatagtttcccttaaaatagaatttatagagaatttgaaaagaaaaccacaagttaattcactttttaaaaaacttcatgtcatctgaatacttaagctgctttgtttggaaagtgtctttttaaagaaaatagttaataaaattacagtaagataattgtcacaaaataaaaatcttaggtggccagttgtgtattacagagatttggttttaacaattatacaagttatttaagtgggaaacattaatattaaattttattaagaaaaattttgacaccaaaaaatctgtccttcacttagaatataaaatgtatagctgaacacca

SEQ ID NO: 119553 - DNA, 1055 bp, Homo sapiens; identical to SEQ ID NO: 119552

SEQ ID NO: 119554 - DNA, 1055 bp, Homo sapiens; identical to SEQ ID NO: 119552

SEQ ID NO: 119555 - DNA, 1044 bp, Homo sapiens
cctgctgctcctctgcccctagctggggccaggtagcagaacagcctctcagacgaggtcagcagtattgaggggcatctccttaatggagatgttgtaggtctccatgtctcgaagggtcttcttgtcttctgtcaccatgactttgattactttggatggaaatctttaaaaagatattctatacttttatgttatttaaaaaatttattaaatgttacagaataattttgtaggaatcaggcgttactgagaatatcagattttatattatggtgaatatggtgatgtcattagggaatgagaaagagagacactgtgctatgtttctgtaccaactgccctcagatactgtgtgttttaagtttttgtatctgcctcctcttttgctataaggctgatgcctgttattcttcccttattatcagccttttcattttctaacttgtgactttttcatagggtgtcgtcttagaaaccagttaactaagctggttagaattgtatgtaatgtaggtcaagtaggctcggaatcagaagggcttttcatgtgcagtatttgtaaatggactttgtagcatcttcttcgtttgcatgacttaaaggtcttagcacattctcaactaaggttcagataaatgttatttccaggtagctgggttttatttgtatgtaaagactgcagtattgtcaatacatgaatgtataggcgcccccccccccttttttctttactgattgttgtaaagaatgtaagaatgggccgggcgccggtggctcatgcctgtaatcccagcactttgggaggcggaggtgggcggatcacctgaggtcaggagttcaagaccagcctggccagtgtggtgaaaccttgtctttactaaaaatacaaaaattgtccaggtgtggtggtggttgcctgtaatcccagctacttgagaggctgaggcatgagaattgcttgaacccgggaggcagaggttgcagtgagctaagattgtgccattgcactccagcctgggcaacaggagggaaactccatct

SEQ ID NO: 119556 - DNA, 1044 bp, Homo sapiens; identical to SEQ ID NO: 119555

SEQ ID NO: 119557 - DNA, 1044 bp, Homo sapiens; identical to SEQ ID NO: 119555

SEQ ID NO: 119558 - DNA, 1090 bp, Homo sapiens
tttccaatgaagtaaaaaacaaattatttgacctccaaatcctcagttaatgtaaattttgcatttgttgaaaacttggtatttcgcaggaaggacatcaggttttgtactgaacataacattgaacacgaagaacctttataagtcagtgttcactgggctgaaacttttactcctatctgaatatgttggcttttgagagctcttgggggattgatgttgttgtttttcaacttctatctcctacttaagtgatattaacagttgtgcttatgtaacatctgtgttgtgtgtgtatgtttttaatctctacttaggttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaatattttttcgttgtttctttctttctgtagtcagtactcattggggtgaaactaactactgaactgccctacgggaaactggagtaagatacattcctcttgagttaatgattcttttttgttgttgggcttattgtaa

SEQ ID NO: 119559 - DNA, 1026 bp, Homo sapiens
tttgcagctctttttattactggttgagcttttaataaatcgtacattttcttttgaagtccttgctgaggtttatatatggtaaagatttagaaaaagaacaaaatgctcttttacaaaatatttttcaaaatatttttgaaatatagactgatgctcagtttattccacagattaagtgctgcctatgaaaacacacctgacaggtagatgctcctttcagtttgaatctaccagttagcctaatgtaattctttcatgtgaaaccatgaattttcataataaaaattaaacttttacgttaaaaaagacatacttgaccagttttcttgactgatgtgttatttatctctgtgccatggactgactatgttataggtgagacagttgtagtaacatctttctaagtagacacaaccttaaacaagatgaatatgtttttataatgtgctagagcagcttgtgtgtaggacttaagtatgtatcactaaaacctgaaacttaaatttttctgaaacagaagcagtgaagattctccctggtaacaacttaagtaaatcaagccaacaaatacgagtccaaataaacatttaatgagaaaatactgcctactttttaattttattgttaatatccttttgtattctgtaataattactgcatgtggagtgatttatccttcacctttggtgatctggtaacttagcagaatgcttgtctgcagaacaggtatgtgctaaatgctgaaaagcaaaggacattcatctcactaaaaatgtctcccaacaagcaggctgctggggggtttgtagcgcttgtagggtggctgagttatttctttctgcaaacactcctgtcagcattatagagacttgcactatctgttaagtaaatgtgacttaggagaaggaacgacaccacccattcatggggtcatggctgcaagttactgccctactggttttctctttacctgataactctcaataattctaaagtttatcttagagaaaagtctttgagtca

SEQ ID NO: 119560 - DNA, 1055 bp, Homo sapiens
cagaattgcactgtggtgttaaatgacattccagttaagttgggtacaaatacatacagatgtggaataaatgatttctaggtgttaaggtagggtgggtgtgaggtgcagattggccacctgctgatatttaccaggtcttcgtgctttgtttgctttggcaatattatttatttttgtcctcgtgcattccttaatttgtttgttcacgttattcaatacggaatatgtaatcagcacagtgtacaaaacagcagtcaaggaaccttcgagtcatcagataattccactgtattttgtttcattgtgagcccaattttagtcatggctgagttattctaagatctggtctatcttaactccgtttgaggaatattatgttgcctttcctttgttatactgcctgttagtgtggctgtttattataacaccagtgactcactgctttcttaaagtgatttcactaggagatagtcatccctgtgaacagactgttactcaagattattaaaatcctttgtaatattatgtgctgcttgactgtaagattgctatcaactgaaatacttttgttctgaagtttggagcaccattggaggcatgtggttcttttataaggaaaggaaaaataaaagaattaactgcaaaatagtccaggagcactggccctaaagaatgtcccaaaggcggcaacgtggtgccagttggaaaggtagcaaagcagcgtgtcaccctgatccggaacggttcacttaaagtgtttctcacatgacttcatggaaaattagtgattcagaatattatctgcttggctttaaagttcaaagtcatgatagagtgccaatataaattaaaaggaattattaggcagaaagagccaagcaccactatagacacactggcatgcagatcaacatgaagcaggaaatggcaactagaacaattgcattgtttcctgttgtaagaaaggaaaaagaacttgagctagaaagggatggtggaaaaccagtgttgtaagtgaaatagtctgggagatcccatcagaaatgttttta

SEQ ID NO: 119561 - DNA, 3297 bp, Homo sapiens
atcccagcactttgggaggccaaggcgggcagatcacttgaggtcaggagtttgagaccagcctggccaacatggcgaaaccccatctctactaaaaatacaaaacttagctgggcgcggtggctcacgcctgtaatcccagcactttgggaggccaaggcaggtggatcacctgaggtcaggagttcgagaccagcctggccaacatggtgaaaccccatctctagtaaaactacaaaaatcagccaggcgtggtggcgcatgcctgaaatcccagctactccagaggctgaggcaggagaattgcttgaacccaggaggaagaggttgccctgagcagagatcgcaccaaggcactccagcttgggcgacaagagtgaaaccctgtcttaattcatctgactcctgcctcccttgctatcctccttcccgtcattctctcagccacaacatgtgccccagagcctgctgtatgctgggctgtttctacccagcatccttgcattactcttctcttttgttccctggtcccagcccttcccttcctctccacttcatttgcatttcccaagtatctctcggttcccactcattcctcggctgcatctctctcaggcgcctaaaccacattgaggtgctccttcctctgtgtgtgtttgtacctcatgtacacttcgggtctagctcatttcactcttactgtaattctttgaaaatctctctaaattataagctgtttgactcaatgattgtagcgacacatatttgtaacaccattgtctgaggtaattcctggcatgtgtaggtggtcacccctccataaacactgaataaatttttaaacgtatttctctatgcttttcaaggagtttcctctatactttctcactgtacctcatcactaagaaggaaataggaccagtgttattggccttcttttacagagaaagaaactaatgcttaggaaacttgagtggtttaaaggcacggcgctcagtttttggaagggccaaactttcagatcttctgactgaagtgtcttaatgtgtggggaagctctttgtcttataaactgtaaaataccgtaataattgaggtctgcgcaggccccaacctatccatggtttggggctgctatctgcctcataaagcaaagtggagggtttgtcttttggaaaaacaaagtcgttttctcctctgaaaaagcctcctacatagttggttttgccatttgccaagaataagagggcacagattgaggcctcttgagtatgggttttcagttgaggttgaagagagaagacagggattgtaaccagaaaattcagaatggaatgcagttccctccagaactcctgggcttcatgacagtcatagaagtggattccttttagtttcccctcaccccgcaaacgtaccgtaataatgcaggatacagttattagttccctactcaagctataatccctcagtttgaatttacttgactttattctgaattgttcctcaaagatccctcagtgattatgttaaattctgtaacattattgtaatggcttagaatgatccttaatttaatgtaaaactattatgagttttaaatgatttattgagagcccactgtgtatgcccactatgccatacttgagagggagacaacagaagtataaaactattttcaggggcatattaatcttattgaagaaattagactgttttacatgaaagcaattaatgaagtagagaaaatggaatccagtgctaatctctggtcagaatattatgttattaatgcatgaggcagataagtagaatacagaatcagaaaattgtcagaaaaatatctgaagatttggatggccttggctgtctaagggaattttcattgttttggaaagcttatgataagtttgattacaaatattctttgtaaatagggcgaccacatgatttctcatccaaaacacttggctgtgaaaggaggcctattaataattacattgggacaacaggagtgaagtagaatgaatattccccatacttacaaagaatatgattcaatttacacaaaataagagaccaaagaggatttgtcttatttctgttcatcccctcttggcttttaaaacagtgccttgtgcagctaaatgcttattgagattagcaatattaaggctgggcatgatggctcatgcctgtaatcccagcactttgggaagctgaggcaggtagatagcttgagcccaggagttcaagaccagcctaggcaacagggcaaaacccgtctctatttaaaaaaaaaaaaaaccattaaccaggcgtggtagctctgtgactgtagtcccagctacttgggggaatgaggtaggaggatcttctgagcccagggaggtcaaggccacagtgagtcatgattgcaccactgcattccagcctgggcaacagagtgagacctgtcttaaaaaaataaataaaagcaatatttaacaactggtacctatttatagttcctatttcagattttttatctctgtagtgaaagtgtaatataagtaatgttatttaaatgtggagaaagtttattggagctgaagtacattgattaccaccttcttttattccatgctaggttcaatatgttttagtagcttttcgaatttaaaatgatcatgaggcacaacttacctcatttcaaaacaaaaaaagcctgcaaggtaaagaggatttgctgctaaggtatctaagcatctctctcctggtggcagcctaaacacagtctttgaacttgagggagtctgtacttcattttagtgagactgtgctgctgtgagcatggctacccaacagggctccaagaacaatttctatctgaaaaccacaataacaaacttgttggctttttacgaaatatatatttaaatgtgacatatggtttgacatttaactttttaagctttatattaggaaaaatatcatcagtcgtcctttgtgatgacagccagcaggctagtgaacgtctgttcagacccacaagatcttgcttgctgtagcatcgggctgtcattaagaaggagagtatttctacatctaattaaaaataaaaaagatgatactgaagtgtaactcataaaccaagtgtttaattaaattttcttttcctctagcttatgcaggttttgcagtagggaaaagaaatactcggaaaaggagggaacttgtttggaattcctttgccagcagaatgaataaggtcataatcctatagtgcaaaatattcatagcactagctgcaaagtt

SEQ ID NO: 119562 - DNA, 1051 bp, Homo sapiens
ccagggtaagaatttaccaggacagctgtacgtaaagaaaagcagatttattagagaaagtatgaaaatatgttgcaagagtgcaacaggcaagttagtaagagaggagctaactgcaaggaaacaaaggctggctggggattttacggaatagtacttcagttgtgtgctgaagaggggtttgtgcagtactgataacaccaaggttgcagtgagctaacttgagttttctatcagccgaaggtccggtgatagctggacatggaaagattgttgagttatttgtgcagaagggctgtgtcctggaccatgaagaaaggcagacttgtagcttatcgcccttctctttttgctttcccttggtcccctcaacctgacttcttttccctaattaggactccatatggagcaaaacactgttgaggagtgtgaaaaaggaagttaattctgactataaaagtggatgtataaactcatggaagagctggcatttaagggattatgctttgaaagatgtgtaaaaccaataaattatgaaggattgggaagtttagggcagtaagtaaaccaatatgaggaatgatgcaatgcaaggtaaaccccaaattacagtttgaggcccaactgtgaagacttccgagttcagagtgtggtttttaatttaattttaattaaagcattttagcagttagcagctagtgaaagtttctgtttacttgtatggggaaagggttggccatatgtgataagattcagccattttttgagaagacagctgacagcagtgagccagcaataaggcattctctgcaacattaccaatcatagtttaaaaattgaaagcagttcagagatccttatctaggatattgattctttaaattatggtacatcaacacattgacatacagtcacgtgttatttaaagacaaggatacatttcaagaaatgcattgttaggcagtttcatcatgtgtgaacattatagagggttctgttttttttttgtgtgtgtgtgtgtgtgtgtgtgtgtgtgtgtgtgtgtgttttt

SEQ ID NO: 119563 - DNA, 1051 bp, Homo sapiens; identical to SEQ ID NO: 119562

SEQ ID NO: 119564 - DNA, 1051 bp, Homo sapiens; identical to SEQ ID NO: 119562

SEQ ID NO: 119565 - DNA, 1067 bp, Homo sapiens
ggaacatgcttcctcctctcaggcagcttgctttttggccaggtggacaaacattgcaaccatttaaattggaagagtgccacgttgcaccataaatggcagagagaacacctaaggagtcttggcccaatctaggggattcggggaaggcgtttctaaagccttggattatcagtttaagtgttacgacccacagtgaatgcgggaaacatcacaaggtatgagattgcctggttaggcactgttagaacgtttgtgttttatagttgtttgtcgtagaaggaatgtattagagaaggaaattggttgtaggaagactactttggatatatgttttttttgctcctttgagattttttccaaatgatgtttggtttttgtctttaattttttctcttcttcatttggtccatgtgaagatcttgtctagaaagtagtagtatagtttttatttaagttaacctgaagcctagaaaggttaagtgttcagcctaagatcagccctgtgattggtggcagagtaggcgttggagccaaagtggccttcttttggtgtttcctctgccccagtgataattccgtcccttcggcccctactccctagcttagtgtatatattatataatatatatgtagtataaatataatatatatggccgagtggacaaacattgcaaccgtttaaattggaagagtgccatatatatatatatatatatatatatatatatatatatatttttttttttttttttttgagacaaagtctcactgtgtcgcccaggctgtagtgccatggcatgatctcggatcactgcaacctctgcctcccgggttcaagcgattcttctgcttcagcctcccaagtagctggggttacaggtgttcgccaccacgctcagctaatttttgtatttttagtagagaccgggttgcaccatgttggccaggctggtcttgaactggtgacctcaggtgatccacatgccctggcctcctaaagtgctgggattacaggcgtgaaccactgtgcctggcctagtttatattttttagggaccattgcc

SEQ ID NO: 119566 - DNA, 1067 bp, Homo sapiens; identical to SEQ ID NO: 119565

SEQ ID NO: 119567 - DNA, 1067 bp, Homo sapiens; identical to SEQ ID NO: 119565

SEQ ID NO: 119568 - DNA, 1027 bp, Homo sapiens
tacatgataaaatctatccccagtcaggtctagaaaagctcttttaatgagcataaagtgattgtctatgcagtaagaaagcatggtgtccttgttgagttagtagtggtttttctcttagtggtatataaaacgtggcagcgtgtcacaacccacagtgtcttagattttctgaaatatggtggtccattaggcagtgataagtggctcagataaatttaaggtaaacttggaagcaaccagctggacaaattgatttgcatggtgggatgtggaactcagctggttcactgcagaaccaggagcagctgtgttttcatcctggctctcctgtgaagttcctgggtgattctggggaaatcctttaatttctcccagtcttagcttcctcatcggccaaatgatgcaatcctgcttatttggtagggggtgaaattgatggtcaggtgatttatgggtaacaaaggttacctaagatcatcctgagggtctgtgcttggtgctgggagtatagcactgaagaaggcagagatggtaccactccttcaggggataacatttgatgacataccgatccagtttctctcgtatccaggggacattttctggttctttctgctttctctgcccaactaataaaaagtagtgtgcaatgtgtcaggaagtgtgtgagcatttttcatcactcatttaagccatgtttgaaagaaataagtggacacaattaaattgatttttaagacctgagaattgtttgattcatttaacatttgtattgggccttggcaaaactgtaaaacaaaaagaagttgaccttcagaaggccaaatatcattttggataaatttcctcttagtgttgtggatataaccttttaaggaactagtgcctctaattccttcaccccgtccttttcctactctccctccatctacatatttgtgttttctttttctttttcttttcttttcttttttttttttgagatagagtcttgttctgttgcctgggttggagtgcaatgatg

SEQ ID NO: 119569 - DNA, 1085 bp, Homo sapiens
ttcaagggtagagctaatcagcggcatgttcaaatatagggttgtttccgtaattttgtagtagtctatttgcccagaaaggcaaaggaatattaattttagaaaaggctgcaccgaattctgccacctgtgcaggtagcctccctctggactccagatgccactgtgattaccccattctgacccactcttggagcttcctgtcaccagccatccattctcttctctgtcttggttcactcctgagggcttcctgtgttatcctaatgtgcaccctaatgtacacaaatcactttcacagacagtgtcatgagtatgaggtgagcaattcatcaatgtcaacatatctttgatgaacagtggtttgtctttgcaaggcctgaaagagtccagtggatttctatttgctgtggcttgctggggattgaagggattatggttgatgagaggtttgaaattcaaccagtttattattagtgggggcacatgaagtttgaaaatcttggttgtcttgatctgtcttttttccttttcttcctttaatctttccctccttaccccttccctcccctcccctacccttcccttccctttaaatgtaaggggaaaagggcacactggtcagaaatgcaatgagctagttgttggtttttgtcacaattattcatatgtccacttctattttttcccacttgatagttaaaccaaacatctagtttttactgccttctcaaagtacataattcatttaggttcagtgtacttattgagtgacttatgtgcaaagcattgtactaggtgttctagtactagtgtaaagagtaattcacattaaaatggaaagatgatgactgagtgaacaaaatttgggatgtcttgcctcttgtgtttttcacgtagatgttgcttacttcaaatgacatgaacaaaggtcctcatgtaaagctggaggaaaaacaaagtcaattgctttaagctatggttggtagttggtaattcgtaacactaattacagctgatacgaagactacaatagatttgttataagtacctataattcccctttatcaggcttgaattatatt

SEQ ID NO: 119570 - DNA, 1032 bp, Homo sapiens
actgcaacctccgcctcctgggttcacgccattctcctgcctcagcctctcgagtagctgggactacaggcgcctgccaccacacctggctaatttttttgtattttcagtagagacggggtttcaccgtgttagccaggatggtctcgatctcctgacctcgtgatccgcccgccttggcctcccagagtgctgggattacaggcgtgagccaccgcgcccagcagagggggctcaatttctaggaacactttcatctccatgattctaggtaaggaagacaggacaattaaaaataggctaattttagggtaaacttttaggctaacgatgatacccttgaatgtggcctttaaacttgggaagaattgacattgaagccatagaaatgaagactagcttgaggcatccattgggacccaggcaggtatttggtgggatcatgtttgtttgatctaaacctttgtggcagctacacaaaaacccaagactggccctaaatgtgcctgtgtgtaacttgagttgagacacaattagcctaagagcccctgggtaagggagcagtttctgaagctgccactggggcaacattagtgcggagaagcaatcactcctgaagggttactccaatgtctgaaagagctagggacattcccagcaatggctgcgtcattgctaaggagcaacttacacatgggagtgtttctctttttatttctttttaatgtgcgcagggactagctgcttgtgcctctttgaacataggggcagaaaaaggaatttcattcttttctctctttctcacaccaatctacacattccttctcctctgaggcgattccaagccaaatggaagggagaagtactgggaggccttgcccaggttttatatggttttaaagggaatgaaaggtttttctttgggtgggaatgaccagaggtttgcaggggtatgtgctcctgtgacccatcacctgctttggcttatagtcctaactagaggcaccactaaccaattctcctatctggacc

SEQ ID NO: 119571 - DNA, 1044 bp, Homo sapiens
tattctacccaactgagacaacgagttggacagctgagtttaattaccaaaatggcctttggtagatatacatgtccaaagctttaagtgtacttttacgacttttggtaggggactgtactttgaatatactgttatccccaaagttcaaatgaactatgtcatataaaattttgtaaaatatctttctttatatctactcaatgcattattaaaagatacagaattctatcaaatctcatctaagaatactatttttattttaatgctattattgtaggcttctaatagaattttacttcactgaagaattattatggacatattaacaaattctgtggttaatagtaaattgttattttgctaattttaattttttttccttatttctttctcttaggtatgtatggtctggtttgttagttgtccttggtatatttcttaatgtttacagcaaaaatatggataaaataagactaccatcactgtatgatttgataaacaaatcagtggaagcaagaaagtcaaggacgctggcacagactgtatagacagtgattgtcctatttaaaatagaattttaagggaacaatcatcaattaattaactttccaaagggactgataaaaaccaaaggatctggaggcattgctatcccatttgtggacagatttcatatgaagttgttttgcggtgtcagccttttcttcagagcatttgtttgactgacttccaaagcaatcaagagagccacgtctagcagactttacaataaaatgtcaatatgaaggactgtaattcctagcagtttattgagaatttcactggaaatggaccatgtgttgcaagactaattggctataattatatcctatcaaagaaatcgatacgtaatagcagattgttttatattcattccattttgatggtgttatttaaattgattctctgttataagagtaaactgatgagttgaagtctggagagaataacattcattataaataaaattattctgtgatcttttttcaagatgtgttaata

SEQ ID NO: 119572 - DNA, 1003 bp, Homo sapiens
tttctactttccattgtcaccttggcacctcaacagattctggcatatagtcaggtctaaatatttgctgaataagtgatttctaaaatattgtcaagataataggcacattctaaactaattttttgctcctacagtgacaacaggaagaaaagcaatgaccattgtactttcgtttatattctttgctaaaccattcacgtttcagtaagtacttcttaattaaacaatttttctcagtttttagatactgtgtttcacatttcctcttaatcttaatttcaacttttctactttttcttttttgtagtaagtgtatttatttttatataaattaatgtggttttttttcctgttatgctttataaagaaaccttttcatcttgatctcttaactatcagtgtgtcttctgctattttggaaatgttggtaatttattattttgaatttatcattttgtatacttaaattgcctaaccagagtccagtgcaaatgtgacctgtttccattatgagtgaatatgagtgatgtgtacgttgttgagattaagggattcccctttgccctactgcaaatatgtaaattatgtatttacatcacatgctttaaaaaaatactagtttatttgatgcctgtttccacaaaggatttaaggtagagaaatattctgtaagttacatcctaaagactttaaactaagcttttattttttgtgtgtgtgaaagtgtttactatcatatttactgtctttactatttgtttgacattagcaccatttaaacttatattggtcaggattgtgaagtttcaaacccagaacttaacaatctataagtttggagggaaacataaaattaatttccatcaatatattacagattattatttgtctataaactagtttttctttctgtatgtactaggtataatacataatagtgttatgtcatacataaatataattataatgattcccctactttctcagggatgtttctctt

SEQ ID NO: 119573 - DNA, 1199 bp, Homo sapiens
aagaatttcttgaacccgtgaggcagaggttgcacttagctgagatcatgccactgcactccagcctaggcaacagagcgagaccttatctcaagcaaacaacaacaaaagaagctctttttctctaacttaagatggttaagatggtttttatttgtggctagaactgctgttaaaaaaaaaaaaaaaaccttttgtcaacatttataccttcagtaaaaatctaaactcttttttacataattgagtggcctcgtttatgattgactaaataaaggtaaattgttatttttataaacttttttatacaagagcattacagtttttaaatagtgatattttttactgatatttccagaaatagtaaccagaaattagaaaagtaattagacatttacacaatgtgaacacattatcttttagtagtatgaattgggtcccaaaatgaaggttttaaaaattgtcttttacagaataccaggaaaaacctacatgataatagcttttctaactgtgggtactatggggttatcaaacacttccttgggctacctgaattaccctacccaagtcatcttcaagtgctgcaaattgattcctgttatgctaggaggagtttttattcaaggtatagtaatgatatgtttttatactatttaaaactaataggctatgttatggcatctagcattaggaaaaacattaaacttctattacattttcaatgagcattctagatattgtaacaattctgaattatgtcttaccaaaataaggtattctaaaaacactgatggccaggcacagtggctcacgcctgtaatcccagcactgtgggatgccaaggtgggcagatcacaaggtcaggagttcgagaccagcctggccaatatggtgaaaccctgtctctactaaaaatacaaaaattagctaggcatggtggtgtatccatgtagtctcagctacttgggaggctgaggcagacgaattgcttgaacccaggaggcagaggttgcagtgagccgaggtcacaccactgcactccagcctgggcgacagagcgagactccatctcaaaacaaacaaacaaacaaacaaacaaacacttatatgccttagtttctgaagtcagtaatttggacttaagaaaaagaaaagataatactttgtttttattattttattttggaatctaccac

SEQ ID NO: 119574 - DNA, 1061 bp, Homo sapiens
aggaagccacagttgggagttggaggctctaagtaacagcagagccccttacagcctgcgagatccatgctggatcttggtttgtttttcaacaaacgggtgttgttttctcaaattcactccaagaggaagctgtgattataaatcaaatgacttattcaacggctccaagcctgttaagagtggccttggtccacggaaactttctgacacataatccagggctttttttttttttttttagacggagtttcgctcttgttgcctgggctggagtgcgatggcacgatctcggctcaccgcaaccttcgcctcccggggttcaagcgattctcctgcctcagcctcctgagtagctggaattaacaggcatgcgccaccacgcccggctaattttgtattttcagtagagacagggtttctccatgttggtcaggctggtctctaactcaatccagggctctttttaaccatactatttaagccctgttgctggaagcctgtggttataacctatgcttaaaaagaaatagtgatgaggataaagcagggtaccgaacttgtcaagagaaaacacataaataagaaagagcaggcagagaggaggacaggaaaaggttgtctttttgaaaaaggacaaaatgatacaaaaattagccaggcatggtggtgcatacctgtaagcccagctacttgggaggctgaggcaggagaatcacttgaacctgggaggccgaggttgcaatgagctgagattgtgccgttgcactccagcctgagtcacaaaagcaaaactctgtcccccaccccccaaaaaaaagaaaaggaaagaaagaaaagaaaaaggacaaaatgtgttgcccttcagattaaaaaccagtttaatccaagctgttcttcctctgagactgcatcaggctttcacagacactgagaaagtttccatcggcccacccccccggtttctaatttgggcacacaggtgatgtcatggtaaaatgaatatgtgaaaagtgctttgggcatcatatggtccatgaataattaaggtgaggatgatg

SEQ ID NO: 119575 - DNA, 1007 bp, Homo sapiens
agtgagacactgtctctattttttttcaagaagttaaaacaaacaaacaaacaaaaaaaccttattgcaccttaaagatttctaggctgagcgcagtggctcacacctgtaatcccagcactttgggaggctgaagtgggcggatcacaaggtcaggagttcgagaccagcctggccaacatggtgaaaccccgtctctactaaaaataccaaaaattagccaggcgtggtggcgcatgcctgtaatcccagcttctcagaaggctgaggcagtagaatcgcttgaacccaggaggcggaggttgcagtgagccaagatcacgtcatcgcactccagcggagactctgtctcaaaaaaaaaaaaaaaaagatttctagactagtacctccattttatagatgaagaaacttcaatgtgattacatgatgtgctcaaatcccacagctagtaagcaaatgcaccaattataaaccaggtctcctaagcctgatgttctttttaggttgactttcaataaggtctcaattgttgctaaatcaattccatctctcctttggtccaagttccaaatgatttttgaataatctcaagttgtttatagtgaaccaatttagtcctgctagttcaattcaaaataagaattcatatttgcagttcaaaggaaaaagtaactggaacctgtatgaagatcacagtcctggtttctttggattgctggttcaaccctggatgcacattacgatcatctggggcttctaaaaataactaagccagggcctgtttccctccttggggcaagacctaactattgatatttgtacagcttccaagtgattctcatgtacagccaggggtgtaaaccattgcaggtgcttgttttagatattggcatacaaagcttcataggcttagaattctctttaagtctgtgattttctcagagccagaaggggaagtatagtgatcaaaagaaattagggctcaggaaagtctggtggggaaagca

SEQ ID NO: 119576 - DNA, 1441 bp, Homo sapiens
tttgggggagatccaagcttccaaaggctaaatatctcagaccctttgaggctgactcaagtttgcacatcttttatcaatggaaaaacacgtttcctgtggaaaaacaaactaatgatccatgagaagtcttcttgcaaggaatacttgacccagagccactacatcacagcccctttatctaaggaagaagctgactttcccttggcatatataatggtcatccatcatcactttgacacctttgcaaggctcttcagggctatttacatgccccaaaatatctactgtgttcatgtggatgaaaaagcaacaactgaatttaaagatgcggtagagcaactattaagctgcttcccaaacgcttttctggcttccaagatggaacccgttgtctatggagggatctccaggctccaggctgacctgaactgcatcagagatctttctgccttcgaggtctcatggaagtacgttatcaacacctgtgggcaagacttccccctgaaaaccaacaaggaaatagttcagtatctgaaaggatttaaaggtaaaaatatcaccccaggggtgctgcccccagctcatgcaattggacggactaaatatgtccaccaagagcacctgggcaaagagctttcctatgtgataagaacaacagcgttgaaaccgcctcccccccataatctcacaatttactttggctctgcctatgtggctctatcaagagagtttgccaactttgttctgcatgacccacgggctgttgatttgctccagtggtccaaggacactttcagtcctgatgagcatttctgggtgacactcaataggattccaggtacgtacaattccatatttcatgcaaaagaaatgtgtcgtatttgaaagggctttagaataaccagccactttttattaggaagtagaagatgaaaactggaacatatatagttctcaccctagtcctttctaaatgcagaaagatgttcttttttttttttgagactggatctcactctgtggcccaggctggagtgcaggggcaacatcatggctcactgaaccctggacctcctgggctccagcaatcctcccacttcagtctcctgagtagctgggactacaggtgcacaccaccatactgggctaatttttaaaaaaaattttgtgcagacagggtctcgctatgttgcccaggctggtctccaactccacagctcaagctatcctccccatcttggcctcccaaaatgctgggattatagccatgagccaccatgcctagcccagaatgatgttctttatgtgataattcacatgttctagcactactaagtaatacctttccatgctatcacttggtggtccatcaagttctttttcacacatcatcttattacatctttaccacaatagctgttagtccacactggtgttc

SEQ ID NO: 119577 - DNA, 1017 bp, Homo sapiens
cccgaattttcctatctttactaatttaccagaccgattgttttttaaagtgtataaaacatgatgggatttcttctgaagaaaacagcgtgctttggactcaatgaaaaatacaaaatggatctctgatgaactagacagcattattatagcaagagaaaagcaatcattgttctggctgttgggggattgccaagttcgaaaggctggtaggtgctctcaggctgcagggcagggcctgctgggcgataaacacgccggcattctctggaaaataccatgcctggtgtttgaatcccagggtgactttcctggtgaatgcggctcactcgtatgctgcgcacactgtttccgcacctgcctctgcctgggttcatcctctcttcacctttgatctgttgtttccaccattcgcatatcattgaggagcattaggtacttaggagctgattttcatatttaaatatttattccctttctattttcattctttccttaaaattcataaaagttgggtcccagtcaagtggttccttaagtattgtgctgagatgagggcatttcataagttaacaaaagtctaaattgttgctttttttttttttttttagaaaaacatgggttttggtttctattaaatgtaaatatctgtggttattttgccagaagcctggtcagttttatcaatgtcaaataatataagaaaatcaagggaaaaagaattccccttttttccttacccctttctgatctcttgggagaccaaaagaatgatatctggataggtgtaggagagaatgctatctagatgggtataggagagaacgacatctacatgggtagaggagagaatgctaccttttcttctcttttttaggagagagaacaccttttttgctgtaggtttatgccatggcatgctggcttctgccttctcactgcaacagtgtggccccatgtaaatcatagaacctcatgggacctcaaatctctccagctacaaaatggggaacccag

SEQ ID NO: 119578 - DNA, 1034 bp, Homo sapiens
tggttttacacttgagcattctttgtgatttaagatttggcatgtgaatctggttcttatataaccacacagccgttaatcaatatcagctcttctattttttttgagacagagtctcactctgtagcccaggctggagtgcagtggtgcgatctcggcttactgcaacctctgcctcccgggctcaagtgattcttgtgcctcagcctcctgagtagctaggattataggcccccaccatcacgcccggttaatttttttgtattttagtagagacggggtttcaccatgttgcccaggggtagtctcgaattcctgagctcaggcgatccgcccacctcggcctcccaaagtgctgggattacaggcatgagccactgcgccgggctgagctcttctattttcaatgtcatgttttaagaggaaaaattcttctgtccgtacagggtaaacatctttttgcaaacgtgcaagtgcaggtggtgctgttcatttcttccctcaaagcgaccgcctccctttctcctaaataccttaaattaaaatgtgttagcaagaccctgtgcaggcatttcaggtttcccaaaacacccccaagagcaatgtgaccgagaaaatgattagtaccttagaattagatggtttcagaaaacaaagtgaaaatcggttcgaattggcgagactgaatagaagggatattcatagaagtagcagtaaatcacagagcttcacactgccttttttttttcttggtgcctttctactgagagtgacttctcttttggttttcaaccactaggctctctctacactgttagaaatggtgatacaacaggccagaaagaggtccttaggggccccagtctctcactccttttcaggggaaccaggtaaagtggttgtccttctcttctgtgtggcttgtgcacagatggggtgtctagccccctcccttctgcttacattctcaaaggaaattctccaggaccacagatttctctgacccacgttacagagcatcaggctgtgacagc

SEQ ID NO: 119579 - DNA, 1050 bp, Homo sapiens
ggtacacccttatattttctaacatctctgagctttgtaatgattgctctaagtcactttaagaaaaacccatgtgctctagctctcccggctcttctttcagaattttcttttctttttctttttttttgagacagagtttcactcttgcccaggctagagtgcaatggcacgatcttggctcaccgcaacctccgcctcctgggttcaagcgattctcctgcctcagcctcccaagtagctgggattacaggcatgtgccaccatgcctggctaattttgtatttttagtagagacggggtttctccgtgttggtcaggctggtctcgaactcccgacctcagccgatatgcccaccttggcctcccagagtgctgggattacaggtatgaaccactgtgcctggcttttgcagcattttcatctgcctatcttccccaaggcagagcacctgaagccatttaatttttgctttacgctttgtgaaattgttcagcatctacccaagtggccgctggttgatcttcttcccagtccattcccatggctagaatgtcttcttacacttcagggtggtttcgtctctaaggaacagagctaccccactctttggcttcagctcctgtttttccctcgctgcactaagtgtgcttttggagtctttgctcattcattactctgacctttctcatgccatgatatttttcttccataagaatgttttcatttatttcgtttcctttttccattttgtatacgttttcctttttttttttcagggcccttttgtcaaattctctcaacctcagaagggatcacatgatcccatttcctcattttttaattctaaaaatatcgtgtttcctactttgatttattttgctttttaaactgtgacttttatttatatgtgcacattctttgggagggtgttaggactctttcggttgcaagtgtcagaaactcaactcaaaggagcttaaacaagcaccagaagttaccgggtcacacatctgagatgcccaagggagctcccaatcaagctggat

SEQ ID NO: 119580 - DNA, 1016 bp, Homo sapiens
attccagccctggcaacagagcaagatgctatctcaaagaaaaagaaaaaagatgaaagggaagactgaccatgttggaatgtggtgcattcctaagggatatctctagaggaatattaacttttaggcctttttccctttactcattgactctgcaacctcacctctgtgtaagatgtatagctactgtacatatttcttggatgtattgaacagctaataattgccagagccagggcacaaattgatctcttcttacttctaatccagtcctctgtctcctgtccacaatgcaatgtatagaatcgatcttttctggaagttgttactgagaaaggcagatagggttaaaagtgctagcaagagaattatcaaagacggaagccagcaaaatttatcatggagttttgactttgccctcgaactctcagccgaaacctcaagataatgaaaaggtgatcactttgccaatgataaatggattttataatccctcactgagaaagttgaatgtaaatgaagagctctgttcttttcatcttcttgcttactgactattgaaatgagacttagctatcggtggaattttggagctactattctcagtgaaattcagaattcgagaaatgttttcaggaaacatcctcctcagttcttgcctcagtttacttcgtggctcttgcagttctttccccctttgtgatctcatttacatctgcagtttctcaccaccacctcagtactgaccattcacttccctgtagtgagctcccaggccttctgccacatctccttgttttttggatatctcttctcgaagcttccacgagtgcctgctgacatctccctactccccacacacccagctttccactcacagtctctgtggtatggccatccttcaagtcagccaacttccccacttctggtaccccaggatccagccagcacattccatacgttttgtctgtgagagttttctagcaagttctacccttcctgttttcatcattact

SEQ ID NO: 119581 - DNA, 1085 bp, Homo sapiens
caaaacaaacctactgctagggccagccactcagaaggcatcacatgctagtctcagtctgttcatctaaaccactgtaaataagtcaggacaaatgatgtacatggttttggggttttgttttatgtatgtatttatttattttttattttttattttttgagatggagttttgctcttgttgcccaggctggagtgcaatggcgtgatctgggctcactgcaacctctgcctcctaggttcaagtgattctcctgcctcatcctccctcgtagctgggattacaggcatgcaccaccccacctggctaattttgtatttttagtagagacagggtttctccatgatggtcaggctggtctcgaactcccaacctcaggtgatctgccctccttggcctcccaaaatgctgggattaccggcatgaaccactgcacccggcctcatttatttatttttggatactgctgttttgaactataaatcatgctgccactcccatctgcagactgctttggctacatcatgttgaaagatttcttgagtttgttttgcattggcacttatcagagctccttattgtaggatcaaggcttgaggcaaagagaagggaaaaaaccgactgaacctgcaatagaagacctttgcctctcttttctcactccaactttccccttctgttctccacaagacctgccaaggacaaattttacagaaaagggtgtggttctagtaagaatgaagagacatgaaggcatcaaaatgggttattggattgttcccttcatacagtcacatttctagagtgtgtgtgaatatacataataaaatagtaatatatatatatacacacacttatatgtatatataaatatatttatgtgtatatatgtatatatcatatgtattatatgtatatatttaaaaatacacatgtaatatatattttaaatatgcatacaaaaatatatctcttaaagtacatataaaaaacatttataaatgcatatatgatatattcatatatgtatgtgtataaaatattttatataaaatatatttttatataatatataaaatttatt

SEQ ID NO: 119582 - DNA, 1822 bp, Homo sapiens
tgtataatatatatcatatatatttaaatatatataaactatatataaaatatttatatatttatataaatatatatattttttttcccatgggctaaaggggaggcagtgatggggaagaaaagagtggaatttaacctccgggaataaagcatttgaaaaccttaaggtaaatgctttttttttccattactaagaacagaaatcaaaatatcagttcattatgagggtcagaagtgttggatattttccaaaagagaaacaacaacaacaacaatcatagctaatgcttatggaacatctaccaggtgcccggattcttgccaaaccctcaacaagaggtatctcatttagtcttgacaaccatttgaaataagagccactgttctttatcttttcacagtgggaggacctggttgtgtaaagaggttaagtaactttacccaggcactgtgagcagctgggatttagccaaacagactggcttcagcacctggaccagggagctgtggaattaaggctctggtttctatccagctgaatgacattggggagaatatttttaaaggcctcaatgtgctcatctgtaaaaataacggggttgtgatgggtgatctcaaagatccccgccaactctctagcagctcaccaaattaatatccaaatcaatatccatcgcatccacggcactgttgccattcattcctacagttcactgtaggaagttaaggggtggagtggagcagagagggggcagggaaatggctgcattgtgaatcaaatgttttcctaacaggagcagctgttccaactggcacaagccccggcaggtacgattgctaggtgactacaggagtgagatgggagcagggcccactcttaacatgcctcgtgtggctgccacagttgatcctttagttgaccagttaatttctcccttggaagtgtccttaccgtccgcatcaatccccagtgcacttcacattggctgcgagatcgcttgcagcactgcaagcaggtgaactctgagaaccctctgtaatgcgaccagacctgtgcttttcctggttcccctgaattacactggctgatacttccaggaattctgcagcagccctggtggttttgttctttcttcagaaaaggaagttggagagggggttgggtgggaaggagaatgagaatcctttaagttctttgaaatgacctcaaatctgaggttgtcaggcttttaaagagagccagtaggtagtcactccacatattgtagataatactgtgtcaacagctcaagttatctgaagctctctttgtgaaatgggacccaacttttgctctctgggaacactatcacatttctctctggcatgcaaacttaggtgtgtttgatgaagggagcctgcctctccactcctgtgggtatttcttgcaaggtggagatgagagactgagaaaagaaataagacacagagacaaagtacagaggaagaaaagtgggccctgggggaccggcgcttagtaagtgaggaccaacaccggtgctcacttactctgagtctctgagttctctcagtatttattgatcactatttttcctatcttggcgaggggaatgtggtggggctatagggtgaaggtggggagagggtcagcagaaaaacatgtgagtaaaggaatctgtgtcataaataagtttaaggaaaagtgctgggcctaaatgtacacgtaggctagatttatatttaactttacataaacatctcagtgcagtaaagagtagtattgctgccatgatgtctcacctgtatccataaggcgattt

SEQ ID NO: 119583 - DNA, 3278 bp, Homo sapiens
ttgtgggaaaatatattaccatcacctttgcgaagtgtcccttgcaaggattacctgacccagaatcactacatcacaagtcccctgtcggaagaagaggctgcattccctttggcctatgtcatggtcatccataaggactttgacacctttgaaaggctctttagggctatctatatgccccaaaatgtctactgtgttcacgtggatgagaaagccccagctgagtataaggaatctgtgaggcagttactgagttgcttccaaaatgctttcattgcttcaaagacagagtctgtggtttatgcaggcatttccagactccaggctgacctgaactgtctgaaagaccttgtcgcctctgaggttccctggaagtacgtcatcaacacctgtggacaagacttccccctgaaaaccaaccgggagatagttcagcatctgaaaggatttaaagggaaaaatatcaccccaggggtgctgcctcctgaccatgcaattaagcgaactaaatatgtccaccaagagcatacagataaaggtggcttttttgtgaaaaatactaatattttgaaaacttcacctccacatcagctgaccatctactttggcactgcctatgtggcgcttaccagagactttgtcgactttgttctacgtgaccaaagggccattgatctactacaatggtcaaaagatacctatagtcctgatgagcatttctgggtgacacttaatagggtttcaggtaggtactaatttccattctgattgatagattgagtttgctaacattctgctcgcctagagaactgactcatttgaaattattatgaaataaatttaaatacttagaaaactattagtttggttgcttgtagcaacagtgtattgctgactgttgtcttatcaatatgtgtgatatagtgatctaagaaatgctggctgcagtcgccccagcaaaactaactttgattacatagttgctgaattttaactgttgtttgaattaatacttttcgtagtccttgataaacacagctgtaacaaacaaaattgacttttaaaataagcattctagaatttaggagttgaaataggtgatgtttctttcggacggatgttagacatcgctttcattgatgcagtctcattgctcaaagttcatggagctgttacaggggtacttactggttttagaatcttggaagctgcttcggatattcacaaatcaccattctggctgaaacatctctggtttaagatctgaacaagtagccaggtctcagctcttcttgtttctacaaatctaacctgatattttagcctggaggagtgggtaacaaagagttggaacatacggagagagaatctagctacagatgatccaaagagaattctcaatttttaagtcataggtttttattggacattccaatttgcagcttcttgtttttatatactgtgcagtctttggttgtttatgataatttgggaaagcgtccaaggtatgccaggcagctgaggcagaagatagcaccaagctccctcgttggttcaggactgggtttcttttctaaactctgtttcccataggtggtctgtgacctgcgttacgtctttcctgtgtgtccccacgtgcttgttttcaacagtgacccagcatggttgtgggtgactggtggttctcatgagcacagtgaccccgacaagcctcacatacttcctgtctacacacacacactgcacaaccacaccacacatacatacacacctgcctgccattcttgaaataactcccagctcttatgtctagtgtcattatcattggcatactttcaagtgctgtttgaagccacctcttgcctgaaagtagactcaatgcagaaaggtccccaataacacggcattcctaagagctaaactagagtggtggtcacaaaaatctacttagagagggacagaaagaggatgggcaaggtggctggagacgagagaattatgctgtctcatgcgcaatttattttcagagatgctaaactgtcaggtcacaaagacttgtaggaggggtggtgaaccaacatttatcacagtggtgagagcgttaaccctttctttacaatcacctattttaaacgcatgtaaatactgcatgcgtggcatttaatcttatttttgttggtatagttggtgatagcctacatcgttccttttaatgataggaagtcatcgtgttagcctcacgtacagatgaaaaacatgaggcttagagagactgaagcaatagtatgttcacgttgttcacatagcttttcataggcaaagctggaatctgaccctgcatttgtgtggcctgaagtgtgagccgtttctcttgcactaggaaaagaaggaatgagcatttcttttttcctgtatatctaaagcaaatttcctgcagaatcccgaaaaagggaaaggattgagggtgtttggaaaaaatgaggagggctgtggaaggaagtttcacctgatcacttagagctggagatgaggttagcagggatatggtgtgtgtgtgtgtggtgtcccaatatgcttgtgtggtgtgtgtgtggtgtgtttgtagtgtgtgtgtgatgtgtgtgtgtgtgtgtgtgtgtggtgtatgtgtgtttgcagtgtatgtgtgtggtgtgtgtgtggtgtgtatgtgtatgtgtgtggggtatgtgtgtttgtagcgtgtgtgttgtgtggtgtgtgtgtagtgtgtggtgtgtttgtagtgcggtgtgtgtgtttgtagtgtgtgtggtgtgtgtgtatgtatggtgtggttgtgtggtgtgggtgtgtgtgtggtgtgtatatgtggtgtatgtgcgtggtatgtgtatggtgtgtgtgtggtgtgtgtgtagtgtgtggcgtgtttgtagtgtggtgtgtgtgtagtgtgtgtgtggtgtgtgtgtatgtgtggtgtggttatgtggtgtgggtgtgtgtgcgtgtggtgtgtgtgtggtgtatgtgcgtcatgtgtgtatggtgtgtgtggtgtgtgtgtttgcagtgtatgtatctggtgtgtgtgtggtgtgtatgtacatgtgtggggtgtgtgtgtttctagtgtgtgtggtgtgtagtgtgtggtgtgtttgtagtgtggtgtgtttgtagtgtgtgtgtagtgtgtggtgtgtttctagtgtgtgtttgtagtgtggtgtgtgtttgtagtgtgtggtgtgggtgtatgtgtggtgtgggtgtgtgcgtgtctgtgtaga

SEQ ID NO: 119584 - DNA, 1995 bp, Homo sapiens
ctcgatctcctgacctcatgatctgcccgcctcggcctcccaaagtgctgggattacaggcatgagccaccgcgcccggcctaattttgacctatctttttatggctttttaatgacatcctctcataaagaatgtccttcgtgtttgatgcccttcctgtctaactcttcatcctttatgtctaactctgtctaactcttcatcctatatggcccaccttggaagtcacttcctctggatgccatgtctgatcaccttcctcccagatcgtgtttcaactctgggttctcctggacctaatgccactgctgccagcattgaattgtagtcacctattaactgaatagctcttctaccagacctcctcagtatttgagctccttaagcataagaaaagtgacatctgtctttgtgttctccaccactactcctacgctgcatgcatcactatgcacctgcctgatctgatgatatgcagggtgctagatggatgtggaagggtcgggaggggcaggaatgtgctggagagttctgagaagatgggcagaacctatgaaagtgtaccctgtacctaggatgggggataatttttggtagtagggattggagaaacagtaggtaaaactccacaatggccaggccaacaaatgatatcagtaaatatgagagagtcctgaaagaattagcgagccccactttattccagataaaatgttaatgggatagagtctttccttagaaaatgtggctcccacacagccaacctgggcccatgatgcagtcggattctgatgccaagagaaagtcacagcaggcggcgtatgcagacgcctccacttagtttctgccttccttgcacctggtgtgagtttcttccacacctgccacccactccctcctcctgctagtaccactcccgggctactcacattcatgcactgggcttcttctcacttaatttaatgtagacttctcctgaattgttggcttaggaaaaaaaccaagactataagaatatgagaggctaagaagagacaacaatagaaagaaactcaaaacgtctctccagctctcaacaactgtaaacactgagctatttagaaggtatatgttctctgcaggaaggtcactgggaccttacgtctgggtgtggctgaatcagtcccagtctttttcaaagtatgcattgtgttctctctacatcagcccagactttgaattcagtttctaggaccacaaaggattcattcactcatgctgattggacccgtgactgagaattaattacaaacgttgaatgatggggtagaatcatgtcttaacaaacgtcaccaggacgttcgagtctaaaataacgctacttgggggggctggaggacaatccacactgacatttgtcttgtcaatatggagataaattctggctgaaggagaaattccacaaaacagatacttccataggttcgtatccattgaacagactcttaaaataatatttttggatagccagatgatattaagtatgcataataaatgagaacatgattttcaaaatattgcgttagtgatgtggaccagtctggcttatttaacctcttcagtaaagggctctaggctcttcccaggtcagtaattcaggtaggatcacaggggaagattttaatttacaatgtatcccagctcttgtgagcacctagattgatgggtctacatcataagatgctgggctcctggtagagaaaccttaggcaggttataaagtatttacacagtaaattatgctgacgctatagccatttgtagaatcatttgtgacgtttccagccactggctccattgtactatttgggaaggatcatctccttcattggagaatctgtaccctaacatttctgttcgccacccctaaaaaggaaataattgggaaacgctactcttaatgagctcttttatttttatttgtttgtttgtttgtttgtttatttatttgagac

SEQ ID NO: 119585 - DNA, 1022 bp, Homo sapiens
cattcatcctcctgtcattccttatcgattgtataagacagttttttctagaagcaggagttgtttttgtctttgttttgttttgagatagggtctccctctgtcacctagactggagtgcagtggcattaatttagctcactgcagcctcagccttctgggctcaagtaatcctcctgcctcaggctgccaagtagcaaggactacaggtatgcaccactacacctggctcatttttaaattttgtgtagagatgggatctcgatatgttgcccaggctggtctcaaactccagggctcaattgattctctcctcagcctcctacaagtgctgagattacaggtgtgagccattgcacctagacagttgtctttgttttaaatgaagtattgcattttgatggcttctaaaaacaataaaatattagtggtatatcaaagctatatataattgatatatgtatatatcaatgtccatagtacaatgatcaatatatactcgacgtctaaattatctcttgaaaatacatatctcttccctatttctctttacacaatacaaaagcatctccttccatcctcctttgtttgagcccacatgctatcaggtaaacgactttggagacagacgtagtgtaagtctgtcctcccaatacttgccaactgtgtgacactggtgttagtttacactgagccttagtttactcatctgtgatgatggagataataaatagtacttagttcccagagaagttgtgagtattaaataagctaatgcatatagtacaggggttcctagacttggccatgcctcagaaccttctgcaggtcctgttaaagcacagatttctgggccctaccccgaagtttctgattcagcaggtctggagcagtccccagaatttgcatttctaacagtttcctgggttatcctgcagcttctcatctgggggccacactttgagaactgctgacacggaccatcttttacagagactggcacatgtatagatttgcagcaa

SEQ ID NO: 119586 - DNA, 1202 bp, Homo sapiens
gttaattttggttttaggacattaaagaaagtttttaaggtgtttgagaatttattagaaagtaggaattgccttttttttttttttttttttgagacacgatcttactctatcacccaggctggagtgcagtggcatgatctcggctcactgcaacctctgcctcctgggctcaagcaattctcgtgcctcagccttccgagtagctgggactacaggtgtgccctaccatgccaggcgaattttttgtatttttagtagagacggttttgccatgttgcccaggctggtgtcaaactcccgagctcaagcaatctgcttgcctcagccccccagagtgctgggattataggtactagccaccacgcccggccaggaattgtcttaattcaacttccaccccataaaatatatctggaattggtctggagacagtcttatagcagtgactacgacttgctaacatttcttttcaaagatatttgtaaaagggctagaagaatctctgggtgtctccaaggctatgagggtttttgttgttgttgttgttttgctttttttgttagagatggggtctcactctgttgcccaggctggtcttgaactcctgggctcaagcaatcctctcaccttgtcctcccagagtgctgggattataggcgtgagccaccacgcctggccaggatgtgagtgttgatgaccccagaagacactaaggattggaacagtagctcatgaactttgactttttaaacacttcacactgcacagttaaaaacagtagaatactaagcaaatggaaagtaaggattatgagccatgcgtgaatgtttaattttctttttttaaaaaagtgctttcgagtactgtgtaagagaggctagtgacttagatacccacactatacaattctgttctaaattttaacctttgtctgtagataactgtttggccttgggcatgtcacttaacctctctgggcctcagtttcctcatgtgtaaaatgaggaaattgggctaggtcatctccgaagagattcctgtattattttgctttaactctggagcatgcagtgaaaaaagcagaagtatttgaggcaggcagacttaggttttgtttccctgctgtcagatcttgagcaattaacgtatcttaacatgggcttccggtgacttatctgtaaattgaggacaataccaat

SEQ ID NO: 119587 - DNA, 1142 bp, Homo sapiens
aagtgatccacctgcctcagcttcccaaagtgctgggattacaggtgtgagccactgtgcctgacagtcttttttttttttttttttttttaataatgctatcttaaggtttttgtttgcttgtttgttttttggtttgttgtttgtttgtttgtttgtttgttttgagatggagtcttgctctatcaccaggctggagtgcagtggtgcaatcttggctcactgcaacctccgccgccccggttcaaacgattctcttgcctcagcctcccatgtagctgggattacaggcgcacgccaccacgcccggctaatttttttgtattttagtagagatgaggtttcacaatgttggccagcatggtctcgatctcctgacctcatgtgatccgcccgcttcggcctcccaaagtgctgggattacagacgtgagccaccgcgcccagcctatgctttcttaatgattgttacttgtaggtattagatttcataatgtgtttttttatttgatctttgttttttgtactttaatgtattatttgaaattattctaataaccactgtcctatttggcagaagttacagaataatagttttaagagaaaataagtaaagactcacaaggtaaatatgccaaaatgctaacactagctaatttgagggagttggaaaataaacaattggctacttctttgaacttttctgtactttgaaaatctccaagacttaaagaaagttgctgtatttggtgaaaaataaactctctccttactgagacataatacttggtgctttagtgctatagataatactatgaagtattatctctgggccaggtgtgctggctcacgcttgtaattccagcactttgagaggccaaggcaggtgggtgtctcaaacccaggagtttgagaccagcctgggcaacatggtgaaaccccatttctacgaaaaatacaaaaattagccaggcacggtggcacatccagctagtcccagctacttgggaggctgaggtgggatcacttgagtctggggaggttgaggctgtggtgacctgtgattgcaccactgcagttcagcctgggtgacagagtgagaccttgtctcaaaaaaaagaaaaagaaaaagaaagaaaaatg

SEQ ID NO: 119588 - DNA, 3782 bp, Homo sapiens
tgactgagtcaatggggccacccttgcattgggaatggacgcgcgttcattcctttaacattggttgagagtctcctggtggccaagtgctatgaagtcaaaggcactgtgagaactggtcctctgctcagtgcagctttttcctataacaggtgggctgatgccttcaaggaggtgatgtgagagatccgttaaaatgcatatattcctagcagtgggaacaagttagttacaattaacccaaggatatagggaccagattcactcacaagagaagattttgagtgagaatagttagtaagagactaacctacaaacctgatgaagactgagggagagaggtcaaggaggggaggaaaaaaggacagtgctgttgctccccaggacaagctgcatcctcctcccagtgttgcttacagctgagagctactcacacttgatcacacacaagaatcttctggggattttgtgaagatgctgacgttggatgttgatacaagaggcctggcgtgggtctcaatttcttttttgagacaggatctcactgtgttacccaggctaaagtgcagtggcctgattttggctcactgcagccttgacctcccatgctcagatgatccttccacctcagtctcccgaacacctggggccccaggcgcacatcacaacacccagctaatttttgtattttcatagagatgggatttctgtatgttgcccaggctggtctgaaactcctggattcaagagatctacctgcctgttacaggaaagggatcccgatccagaccccaagagagggttcttggatcttgcaaaagaatgaattcagggtgagtcttcagtgcaaagtgaaagcaagtttattaagaaagtaaaggaataaaagaatggccactccatagacagagcaaccccgagggctgctggttgcccatttttatggttatttcttgaagatacactaaacaaggagtggattattacccccgtttagaccatagagggcaacttcctgacattgctatggcagtggtgggagtgtagcaggacgaccagagattgctctcatcgccactttggttttggtgggttttgggcggctcctttactgcaaactgtttatatcagcaaggtctttatgacctgtattttgtgctgactcctgtctcatcctgctatgtctggaattggtgggttcttggtctcactgacttcaagaatgaagctgcggactctcgcagtgagtgttacagttcttaaaagcagcgggtctggagtttgttccctctaatgtttggatgtgttcagagttttttccttctggtgggttcgtggtctcgctagctcaggagtgaagctgtagacctttgcagtgagcgttatatctttcaaggcggtgcgtttggaattgtttgttcctaccagtgggttcgtggttttgctggcttcaggagtaaagttgcagaccttcgtggtgagtgttaccactcatataggctgtatggacccaaacagtaagcagtacaaagatttattgcaaaggacaaaagaacagcacttccacagtgtggaaagcaacctaaacagggtaccgctgttagttttgtcagcctgcttttattctcttatctggccccacccacatcctgctgattggtctgttttacagagagctgattggtgcatttacaatccctgagctagacacaaaagttctccacctccccactagattagctagacacagagtgctgattggtgcatttacaaaccctgagctagatacagagtgccgattgctgcattcacaatcccttagacataaaggttctccaagtcctcaccagagtaactagatacagagtgccgattggtgcactcacaaaccctgagctagacacagggtgctgattggtgtgtttacaaaccttgaggtagatacagagtgctgattgctgtatttacaatcccttagctagacataaagtttctccaagacccaaccagagtaactagacacagagtgccaattggtgcattcacaaaacctgagctagacacagggtgctgattggtgtgtttacaaaccttgagctagagacagagtgctgattggtgtatttacaatcccttagctagacataaaggttctccacgtccccaccagactcaggagcccagctggctttacccagtggatcccgcaccagggccgcaggtggagctgcctgccagtcccactccgtgcgcctgcactccttagcctttgggcggtcgatgggactgggcaccatggagcagggaggggtgctcgttggggaggctctggccgcgcaggagcccatggcggtcggggggaggctcagacatggccggctgcaggtgctgagccctgccccgctgggaggcagctaaggcccagcgagaaatccagcacagcagctgctggcgcaggtgctaagcccctcactgccccgggcggcggggccggccggcttctccgagtgctgggcgcccccagcccacgcccacccggaactcacgctggccggcaagcgctgcgcgcagccctggttcccgccggcgcctctctctccacacctcccagcaagctgagggagctggctctggccttggccagcccagaaaggggctcccacagtgcagccgcgggctgaagggctcctcaagtggggccagagtgggtgccaaggccgaggaggtgccgagagcgagcgagggctgctagcatgctgtcatcgctcaccgtgacttagaatgcgtaaccatctgggaatgcggtccagtaggtttcagccttattttacccagctcctatttaagatggagttgctctggttcacaggcctctgacacctcagcctcccaaagtgctgggaccacaggcatgggccactgcacctggccagagtctgcatttcttcttttttttttttttttttttttgacacagggtctcactctgttgcccaggctggagtgcagtgctgcaacctcggctcactgcaacctccacctcccaggttcaaacaattcttctgcctcagcctactgtgtagcagagactacaggtgcgtgccatcacacccggctaatttttgtatctttagtagagacagggtttcaccacgttggacaggctggtcttgaactcctgacctcaggtgatccgcccgcctcggcctcccaaagtgctgggattacaggtgtgagccaccacgcctggccagattctgcatttctaacaagcttccaggtgctgctgatgcccctactcttaagagccacactcaaaaagcaaggctttgtgcccactcctgccactttctgcgcctcagaattctttgcaaaaagagtagaattcaacttgttctgtttgcccttctttccccttctgcttttaaaaatgtaatgttttaatgcacaaacatgcataatatgtaagcacatacgtgtttgacacctgtcatcaaacagaaagtattgaagttgaggtttggaatttcagtaacacgaggttagtaggtgttatgtgttcattttataaagacagcaggtaattaattataaatgtcacgatcttacctctgcaataatggaatctgtttctgagtaagagtcagtttgggattatcagtattaaagagaatgaaaaaggaagaaaaatgtcttgtgctttcaaaaatagtcatttcaacattaaatgactttttgtcatgggaatgtactcttcatacttttatgatgtagttatttaa

SEQ ID NO: 119589 - DNA, 1012 bp, Homo sapiens
ctgcaacaaattaccacaaattcagcagcttcaacaacataaatatattgtcttacaattctgcaggacaaaagcctgaccaggctgaaatccaggcattggctgggtcaggttcctgtctgtaggctctgaatacaatccatttccttgccttttctagcttctagaggccactcacattcctggctggtggcttcttcccccatcttcaaacagcaaaggcagagtcagagtggagccttcttacatcgtgtcactctgtccagctcttctgtttccttcttccaatgttgaggacccttgtgattacatttggctcacccagataattcaggataacctccctattttaaggtcagctgatcagcaactttaatctccctttgctgtgtaaaataacatattctcaggttccagggattaggatgtaggcatctttgtctgttctgcatgtgtgtgtttgagggagtgagtgggtggaggccattattctgcctaccacaatatatcttatcagtaattaaaaagaatcttctaagagaggactattgaaatttgggtacagatagcatttgcacagtgccattgcatcaaaattcagattgcattactcactggtggaaaatgctgtaactctaaagcaaagtatttctcttttagttgcatttatgttgactcccatgttttccttttctttttttaattttttttttttattttgagacaggggcctgctctgtaacccaggctggagtacagtggcacaatcatggctcattgcagccttgaccttcctaggctcacatgatcctcccacctcagcctcctaagtagatgggactacaagcacgtgccaccgcactcagctaattttttattttttgtagagacagggtttcattaggttgcccagggatcttcttacctcggcctcctaaagtgctgggattacaggcatgaaccactatgtctggcaacttcttctctagtaatgatttatatattataatct

SEQ ID NO: 119590 - DNA, 2069 bp, Homo sapiens
caattgaggagagggtgctatcggcatctattgggtagaggccaaggatgctgctaaacatcttacaaaacacaggacagcccccacaacaaagaatcatccagcccaaactgtcaatcgcgctgaagtggagaaaccctggcttagcaagatgccaacctacagcaccccacccctcaaccgaattaggtattagtaaatggatcagaattgtattagtatattgatttgtatattgattgaattagatgttatactaattagatgatgagtcaacaactaaaattctggtcaaaagatcaactggaggaaacagaagatgggtagatcagtacataccaatctgtgtgaaatgcgaaaggtaataaactgaaagaaagtaagcctgacttagaggcttaattgatgaaattgatgcccttctctcatgactctcatctctacgcttcttctttatcaacattgcaggtgttcctggctctatgccaaatgcatcctggactggaaacctcagagctataaagtggagtgacatggaagacagacacggaggctgccacggtgaggctctcgttccatgcttctaggccactgcctgttggtgttagcaggaaggtagctgtggaatccagggttctcatggagagagaattgctgctatatttagaccaatctgttagttattggagaagccagaggcttcaagacacagtccttcaaaaataagtttaaacatctcattgatgttctctaacttataattacctagggagatggaaaaatgggttcaaatcagggcggcatgtttttcttcctgctagttttcagctttctttctttctttagagacagggtttcactctgtcattcaagctggagtgcagtggcatgaatgcagctcactgcagcctcaacatcctgggttcaggcctcacacctcagcctcccaagaagctgggaccacaggcgtgcaccaccacacctggctaatttttttttttcttgtagagtcagctttcttgtttattcctcttgctgtgccttctgggagtccagctgttcagaggcgaaagccatcaggaggagaagtgatgtcatgttggcaccgcagagaaagctgggcccccaaccctcaggccagtccctgctccccctacaggcagccttcccagtggcttggagagctgtcggggtttgcacagctctggcatgatggatggcaggttacactagcaagaagggttcccctccaaatggaaaagaactagaaatcctaagtcatttccatttctatagaattttgtgaaggagagtttttatcagtcctggcacacactgcattcagaatattgcccagcatatactgggcatgagtattagtttgctagggctgccataacaaagtggcacagactgggtgcttaatagaaatttatttagttctagaggctggaagtccaagatccaggtgtcagcagggctggtttattaaggcctctctgcttggcttgtagatagcattttctccctgtgttcccacatggtcttccctctgtgcgtgtctgtgtcctaatcgcctcttcttctaaggagaccagtcatattggattatggcccaccctaaaggtctcattttaatttaattacctctttaaagaccctgtctccactctgagacactcagtgttaggattcaacatatgaatttagagagacaaacaattcagtccataatatgcaataaatatttatttagtaagtgattgtttgaacaaatgaatcaatgaatgaatgacaatatggtggtttggccttttctctctatggcaacgagactttgcctctactcctcagtccatcttttttttttttttttttttttttttttgagatggattctcgctctatcaccaggctggagagcagtggcgccatctcagctcactgctgcaacctccaccacccaggttcaagtgattcttctgcctcagcctcccaagtagctgggataacaggtgcatgtcaccacgctcagctaatttttgtatttttagtagagacggggcttc

SEQ ID NO: 119591 - DNA, 1010 bp, Homo sapiens
gatacaacccagctggtatttttgagctattcatgagctactcatgactgaagggaaactgcagctgggaagaggagcctgtttttgtgagagacttttgccttcgtaatgttaaccgtttcaggaccacgtttatagcttcaggacctggctacgtaattatacttaaaatatccactggacactgtgaaatacactaacaggatggctgggtagagcaatctgggcactttggccaattttagtcttgctgtttcttgatgctcacctctatattagtttattgttaggatcaatgataaatttaaatgacctcagatctttgcaccagatactcatcatatacaaatgttttagtaaaaaagagaattgtagataatactgtctaggaaaataagaattaggtttctttgaagaaggaatcttttataacaccttaacagtcaccactgtgctcaaccagacagatagtgaaacagctttctgggtaattcaccaatttcctttaaaacataagctacctgaatggagaatacatcttgtttctgagtttcaacactagcatttttggcttactcatggacaaagttctgtatatagtataaagtcattaacaagaaacaggatatgctttaagacagaattcactgtctgttgcttcagtaaaaggacctcggggaataaaacatttctctcttatatgccagaatgtaggctggtccctatgtcatgtcttccattaagaacactaaaaagtccttgcaagaatggagatatgcattcaagagaggtgctatcacatagatctagtctgaagtctggaacactttcctcttctatgacccctctctccccagtattatcttacttgcaaaatggagaccaaattctatcctgtgaggcttttaattgcaccatagtatgctctgagtagctttacactgcctggtactgatagtagtggctcgatttttaagagccttcaattgtagatgaacatctctgttatt

SEQ ID NO: 119592 - DNA, 1953 bp, Homo sapiens
tggttttctttttcttttcttttctatttctttctttccttcttttttgagatgcagtctttctctgtcacccaggctggagtgcagtggcagagctcggctcactgcaacctccatctcccgggttcaagcgattcttgtgcctcagcctcctgagtagctgggactacaggcacacaccaccacatccagctaatttttgtattttcagtagagacggggtttcgccatgttggccaggctggtattgaactcctgacctcaagtgatctgcctgtctcggtctcccaaagtgctgggattacaggcatgagccacctcgcctagccagtgtttaattttctcttcctgcattagtttgctggggataatggcttccaactccatccacatccctgcaaaggacatgatctcattcctttttatgggtgcataaatcctatttttctaagagttgctaatagataagcttttttctagggaagcaaatgtgggaaaccaaactttccaaagtgagaaataggataatagggagaggaaaatatgaacaaatgaatgagaagtgtgtggaaatggatcaaaacagatctgagtgataaggattggattgtggctgattgggtagctaattcactgtttagaaagtggaagtcatgtggcagtacacctggtttgttccccagattagcttgttagctgattagttttgtttacttctgctcaaactatcctagccagccacctcctaaatttataatttgaagacataaagcaaggacgtgaactgatttgttcaaatctgtatctaaactggagatactctgctgaaaatatttgcatagatttgaacaactgtacttacatgaaaaaatttaaggtatgttttagtaatattaagacattgaggccaggcacagtggctcacacctgtaatcccagcactttgggaggctgaggtgggcagatcacttgggcccaggagttcaagaccagcctgggcaacatggcatggtgaaacactgtatctacaaaaaatacaaaaattagctaggtatattgatgtgcacctgtagtcccagttactcaggaggctgaggtgggaagattgcttgaacccaggaggcagaggttgcagtgggataagatcatgccatagcacttcagcctgggtaacaagagtgaaaccctgcctcaaaaaaaaaaaaaagaaaaagaaaaaaaggtattgagtgttttacttagcatagcatagccttcaaatcagaaatggagtttgcatttaaaatgaatattatttttgcctattttggtttttccataggtacaataacttgcctgaaattctatggcaacaggcatttaatcagtggagcggaagatggactcatctgtatctgggatgcaaagaaatgggaatgcctgaagtcaattaaagctcacaagtgagtcgggctctttccctttggcattctcgatgtgccagtcaagttggggactaacttttggtttcattatagaggacaggtgaccttcctttctattcacccatctggcaagttggccctgtcggttggtacagataaaactttaaggtaagtcattaatgctcaagagcatttatctaaggtgtgtgttttactacagctctccaccatctaaaaatactgttatacaagggaaaggtcaaaagctggtgaaccttttcatagtggttcatagtggtagaatgaaaatgacaagctctgttttctttcttttttttttgagacagagtctcgctctgtctccctgctctgtcgcccaggctggagtgcggcggcgtgatcttggctcactgcaagctccgcctcccaggttcatgccattctcctgcctcagcctcccaagtagctggaactacaggcgcccaccaccacgcccggctattttttgtatttttagtagagacggggt

SEQ ID NO: 119593 - DNA, 1871 bp, Homo sapiens
ttttttgagatggagtctcgctctatcacccaggctggagtgcagtggcgctatctcagctccctacaacctctgccttctgagttcgttattctcctgcctcaccctcccaagcagctgggattacaggcgcgtgccaccatgcttggctaattttttgtattttttggtagagagatggggtttcaccatgtttgccaggctggtctcaaactcctggccttaagtgatccacccaccttggcctcccaaagtgctggcattacaggtgtgagccactgcacctggcccacctttgactttttgaacctagattattttctaaaaaacttgacttgtaaaatgtgttacgaagatgaaataggataatgaatttgaaaatgcacagtataaatatttgctatttttattactatgatcattttatgttttatttacaaaataaataaacttcgtttttttccacttacagatgctcacatagtagaatggtccccaagaggagagcagtatgtagttatcatacagaataaaatagacatctatcagcttgacactgcatccattagtggcaccatcacaaatgaaaagagaatttcctctgttaaatttctttcagtaagtaatcagaaatcattgaccaaagtttgtggtgatggttggaactgttgatgacattctggatgttattactctttttcctctctcctaggagtctgtccttgcagtggctggagatgaagaagttataaggttttttgactgtgattcactagtgtgcctctgcgaatttaaagctcatgaaaacaggtatttttaccaatctttggtgtatatgtctagtcttaataaaaggtatatatgcagtagtttcataagccaggttatatgtttttattaacaactgcagaaataatcagacatatctacatgtacagtatatggtatctgtagtctaataaggtggtggaagatgttatcttcctggcatttaataatgcaaaagtgggccgggagcagtagctcacgcctgtaatcccaacactttgggaggctgaggcgggcggatcaggaggtcaagagatcaagaccatcctggccaacatggtgaaaccccgtctctactaaaaataaaaaaattggtgtggtggtgcacgctggtagtcccagttactcgagagggtgaggcaggagaatcacttgaaccctggaggcggaggttgcagtgagccaagatcgcaccactgcactccaacctggtgacagagtgagactctgtctcaaaaaaaataataataataatgcaaaagtggtgaaattgttttctggactgtcatttacacaaggtattttttaaatgtctgttagacttggagcctgaaatcaagcatatttgaacaaacaaaagactaaacaatcttgagctttgttcccatctacttttgtccttttacataagtccccttgcctacttcttccccctttccatgtgattttttttcctgcaggagaagtgaattgacgttattgagttcctgttttgtgccagcttttattaccttttaatgctttctctatttctagggggtagatagtctcaaagtaagtagttaagtggttggccaatattaccccaatagtggagctgagagctgaacccggttttatctgactcttatatccctgctttctccagtaattttgaaaaaggtgatctaatatacagagttagattttgatgtgatccatttgcatgttctatgtctcaaatgagtcttaattcttatttcttaaacagtggttaagttttaagaaatccatacttagagtactgcagtcagtagtataaaggccttactcttctcctatat

SEQ ID NO: 119594 - DNA, 1076 bp, Homo sapiens
ttatgaatgtttgtttcttctgtttagaaagttcccccatctttactctgtgaaataaacactaatgccaggctgacgtgtcttggagtgtggctagacaaagtggcagacatgaaagaaagccttcctccagctgcagagccttctcctggtaatcgaatttgattgttttgaaattttgaataatctattatctcttaaattgtagaagtggaggagatccagataatttcactttattgacagcttgtgtttatttcattcaaaggggaaaacagtctttttttaaaagcactctcttttgtgttttagtaagtaaagaacagtccaaaattggcaaaaaggagcctggtgacacagtgcacaaagaagaaaagcggtcaaaacctaacacaaagaaacgcggtttaacaggtgacagtaagaaagcaacaaaagaaagtggcctgatatcaaccaagaagaggaaaatggtagaaatgttggaaaagaagaggaaaaagaagaaaataaaaacaatgcagtgaatcacagatgtctcctgaaagaactcttttagatgaaatcattctactcaaatgtaccttaattttttttttttccctgagtaaaagcaagaaatttcttcctttggaaaaaatatatatattaaaaaaccacttttagatggttttttttaaaaaaaaaaaaaaaactggtaaaattacttttggcagacagtgttttatgaattatgtatcatgttgatatataatatgttaatgtgtcatgtaatttttactttgtacaaagcaaataaagatctttctcaaaatatactgtaaaataatataaaatattgaacacattctttatcagatttggatgaaggagtcattattcaaaattttctcttaaatgggaaagaatttaagaactgcctttggcttcttcaaatggtaagtagtaattttagattttcataccaaccagacaaacttaaaagattatacatatataattatacatatctatgaaacaaacatatgcttaagtgtaggaccacgtacctaagattatagagagattgccagact

SEQ ID NO: 119595 - DNA, 1484 bp, Homo sapiens
taccctccccttctgccctcctaacgagaactgtgagttggatgcagaagtttctaaaaaaaaaaattgagtattgaaattggctgttgcatcagtgaagaaaagcaacatccctaccacccctcaaaagagacattaaagtagttggattaagggcacgggagtatttgctttccgatttagtgataatgtgagtgcttaatgaaatgactaacacattccctgattatagagctggtcagtggatcttgctgagtttcctgtggacctatgtgaaatgatcggcatctgttcagggtttactaggtgctaagcacctttacatgtgacatccattgaatgctcacaacacccccaggaaattggtaccagtgttatcctcatggtacagtgaaggatactgagacttaggttgcatagcctgcaggttggacacacttctttctgactgctggggagctgtgcttttaaccactgctgatccggcttgttttccccagatgcaggcctggggtagtctcctttctggactgagaagagaagaatggagaagcccctcttcccattgtgagtagacagtaaatggttagagagtagccaggagcttctggaaaccagagttcctttcctcagctgaaaagaaccctaagagtagactgcctgggatggcgtgcgggatgggaggatcactggacctgtgggccagaaacttgggtttgagtcccagctctagctttgcttagttgtgtgactctcagaaagtcatccaacctctgtggtgcttattttcagtgatagtacctgtgggcacataggacctgtggggaatgattaccttttagccccatcctatgacaatatggtttgtttttaaatccaggttagcactgacttctcactgacttctcttgtgttttcagagtgcctttgcattggtttggctttggctacacagcactggttgtttctggtgggatcgttggctatgtaaaaacaggtagggttttgttgttacttagcctcttaacatcttcacgttgttccagtgaaatgtgagtgcctgtgtccctgagaagcaatctcgtttgactcagctttgctgtaggtccccaagctggagtgcaggcttccttgtcagtcttgcagctcctgcccttgccttttgcttatctggtgaagctgagccaggcctcttgtggaattacttatttttgcctctttatctaaaggtaggcaggggtggttgtagtttgttattatcattgactgccattcatcagccatgacccccaagtgccatctctgggcttaagtaggagtcaacctctggcctacacagactggtattttgaagtttcctcattaggccaggcaggggtgtgtcagtggctgtgcttgtttttgccccctagtccttgcctgcattcccaccccaatccctgcaccagacttcttattctcctgatcttctattttttttttaa

SEQ ID NO: 119596 - DNA, 1091 bp, Homo sapiens
tggttgtcgtttgtcttcagtctgcttcctgccagtgcagcagctcctgctagatcttgacatcctagtggccagatcccaggggcggtgctggtcctatccgagctctctgcctcatctcccattccttttttccacactcagtgtgtattctcttggatttccataccctgttcctcctaccatccacctctctacctgttctcttcctccatgaggtccttttctctcctgtcccttaatgctggtgttccttgggggtctactccaggtctctgcacattcgcagtgcctctgagctggctccttcagcccacaactctgtaaccaccacaccctgatcatcaccaatctccacgcctgcccacttgccctctgcctgccacaacatgaatgtcctctgggtaccatgtctttcccccaatcctgattctcctcctatgttgctattcatggacaacgcaccccccagtcacctgagctgcaaacttaggagtttatatttccctctttccctaccacctccaccccgtgaacctgcttagttcccttcttcttcaccctctgccactgctgtggttcagaccctcatcctccctcatttcagctcttagcagtgacttcctcactggtctccagactttagatttttcctcatcaatgcatccctatgctaacgccagattgagcattcaccaatagtgatgatgatgatggtgttgataatgatggcaattatgctagctgacgtttaatgcgtacagattctatgccacgtgctctgaagagtctcatcaatccctacaacaaccctacgagaataggtccacttacaaccattttacagaatgaagacagacacagagagcacttcagagataggggcttcgcagtgggaaatacacccccatgtgaagaagtggggtcgtgagaaagcctggcgtgttcagggtgaactgaacacccctgggccttgagttcagaccccagctcagtctcttactaactgtgagaagttaggcaagttactcaacattggagagccacacgatatggatactaatatgatctaagcgggctgttgtatggat

SEQ ID NO: 119597 - DNA, 1038 bp, Homo sapiens
ctcatgcctcaccctcccgtataactggggttacaggcatccaccaacacgcctggctaatttttgtatttttagtagagactgggtttcaccatgttggtcgggctggtcttgaactcctgaccgcaagtgatcctcccacctcatcctcccaaagtgctaggattataggcgtgagccaccatgcccagccacttttaattttttaatgcaatttatttctcaaatcatttttttctggttatcttttaaaagaggcactgtatagggaatgatggctgctttctaaatctttgaagctcatgtgggctaatgataaatgcctcgcacagggccaaccatagtttatgtgcaatacatttaggtggaactgttttccatttgttgttttctctgtgtttttataggcattgaaacacccatattttcaagttggtcaggtattaggcccttcgtcaaatcatctggaatcaaaacagtctttaaataagcagctgcaaccattagaatcaaagccatctttagttgaggtagagcctaagcctctgccggatataatcgatcaggttgttggacaaccccagccaaaaactagccagcagccactgcagcccattcagccgccacagaacctgagcgtccagcaacctccaaagcaacagagtcaggagaaaccgccacaaacgctattcccgagcatcgtcaaaaacatgccaactgtgagtagccagtcatgacacttgcaatgaaatagtttgactcgtgcaattaagatttttttcgaggcatttctaataatgttggaaaagatataaaagatttttctttgttaaagaccctgagtcctctggttggagcttgacatgagatcacttaaaattctaatatggtttataaaaagaaaaactttcaggataaaagtaaccaagtttacatgctacagtcttcagtcttttttctttttctttttttgagacggaggttcgcttttgttgcctaggctggagtgcagtggcacgaccttagctcactgcaatc

SEQ ID NO: 119598 - DNA, 1366 bp, Homo sapiens
atatatatacgtgcacacgcacacacacacacacacacacacacacacacacgtgcacacaggctgtgtgcggtggctcatgcctgcaatcccagcactttgggttgaggtcaggagtttgagaccagcttggccaacatggtgaaaccctgtctctactaaaaatacaaaaattagccaggcatggtggtgcacacatgtaatcccagctactcaggaggctgaggcacgagaatcgcttcaacctgggaggcagaggttgcagtgagctgagattgcaccactgcactccagcctgggtgacagaaggagactccatctcaaaaaaaaaaagaatatatacgagcacagaaagaggtctagtttagatcaaatagcatctggctcatgtggaatgtcattcttggaaaagaacattgccaaagaggaattctgctgtttttcttctatattactttaactgtctggcttgtccagctacactgataaaccaaaaaatatgagtgcctccttttttatatgtataatacatttggaccaaaactacaggtgatctttggaatgttcttccaaatttatttgttggttttcgtttttgtttgtgttttttgagatgggggtctcactctgttgcccaggctggcgtgcagtggtgtgatcatggctcactgcagtcctgacttcccaggctcaagcaagctacccaccttggcctcccaaagtgctggaattacaggtgtgagccaccattcctgacctgtttttcacatttaaagttgagtgcagagtagggcttattatttctttaaaacaaggtctcaaaatcagatggtattcataatgtcaaattgagttctgaatgatatatgttatattcctgaacttatgaaatagaattgttgttaatttgtttgtttttaatccactgtgtttatctattgctgcataacaaaatacctgcaaagcttagtgatttaaaataagaagaaacatttattaattcacatagtttctgtgggtcaggaatttagaagtagcttagctgggtagttctggcttgggttctctgatggcagtcagataattggccgaagtttcagtcatccgaaggcttgactgggactgcaggatctacttccaaggtggctcactcttggtttgctagggctgctgtaacaaagtatcacagactggttggcttaaacaacagagatttatttcctcacagttctggaggcaagaagtgcaacatcaaggtatctgctggttgtttcttctgaggcctctctccttggcttgtagacagccatatcctctctaggtctttatatgatcttctcgttgtgcatgtctgtgtccacatttc

SEQ ID NO: 119599 - DNA, 1051 bp, Homo sapiens
agctgaccacctctctccccatgcaggtgctctgtgaattgtatcctgggtttcagggcattgcacgatgtcgttcctgcctaaaaatttctcctcaaacaaatctagtgctcctccctaggtggctttatatagcaatttattaattatcgtctttatatcctctgctaatcttacgtttttctagtgaatggccatttttgaaacagcttaacttggtatatgaatacaatgtaaaggtaatgatataatccattgctcactgaaacaagagaagaattaaatgtctaaaattcatggctaaaataatgccttattgtaaaaataactcccaagtgataggtcatttggaattccatgcaggcatacattttaactgctttgaaccaaataaaactcgcaacatgcatttaatgtaaaaatcaatttattatacaacaatcatagataatgctttttatctacaaagagaaatggcttctgcagcctccctgtctactccattcatgatactatgttcttaagatataattactttcaaaggaaaacaaagcgatatccatattttccaaacaaggaagcccccagacacatttatgaacgatatggaaatattggaaagaactcaaatggactcctagatacaaaaggctgttctgcccatcacagtaaacactgttttgccttaaaataaaaataataaaatatttctcaaatgcaggggtgaggactttaccccgtaacatgcctaagtggttcgatatataattttgatggcttgacaattgctatgtttaattccattcagttaacattccattttgttagtttaaaaaattgggggaattattaatagatatgctttacagtatttaagtattttcattcccatgggtcagaggaaatttgagagaaaacattctccattttttttaatagattatagaaatattaatttttcaatagttttagaaaaatcacattaaaataagcattttggttttttgaagttacaacacttaacgacaggttaaaatgtttacctgattta

SEQ ID NO: 119600 - DNA, 1030 bp, Homo sapiens
ctaggccctgagcaaatgtgagtgacagtttctgcctttgagtgatttgcaatctattgatagattcgtaacactagctacaccctattatgtctattgattatggagccacagttaaagtaatttgaatacaaatgaagcagcagttcagcctgaaaaaggaaagggctgggtgaagttccagagaaaaggtggcatttaagaggaatattaaagaatatgccagacctgaagtaggaaaggagtgctgggagcagagagaagagttttcatggctggaggaggagtaagcaggccactgttccagcacacaggacaccgtggtggggagcttgcaggaggctggtggaaacagcagccacccaagcccatgggagatcctgggttcaagccaggagtcatgaacttgggttctgcggatgcagaggaggaacgtgatcacacatgtgttctggaaaaataactcatctctcactagaggtgggtggattgcttgaaataaggagaaactggagacaaggacaccaggtgagctgccttttcagcagtgagaaagaaacagcaggaaaccacaggcagcaggcagaaggccgagcagtggggcagcaccaggaacactgccatttctcacccttttctcccctttacaaatttctataggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtaagttattttgttaatttttccgttttgaggaatggctcttagagaccactggtgctgtcttgtattaagcatcgcatgcagatcaggagagcatgaagggaggcctagagcgccggccttgccgcagcaggatgcccgtgtctgccaggggtcatgtattctagtgtctggtctttgatacaggcaaaatctggg

SEQ ID NO: 119601 - DNA, 1020 bp, Homo sapiens
gatactttcccaaagctttctccttgtctctgttctctcttcctactctcctacactctttacttgccaaatatatattaatacacatacaattctgacacccctctgaacctgaagaagagtgttgtcaaaggaaaaagaggtcaaaagtggacccttgagattttctagccccattcctggtgtgattctgttacttgttcaataaaagacgcttttcacaaatgcttattgagagctcaaatgtgtgccaggtaaagaagatcttgactagtttgggagaacaaggggggccagggaaaaccaacagagttaggaggcatatccaggcagagggaagaacacatgcagtggcacatgcggagagaacaggatgtgttggaggaactccaagtaattagatatgcctggaacaaagaggacatctgaggatttggaaggagcagagacttagcaaagtgggtggaggtcatcacattctggcccagtctgccaaaggacttaatagcaattgtttaattttttaaagtttttcagattttaagtcagataagaatgctagttcctcttgtaacatacagctggataccaaggaattgaggttaagatgcatagtgtatacatccaaactactatagcacagttcactgagatggacttttccttccactgagctctgtactgtgttagttccatcatatttaaacattgataatagtgacagtaaccacacttgtaatgataaaaataatgagtttgtcactggaccatgcttgctttagagctttggtttttgtaaaaatttaacctattagggggaaaaatgctgttttactgttaacacatggcaatctgaccagcacttaggacagactactgcacatccactgagggaagcccctcatggttttgtttgggttgaataaaatccttctcttactgtggggttggagtcatcttattcctctgaggtatgttagcagataaagcagaatggagtaactaaagagctaaaggacc

SEQ ID NO: 119602 - DNA, 1628 bp, Homo sapiens
ttcagcactagaaaggtacctgcagacagtagatgctcaaataatacttgtctgataaatgaacaggcatgtaaagtcactttcccatgtttgaagaaactgagactgagattatttcattcagagtcataaactagtaagtgattggctgaatccacggatgcagattcatgcatacagaggatgactgtattttgtaattgtttgaggaatatttgattatcctttttccattggaaaatatgtggcatgtgcaactaaatttccaggatttgtccatggtttagtacatagagtagaaaaagctaaggattaaacctaaatttatgtgaccctatagaggccctatcctagtctcctctacattttttttttttttttttttgtataggaaacatttatccaaattgtgtaaaaagatgtgaaaattaattttgtcagccattaggagaatatgttctgctatttaataatatgatggaacaacttatggccttgaagttctttcataggtaagaccttaaccttgtgcaggagccaggtggaaaaatagaataaactctacatgatatggataacaaaactaaagcacagaaaaagtaacttctctacatgtctgtagccgactggaaacctgagcccaagtctttgacttttagttcattgatatgtacaagaggaaaacatctgtggtttgctgtagtgatgcagaaagtttggaatagacaactagattagtgaggccaaaagagaaagtctggtgcagatatgggaacttgctataagagaggagtagcactacaaatgagtgtggaaaggactgtttgaggaatgatgttgggacaaatggcctttcatatgggacaaaataaaattagatctctacctgataacaatatgcaaaaataaattgagatcatttaaaaacctaaagaaaaattaagctttggaactgttagaaaatagaggttatggcaggaataatttcttaagcaagattaaacacaaaccataaaaagtgacatttgaccacatcagagtttgaaaattttgagatgacagaagacaccatacagattttttctttttaaaggaggagaagttatttgcagtgtatataacaaaagattagcactaggaatgtgtaaatgacccttataaatcaataaacagaagacaagccatccattagagacatgggtaaaggttatttaatggcagctcactgaagaggaaacctgcatagccaataaatatttaaagacatacgcaacttcagtagtaataaggaattgcaaattaaaaccatgtcagactcatgaacttggcaaaatttaacaattctgacagtagcaagttccatacatttttagagctttgtggtagttttcaaataaaaatgtattccccaatgtagcaattccacagagatttattcccaaagaaattctcattaataaacataaggagatttgtataaagcagcattttttgtaatagcagaaaaatgggaaataaccgaatatatccattagtaaggaggtggacaaatgacaatatggaatattcataagatggaatactatacaacagttacagtgaatgagccagagctgccgtgtcaacat

SEQ ID NO: 119603 - DNA, 1044 bp, Homo sapiens
tgttaggattcctaggattccaaagtatccagcctttttctctttcgattcttcgaacgtatagcattttcaaggagtaaaaaatcaatttttaaagtatccagttgggtaagcctaatttttggttcttcaacaagggttccatttaatctagtttccttcaaaacgttttagtcagtttgggaggttcaggtgctttcatgttccgaaagagaatgttgaaaatgtgtcaagtagatattatgtatctagttatgttcagaaaacagggccctgctattcagggttaggtggatgatcgtctgggttggacagttggatatgtatcatctaacttgacaggtttgcatttctgggagtagacattgataaggggaaagaagttgcaccagaaacttctttaatggcccaatgtggtgaaaatacgccagcatcagtagctcatagtaattctacagttacagattcacgcatttgtagcttttcttcttaattgaattgggacataactgactttgacaatgaacaattctaataaatagttaatttatgacattttaaatctaaccatttaataattggagagcataacttgttctgaaatttatgtgacagtttagaacctgagatctgaggtcattcgtgggcttgaatcctgacaccagcatttaactgtgtgaccttgggcttcagtattttatcctgtaaaagatgataatatttcataaggttttcgggaggaacaaatatgatggtgccctttatgtgtctaaaacagtgcttggagtgcttagtaaatattaactattataatgatgtgtgttcttttttctcccatatctattttagttgagacacttcagaatgatgtctctgtcccttttgtggtcttaatatacaactaatattgctgtccaatagaaatataacataaatcgcatatgtaattttcagttttctactaatcatatttaaaaagtacagagacaagtgaaattagttttaataatgttatttaacccaatccatgcaaatatttcaaca

SEQ ID NO: 119604 - DNA, 1024 bp, Homo sapiens
gctacagccgcggccgggcgacgctgacatctggcatccctggggtctcagagacacgggtggacagcgacgagggccttgtggccgccgtgtgtacccgtgcttaccctctgtcctccctacaggcgcgcggcgtccgccatggaagcgcatccgaccgctggggtctctgggtgccgcggcctcggctctccggggcgatgagggactagaggcgccctgaggcccgcctgcctcccgcgctctggccaccccggcgggaaaaggatcgggcgggcgggcggtcccacagtgcccgcctttgcgccgccccaccccctgggggcgctgccgagggggcgccagccgcccatgccgccccggcgcccagccgcgcctggcgcccgccgctgaagcgcaggacgcgccgccgcccgcgctcaccgccgtccgcgccagccgccccgagccgactgcccttctgcccccaagatgtggcacagcgtcgggctgactctgcttgtgttcgtggccacgctgctgatcgtcctgctgctgatggtgtgcggtgagtgggggcggtagccgcgaggcagttccacacgccgggtcgctgatctgctggggttttttttgttgtttgtttttttgaaaaaaacaaaagggcgtggacggacaattgtcttaaaatcaactgttgtcccttagcctctagggctgagcgcagaggtgggccctttactcatggccggccctcgggcatcctggggagggaaaggacaggctccagggcttcctgcctctgagtgaaactcagccttgcttcaccggcagcgtctgctctttcattctcaccacaggctgcccagattgtaaccttggcctgcattcgaaggtgaagtgattgattggtcctttttcatttgcacagattctgaccttaataatgagaggtgtcaccttcgtttcatcagcgagtggggtagagttgggttttcagcacgcgtgaaattgtttacttagagttcagccttaaactcaattc

SEQ ID NO: 119605 - DNA, 1068 bp, Homo sapiens
gactggtgggtggcttaaacaactcatttcttttctttgttttgcttttttttttcttttttctttttttgagttggagtttcactctcgttgcccaggctggagtgcaatggcgtgatctcggctcaccgcaacctctgccacccgggttcaagcaattcttctgcctcagcctcctgagtagctgggatcacaggcatgcgcctagctgattttctgtttttaatagagatggggtttctccatgttggccaggttggtctcgaactcccaacctcaggtgatccacccgcctcggcttcccaaagtgctgggattacaggcgtgagccacagtgcccgtccccagtgcctggctaattttgtatttttagtagagatgcggtttctccatgttggtcaggctgatctcgagctcccgacctcaggtgatctgcccacctcgacctcccaaagtgctgggattacaggcatgagccacccatgcccagccaaacgcatttatttttttacagctctggaagctaaaagtcagagatcagcagggttgattttctcctgaggcttctctccttggcttgtagatggtggtcttctccttatgtcttcacatagtctctcctttgtgtgttctaatctctttataaggacatcagtcgctggattatggctcctcaccctatgactttatttaaccttaattacctctttaaaaatctttatctgcaggccgggcatggcggcccatgcctgtaatcccagccctttggaaggcagaggcaggcagatcacctgagatcaggagttcgagaccagcctggccaacatggcgaatccccgtctgtgctaaaaaaaaaaaaagaataccaaaaatttgccgggcatgatggcacatgcttgtaatcccagctgctcaggaggttgaggcaggagaactgcttgaacccagtaggtggaggttgcagtgagccgacattgcaccatagcactccagcctgggtgacaagagtgaaactccgtttcaaaaaaaaaaaaaaaaccttatctccaaataccgtacagtcacact

SEQ ID NO: 119606 - DNA, 1053 bp, Homo sapiens
aaaagaatgtgcacaggcagtgtcatgggaaggtgccttgcttggagaactatagatagttggtcattcctgaaatagagaatgcacgtgtccgggggtgggggtgggggtccactgttttgacaatagagatgtacagtctaggtcacaaaaagactttgtgtgcagtggcaaaggctttgaagttcatgtcatatgggacagagactactaaactattttaaacagagagcactgatttgcttatttaacatatgttgagtagtcgactaatcttccaggcatctgcactagttgctcgtgctaactgcaaggaggaggactggttggaggcacgatggaaacaggatgtctcttaactggtccaagcaagaaaacaaaactaatggcagactggaaaggagcaatgaccatgggaaatttgaggatatgaaaaatcaataggacttgagattagattgtgaaggagaaggagaaatgaaggatgatttcaacatttagcagttgataacatggggggatgcatacagcaagagaagtaggtttgggattgggcatagggaggtggaagataggagtccagttttgggcataccatatttgaatttcaggtgcttatatgatattacgtagacagaaataaccagttgtacaaatagtatgagggacatggattgaaaacacagactcagtgttatcactatgtgtatgcatttgaagctgtatgcaaaaataggattccccagggtaggggggtggaataagaagagacccaaggtgacactgctgtggtttgaatgtttttgttccctccaaaaattcatgtgttggaaactttatgcaatagggttgggaggtggggcctaatgggaggtgttcaggtcatgagggccctgatctcatgaatggattaatgtcactataaaaaaggctttcaggcatgggatcccttttttttattttttgagatggagtctcactctgtctcccaggctggagagcagtggcacgatcttggctcactgcaacctctgcctcccgggttcaagcgat

SEQ ID NO: 119607 - DNA, 1031 bp, Homo sapiens
cttaatttaatgcctcactcccacaggagatgaggctaactgaggactcatctagaggactctttaagaatgagctgggcttttctgccccccaacaccctccgcctcccaaaataaccataacaggcaaagccagcacacagaaaatggcagtaagtggacttctagacactccagctacttctgagtcttcagtgtcaggacacatcagtcatctgtcgatgagattttttttttcttttccttttgttctttcgttcttgttactagtcactgtggcatgactgagagtttggcaggaaatgggttcgtggacctgtggtacagtcgcactaccacagcagcattggcctagcaaaatgttgagccctctttcccttgcatgctcccctggggcagaagtccagtgctatctccgcttccctgaccctctccactcagagcccagcatgacaagcacacctttaaatgggttcaaggaagggaatagcagaaatgaacgcagcccgacagcctcctttctcttgataacccctgtcactgtggagctggacttctaggctatctcacagaggcccagaggcactggaatcgatctcatttccttacagacatcaccttgtcaattagagaacacataacgttgattgaatttaagattcttatcagtgcctagctctttttctcccaaatccgaaattcagccatggcagatccataatcaagaaatatacttacattcccatcctttgttgttggtttcaaaaatatttcttttttgtgagtatgtatccatgttttacaaaccaaaaaaatgggacatatggtctgacaaagggaaggatatttgaacctggggactgcctgggagagtccggaagcacatggtcactctagagactgtcatcaagggctgctcctgagattaatccactgtcgaaggcattatcccatctcccttacagcagccttttgcaggaaactgtctaagatgttgtgctttttttttcattgacttgtaaataacaagg

SEQ ID NO: 119608 - DNA, 1054 bp, Homo sapiens
gatggtcaggaatgctggttctggctcagggtcttacagtgtccagtcaagctgtcagccaggactactgcattctctgcagacttgtctagggctgggggttcagctcccaggggcattcatgtggctcttggcaggtggtgggaggccttctccatagggctactcacaactgtttttttcagaatgagagatcacacacacatagacacaaacacacagtaagagaaaccaaaacagaagccacagtctttgatagcctaatcttggaagtgatataccatcatgtctgctgtattctattggtcatacacagaccagctctggaacattgtgcgagcagactgcacaagggtgtggtagggactcttgaaggcctgctggatgctggctaagacagtcttaaaggtgggtatggggagaaaggaatgaggctaagggaagactaggggcatcatagcaggtgagggaatgaagtgtctgtaaaaacaaggtgattagaaaaagcagaaaactgtctcgatatgtaaaatcatgtttaaatagcacagtctagcattttcaaggattaatcctgatatttcttgattataagttatgtgccagtctctgtggtaaacactgatgaacaaaagtgaaaatgtcagtcattatccataaggagctcagtgatctagagaagctaacctttagattaagtaattcttttgtggcttgttgagttcaggaagaaccaggcaatggaactgtgaagacagcacaagaagaggttaagagtggagcaggaacctgttcatgggagggtagagaggcaggagaggtgaactgcctatgggttggtactaccaggacatgattatgttgctgctcttgggtgccttggaaagcaaagatgttttcatcagtaatatgaaactggattttcattatacagttttttccttctgtcactccctaccatgaattacgtgaatctgtcatggtttccaggcctgcgtatcagaatcacctggaactgttcatacagatccatggctccagtcgataaatgtgg

SEQ ID NO: 119609 - DNA, 1058 bp, Homo sapiens
tccatgtttaattgaaaaacaaaaatccacatgtatgttggacccatgcactgcaaacctgcattgttcaagggtctactgtatcttaaaaattctaaacattttagttatattaaatctgaagtatataggagaatcaaacattaaaaatgtttatgtaaatatgttaggtgagcagctattggaatttccacctcccttcttggataattggggttctgctaaatttttttctaaaaataaagatttgaaagaagtaataggatccttgaatgtatgagtcaaaaaattttttagcctcaacttctactagctagttttttttactttagacaagtcatgtatttcccaggcctgtttcctcacttataatactatctaatgtaaatagttttcatattgattaagggagagctgatctagaaattttatgagttaagaaaagtttagaggttttactaggatttaagaaaaaatgtatgcatttgcacataaacttgtttctttaatctttcaagttaagcaactttctttttcaagtgggacttcttcagacttttaatatacttatttgtagagtaaggtttagaaccaagaaaatctttgctctctgcacacctctgacctcttagacttaggccttcttgaaatttggtttaggaaacttgattcagtatttaaagattccttccagttatgaaattatctctctctctcttttaatcccagtacagcataattacttccttacagttagtctgaatgctatttaaggtgtgattaccgtgacttgactttgcattatttgcagtttccctggttatgcttgtatttcctgatcggtcattcctttggttacctatttatatttagtttcaggaatgtattatattgagaatttcattacaagttatgctcgttggtgtaaaaagtttaattttcagtatttagtataaatatcccatggaaatgttatattatgagattgtaaaacattttatccttcatggagaaggtttttttaggttggtgattcaaacaaacatgaatcaaaaaat

SEQ ID NO: 119610 - DNA, 2031 bp, Homo sapiens
ataagaagtttcctttactttttatatttgttccactgtttgtaatatgtcttttaacctctgactaccctcagtattttccctttatctttggttttcacgcatttcactatgatgtgtctaggtatgtgtgtgcgtggtttatttttgttttgttgttttttggttcttggaagtgggaggtatttatcttaggattctgtgagagtcttggatttgtggtttgatgacttttattatttttgaaaaattttcagcatctttcccttcaaatatcttttcttctccattgtctctttcttattctggactccaattacatatatgttaaaccatttgaaattgtgccatatctttttttctaaacttctagcattttcatttggctctcagaatttccatctctactgaaattcccaatctgttcatgtgtgttgtctgcttcttccactagagactttaacatattaacaataattattataaagtctctgtctggttattctacaaactgggccatctctgactctggttctgtagattgctttatctctcaacagtgagttgtttttcctgtttttgagtgcttcttttaattttttgattgaaaaagtctcactaaagactgaggtacaaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagactgaggtacatcgtgtttatgtctggagatggtctgttgcttccgttagaccaatagtgagaattgatttaatctacttaggagttgagctgaatttgaattttgttgttgtggttaccttcagtgcactgcacgcttcacattctgtaaggttgctgttgttgccttgtgcttagggtgggagctctgtactgcagggttattctcagtggcaatgctccattgtagcttttagccatttcttcacaactatgcctcaaaaggggtctctctccacacactagcctccccccagtggtggaatgctgatgcttgttacttgctgctaggctcctgaggggagctgtcctgtttctgtgttaggcatgctctgtgtatggggatctcaggaggtggggctttgtcagcattcctgcctttctgaaccatggtggccaaactcttcttacatttgtgattgttcttaggagtttctcgtccttccatcggcagtaacagacctctgcttggaattgggtcctgggtcctggatggttttctgcttctctcccaggaatagaggttttattcttctacccttccctaaactggagttctactagagctttgcctgtccctttagggtgacaggatttgctgccctcccctaatggctaagggttttgccttgaataagagaagggtcgcaagaaacaagatttctgtgtttccctagcagtcacctcccgcaggcctataccaccagtggtggctctctccagtctccagcctatgatccagtctttccagggagcactcagtagagacctgtggaaaagcacttgcaagcgagtgtgcatttgtgtctgtcacttgtgtcatttactcaaggttgatatgttaacccatgcttggtctttaacaatctgtaaaaattgtagctgatttcttcttacccacttgtatgttgcccactgcctgctcttgtgctttaccaggtaacacatgtcccccactccttgctttgcatcctcacctcactaatgagctaaggaaaagttacgattgtataattttatctttttctcattggatgggagtgacatt

SEQ ID NO: 119611 - DNA, 2044 bp, Homo sapiens
tcttttcttttcttttttttttttttgagacggggtttcactctgtcacccaggctggggtgtggtagcatgatcatgggtgactgctgcagccttgacctcctgggctcaagtgattctcccgtctcagcctcctgggtagtgagggaccacaggaatgcacaaccatgcctggctaattttttaattttttgtagagacagggcctcatgctggtcttgaactcctgggctcaaacagtccccctgagtcagtctcccaaactgctgggattacaggcatgagctactgtgcccagcttcttgattttaaaaaatcatttcaaaatctaaaaaccattcacgaagactatacagagacaggtggtaaactagatgtgactcatgggctatattttgccgacccttgatctgtatagcacttttccaaattataaatgtatcatctctctgagagtctagtaagtcccctatgtgggacatgtccccaaattcagaagtcattgctgttagaaaatgggtgcaagttctacacttcagatttgttggtataataaaaagcttgaaataacccaatttggacacagattatttaaatatgtaatatggaccatttctataaagaaggtgatggtataaagaaagaaaaaatatatatataaaatatataaatggtattttcagcttgatttctagaatgtttagtgcatagtaagttttcagtattgacttgctaatgacttttaatagagaggttgggttctctgtatttttgaggattaaaaaaatagtctaatgagataggttttgttgttttaatgactttcggagttttaaataaatacctcttatgtaactttatcctagagtagtgatttctgtctctactgcatacccagtatgcagtaattctcatgagcagctcaagttgagaaccattgatctagcagagcatcttctcctttatttttatttttttattttttattttttattttttgagacagtcttgctgtgtcgcccaggctggagtgcagtggcgtggtctttgctcactgcaagctccacctcctgggttcacaccattctcctgcctcagccttccgactagctgggactacaggtgcccgccaccacgcccagctattttttttttttttttaatttttagtagagatggggtttcgccatgttagccaggatggtctcgatctcctgacctcatgatccacctgcctcagcctcccaaatcttctcctttgataaagaatagaatgagagccaggcatagttgtacatgcctgtagtagcagctactcaggagactgaggcaggagaatcgtttgagcccaggagtttgagtccagcctgggcagcatagcaagactgctatctcttaaaaaaaaaaaaaaaaatgaaaaactaatttctaaaaatattatatttgcagtaaaaatgtgtgtaaaatatttcagaccagtttaaaatagtaaagaatgtataaaatgatatcattcatctcatatcttatctctaaaagccattgttaggtcttcttccatttggttatatgttttctatacagatatgaaaatgtacttttttaaacaaataggattatacaatatgtaccattctttgacttgtttttactcagtattttttagacatctagagaaattcatttctcataaataatgttgttgaaggattaaaaacaaaagcacagaagataattttttagtggcttggcaaccagagctgatgaaagttacagattgggagcagagctatttctagtattgtttggaggctggaacagatcataactctgctgccttttaccccaccaaaaagtaacacactgcaacaatccaggcaaaattaaggtgaggattatagacagtcttgagtggggaaatgttaccaaaggaatttctgagatacgttctggaagaagggatattcccttccagagaattatggtgattataggcatgagatgcttcaaagtttctgttgtttttttgtattacatttttaaa

SEQ ID NO: 119612 - DNA, 1048 bp, Homo sapiens
ccttaaaaatgtaagtctgacacaatttcaagtaaaaatttgtgtccatattagcaataaaacatttaatttttttctggctaattatctgacctgcaaacaggtgaattaggaaaactagccaatgtgaatagtgatatttattttcttaatacaagttgtgaatactagtgcactcatagctgtatcttcagttcagttattgattgctaaatacctatattcagtaagatgctgactgaatatagttacatattcattatattttgctacttcttagattttattttgaaactagagtgatttttcatatagtgtttttagttaataccagaattgggagaaactggtttctatataatgtctaattttagctgtttaattttagccagtctaaaagtgtaaagtaagttctcattgttggtttaatttgcatttctgtgattattagtgaatttgagcatctcttcttatgtttattatatatttaggttttcttttttacagattgcttctttaaattctgtggttttcttttggtattcttgtttcctttttattaggttacagatatttttatatattagagatattgacctcttgttggttttggactttgcaaataatttatctcagtcttttatcagttaccttcatccatgatatcatttacggagcagaaatccttagtttcgacatgatcaactgaaagggtttttgtcttatggtttatacttaaagattttattaaagaagttatcctccattccattgccaaaagatattctgatatattttcttctattaattttacagtttttccttttgtattaaggtctttaattcacctgtagcaggaagtggcaaacatttttgtaaagggccaagtaataaatattttagatttcgcaggctagtggtctctgtcacattattcagttctgccaaggtagtgcaaaagcagccatagacatatgtaaatgaatgctcatggcctgtttcagtaaaacgttatttctatttacaacagaggcatcgggcattcagg

SEQ ID NO: 119613 - DNA, 2074 bp, Homo sapiens
tagaaattacattaaattatgttatttttctgcattatcacttgtaattatcagtatgttatactgtatgtttacaaaaatgctaaagaggtctagttaattgaatgcccaggtgagaggttgcaataatgaattattcattgtttatgaacatatttgctatcaagtatgcagcatataccataaatatatatcttttggttgaatagaaaagtctgtttttcaaataagtggctaagtgtattatggtaagttgtaactttcaccaatcacagggaaactttttcatagaaagtggataaaatgagaaaaaaatgatgacttatgttttgatgaaatgaaaagagctcttaaggtgcagcatgcagtgtgttataaaacgagtgactgtatcccttcatttttctcccgtttctccttaggtgcagcagtagcgggcatttacagagtagctgggaagaacatggcccctttggaagcgctggtatggggcgttggacagactgtactgacattaatcatctccttttcaaggatcctcgctacactttgaggtttctgtgggaatgtcttacttcacataaggaaacagatgtacagattccctgaaaacggcattgttaacaagtggaaatgaaattgtgcaagaatgtggactgagcaggtcaaagcataaggaagaccttgagctgtgtggaaggattgccctctggtgttcaagtgattgcactaccgcactgcaccttatgtgcctctgtctcaggcaaggtgcattaagacactatgtaaagttacaagaaaaagcaccttgtttagctgcctatcaggttaacattggtgttgaaatcatcgttcctaacagtgttatgttaagttacagggacgttttgaggtattgatatatgtgccaaactcttttctttttgttaacattgatcatgtgacaatttgcaagtgtagatgtagctgagtgctgtgaacatatttgacatgaattcaggtaatgtactaagatttttgttcggtaacactaaatcccgtatgagtgctaaatactgaattgtttaatatgagagaaattatttggtttttaatgttgcgcgtttctgggatttagggcttcaatatgtttaggtattattgttatttaattgatgtggaagataagtcttcttaactgaagactagctcaactgttttaagaactcagagtagctctatagggtgcatacttttcaccaacttaagtaacacccttttaatagcttctctcatgcatccatattctgtttatacaaattcagaaacttgaagggtcatacacattgattgtagtttgtgcgtcataaaaatgtaatttgaagattttcttaaaaatttttgtaagaaaaaagtctgaaatgcatgttgcattctttgacccttctaaagaaagtttttgccttgtatctcatggacaaaacatctttataactagtatctcagtgggattgtattacgtgttgcatatatcttgatttttgacaaaacataaacagtctttcattctggagtattaactgtttttagagactggcctaaattaggctctggaaataaagacctcatttgtagaaataagtaacaagtaagttatataggaagagtaatgaactattttactttggacatgtggcaacatcataattttgctaagtaaaaattggggaatatagtagataattttaaaatttggcaattagtctcagcatatcaatgcagtactgagcgtgtattagagtaattcagttgttcagttcttgatttatgatatgaagttatgatttaagtttagtagaagaatctgtgagggcatatagcaaaagtggaaatgtcctttatataaaacattttaagaggttctggcaatacgtaattgtaagagtataggaagtagggttgaactggtctcctaatgagattttttttggcaccagatacaattataatgtgctaactcaaaggagacattgcagagaatatgaagttaaggataatccaaaaataacctggtagccttgctgtttaatccaat

SEQ ID NO: 119614 - DNA, 1070 bp, Homo sapiens
tgtgatttagcagtacattttcttcgtgacaaatgcaagaagggagggaggatcctctatagtggacactcctttatttaaaaaatgtttaataaaatattgtttatagtgaaatcagctccccaaagaaggaactcctacatgcccaaactaattacagttgaacatactgattaaaaatgccatagatcacagctagtcaggaggcctcaaataaactgcaaataatgcttaaaactttaaaagaaggagaaccagcagtcttccgaaccatgggacagttccaaggtaatagcctaccttgcctaggataagtgaagtcctaaatgatggctatcttcagggcctggagcagaattattctttagatcttaatgtttaccaaacagtgttacagtttgttacccaatatactttcttagtatttgcagcatacatttcactgctcaaaaaagtataagggttttgtttgtactttaaatgagagaaataaagaaatgagttggcctgtatatcttgtatttgtgatatgagcaacgggataatttgaaatcacagaatgttgtgggaaaggtctttaaagaacctctaatgaagaaaatgtggctgccacattgatgtacctaggctgccactcatacagcaaataattctattttgtaaacacttcgtgtggatccactatgtaaagtgctctaccaagtattttctctagtaagaagtacaagaattaccaagatggaattctttaccttgagtacaccaagagctagcaagatgatttttaaatcctaaaaagtttgggacaacattttgcttcctgattttagttgagagttagcctgttatccctccaaattctcattttcctggttcatccactaaatagaatttccataactgagatatcatggctgtgacatagtgaagagaatacgagactccaagccagcaacacagattgaattaagactctgtcacttgtcaactttttgaccttgagcaaatcacttaacttctctgagcctcagttcatactccgtaaaatgtgactaatacctcatgtagtt

SEQ ID NO: 119615 - DNA, 1576 bp, Homo sapiens
aattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcaccagtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggattattttaaaaactatgtttatatataatacctaacaagctgtaaatattgtatattattgatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttgaaagctttatggggtgtttgactcttggtgataaatcttttcaattcattcactatggactcaaatgtcttctcttgcctttttgtcaatttttctggccctgttttacctacagatttaggagttagtgcttaaaagctgagaggcgaccagcttggccaacgtggtgaaacccgtctctactaaaatacaaaaaaattagctggacgctgtggtgtgtggctgtagtcccagctacttgggaggctgagcctgggaaatcacgggaggcggaggtttcagtgagccaaaaacgt

SEQ ID NO: 119616 - DNA, 1094 bp, Homo sapiens
aagacttcagggaagcggcggcttctgagccagtgtagctcactcagcagcgggggacgggagtgaagctctaggtccccatgggaaaccctgagtaagcaaagggacagaggggttggtgctcggcggtgacacctagaaacttccgcgctcctcacaatgtctgtaaggactcgagccctgggaaggatgtgggggttagagtaagcaggtaaccatcagctcctgagattaatttttgagcgtatctttaatatctcattgtgacagtttggaatatcaggtttgttgtgccctacctgtgatccactgctttgctttactagaagacatctctaatgcgatgagataagaaatgcggggagaggaaattgggagaccagaagaggagtcacagcccagtttgcccctactgtttctgccgtcagctcaggagctttcaggaaacccatcgcctctttttaggcttcctgggggaaatagtctgaaatgtttgtcttgtgcttggtaatcaagtccgtattaaaaggcagatacctgatactttctcaaattatatttttcttatgcttccatggtagtttcacctcttagaatgtaatctttctttgatttattcttggttctcctgctgggacagatatatccctacggatgtgcaaagccacagggtaacatgtatctttcaggaatgtgaattttacttggggaaaaatacgtatacttgtctgtgtgtgcacacgtatacacatattaaagtattaggcaagcataaaaatgtgcaataccggaatctatcatggaagagtatagaaagtttgcatggatttgaaaattaagcctgcatagactgcttttataaggagatggagtatctacttctttgctcttagaggttgtttactagaaaaggtataagaagaattgttaggttaagggcaggaaacaaattggggacataagtgagacagtgtccgacttgatgggtgatctgtatactgtgtaggactgtggttttgttgaattcagtctcttcacccttggcccagcgttaaaccagatagaatcagttctccatgcctgtttcccatctg

SEQ ID NO: 119617 - DNA, 1047 bp, Homo sapiens
attataatatgcatcttaaagtatcactgcctacttgagagtaatactaactgaactctggtaaaatatagaaacttttctccagtatctccttttctttctccttttatgctattattgtgatatatgcttaatccctttatattataaagcaggttacacagtgttaaatcactcctttacacaatcttttttaaaaataatttaagagaagaaatgagaaacatactaataggtcttacatatacctacatatttattgtttctagcactctcctcttcttctatggattcaggttatcatcctgtaccacttttattcaacctgaaatatttcatgtagcatttcttgaaagtcaggtcttctagcagcaacgttgcttttttaatatttatggaatgtctttatttttccttccgttttgaagcataattttctggatatagaattcttggttgatagggttttgttgtttttctttctgaactctgaacatccactattctctggcctctgttacttctgagaagtcagctgtttattgtgttgtgtttgttttctttgcaagatgaattgtttctttcatggttctttccatttgtttctcatctttctccaatttgaatgtgatgtgcttagttgtggatttctttgtgtttatcttatttggaattttattgaacttcttggatatgtagatcagtatttttgttttatcaaatttggggagtttttggccattatttcttcatatattttttctgtacctttcttttctctaatcacacatttatttttatgtttgttgttccacaggtctctgagggtctgttaatatctctttaatttttttctgttcctcagattggatacttttcattgagctatcttcaaatatatggattgtttctcgtaccagttcagatttgcggttgagtccctctagtaaatttttcatttcacttactttacttttcaactctagaatttctatttgcttctctgtctctttttaaaataatttctatcactttattgagattcta

SEQ ID NO: 119618 - DNA, 1111 bp, Homo sapiens
aactgagaattgtatagtttatcttactattttacttactgacagagtaccttattctagaatactttttaaaaaaatattaagtttttaaaagccaaatctctagacacttcttgttccttggaaaccttcttgtctcctgaagagtacatttgttgtggatagtgtgttcctcaagagtaattcttaaactagttggataggtttaaatttcgcaacataggcattgcagaatttagacatacaggaaatcaggattcagggctcatttgttgtaaggtgaaatcaggaagtctctggttaaagattggatgggattaagcagacgttttgtaggcagtctcttcaccctgaactgcagccgtgtgctgtctggaatgcggtctgacttaataacccacccatgccagtaacatacatgatagagcagaattgctgtagttaaataatggattttataaacattagatagtcttttagcacctgcatttttttgtaagagtcaagcaagaagttatgtatgtatgcattttggtctgaatcttgtacttttgttaaacactgatataaatgtgtctcttgaggctggtctgtaacagatttataaaaatgattactgtttcttaggctttaaaaatcatatttttggcaaccgaatctatgagttttattaagtaaaagtttagaccttttattctttgcagattggataatttttcttgtacacttagcaaatgtttgataaatagccctgcaaggcactgtgcctgctgagtgctgtggaggttacctgagtgactctggcatacattgtagcctcagcgaccctgacgctgcagttcaataggagagttaagacaagcccaaaactgtaacagctgcaaagtgataagggctatggaacaatgaaaactgtcaggagagactgggaaaggagaacagtgttttctgattccatgtgaaagctaccccctcaaccccaagaattctctttactttctgtgcccacattgagctaattctctaagtcccagtttcgtaaaacctatgcatgtatttctgatttcttctcattgtgggtacttgaaagagaggaaaaaggaatttgggg

SEQ ID NO: 119619 - DNA, 1101 bp, Homo sapiens
cactgctgattgctgttaagagtttggcctttccctcactctgcttttggagtgggattggctgagggtgtggatgtttccttcggttttcacccttacgtttcttaggcacttctaagggcacctttttcctgtggatgcacccggtaggtagctttttaattcagtggtatttccatcatgagagatcgcttgcagtcatggaaccctcttagtttcctcgataagctggtcaggaaagaatttcagacctttgttttgggttcattgcacttgtcttttcagagcagtaccctccttgcttttcacatctgagtactgagcagtttgcgtggttctggcacgtgcctagaggccctctgaatttgtaagtgagctgtaggctcaactgttgctgttccattttgcaggtaggatgcatctggactcttctgtttttcactagctttcatgaccatgggcttttcagcttcttacaagatttctgttaagcgggcatctccatttcagccagttctttgtcccagcttcaaaagtcataaattttagctgccattgggcccagtgataagagtaggtgggccatggtgaagcgtaaggccttgggaaggcacttgtgcgccgtccgcggcagcagggtatgtcaaggctggagagtggacaccttcttgctcctttagataagggaaagaacatttgcttgaataaaaaattagggtcatatttttctgaactttgtcacctagacattaaatgataatttagaattgagaagagatggcatacatttccaatactctacctctctccagcaattcttggccttccaaccaatatgcccatcatcccaccccaaaatcttaccttttttaaaatttattttttagtaatcaagattctacttgtgagtcacagagtatttaaaaacatgcacaatctgttgttcatggtacctggatacactctctaattgaaaattcaacatttaagggcgaatacagaatgcttgtttttaaaaatacctttccagtttaaagaaccatagaggctaaaacgagattgtctcctttttagtattactcacatcaaaattattcaatc

SEQ ID NO: 119620 - DNA, 1030 bp, Homo sapiens
ttactgcctagtgggaaagtataatactaagtaattaatacattattatagaattatacttgcaataaacattacgaacctaaagttatagtatgtttttagaatgtatacttgaggaatctaaacaggaaagaaaattcttcagttaaaatcatgattttcagtggctcacgcctgtaatcccatcactttgggaggccaaggcggacgaatcacgaggtcaggagatcgagaccatcctggccaacacggtgaaactccgtctctactaaaaatgcaaaaattagctgggcatggtggcacgtgcctgtaatcccagctactcgggaggctgaggcaggagaaccccttgaactaggaagtcagaggttgcagtgagctgagatccgccactgcactccagcctggcaacagagtgagactccgtctcaaaaaaaaaataaaaagtcattattttgttatctttttttgtttctatttaaaatagaaaaccacaatgcctcatctgaccagttggcacaaaccggaggatacaatatggacatggtatttatatgtttttctctcaccaatatccagtttacaggagaagaaatctttaatccttttggttggatatttgatttctgagctggaatttttttctaagctagcaaatttcaggatacaaattgagttatttctgccagcatcctggattggaatcatgagatttcatcactatgattaaaagagcctttccctgctcacaaagcaagttaaacaaaatcagcaagatgatggagataaacgtgcttggtccataaagcccaagacaagtgttctattaagctagtgctgttataaagtgagcacagggagatatggaaggctagtgtgcatcattttggggaactgtactatatgtaatattcgtgcaaaagatgagctgttatttgctccttttattttatatgcgcttgctcagcaccttaggtagcagaagtcatatattggattaaatggctctaggcacttgttctaggggccc

SEQ ID NO: 119621 - DNA, 1085 bp, Homo sapiens
catcacatgtttataaccacttacagaatttgatactttggtgcatcccatggattaaaacatactttaaaatctgacatctatatattaaacagttattgtaagcatgattttgttaatggggatttacatctgctttccaatctctgtagccatatgaagtgtaactagccattatatttgcttctttaaatatatatctgggaaataaaacttcagacaattacagtataaactaaacctgataacaattgaataatgaatgataatctgttcagtttttccctcctgtagaattagatagttgatgatttggtttaaaagtaaaaatattttttaaaaccttgacttttctaaataaatgagaatctgcaaaagaaacaatgcatattaagtactgattgtttcttgactgtcataatggatggcctctctctctctgtcgtttttaagaaagccaaattacaggatagttaatatcttaaaggactcttatctcaaatactaggatgctgagacataaagggggcttgctgagatactgtgtcagtaaatgaaactcagcaaatcataatcatctttggattctcagtcatgttatgtaagtggtcacacagatggatttttaactctgattttcctaagttgctttcctggccattaaacggttgggaaggtactctcggatgcagaataagaagaatgcattactgtgactttaagaaggaaattaagtagggagggaaaatggggatgttgtgactgctgacatttgtggcctcctttcatttgcgtaagagatggactggcttctctgtggctgcggttgccatggagaggtagtgggggaggacttccaggaggcagcccatgagcgagagtctgccttagagctgctcctagatgtgacgtgaaggggcagggagctcaggtgtgccgcggcggcacagataatggggatggccgacctgtcatggctggtaacgtgactgtgcacatacccctgggtgtgacggatgtgtttgtgcaagtgcctgtggattctctatgtgaaatgaaaggattgtaatgttgtgtgtgttccc

SEQ ID NO: 119622 - DNA, 1051 bp, Homo sapiens
cagatacccagttggccttcttcatagacatatgagtgtatatgtctgtcaagtgtgtgtgtgtgtttctgtacatttctacacattcatcttcatggcgcaaaatgtttagaattatgtctttttaatataatatatgttgagcattttccatcaataaatattttgtaaaaaatacatttaatggctaaacaacattctcttgtatagaaatatttaagtatttgtttaaccagctccatattgttttgtatatagaattcctgccaagttattattaacaaaaatgctggagtaatatcgcaatagcagttcatttattagacaactgtgtgtcaagggtctagtgaccctggcaactatgtgctctgtggagtaagatacagtttgatgtggaaagcaagcaaacagactctcagaatatgctgtgaggaccgctgctgctctagggttaggaaaagaatgccagggacacagaggagtttgagggagatgtcagggaaggctgcctaccagagctgcaggggaacagacaacatggttattgactgatttctttgctcaggatatttgttaggataacacttggttagtatgatgaagaatatccttttctatgtaatattgagggttttttgaaacattaaagatagatacgatttaatcaagtacatttgggacattatttaacttatctttactctccttccttgacctgttgctgtgaaaaattataatatgttgcttctgaatattgaaatagctttgcttcctattttctgtgaatgtgcttcttgatatagattgttaaagctgtgttcatgtgtggtgttggtttttctgcccctgtggctgggtttggtatctgaggcatgccagctgtatgaaatactgtagaatgccttctgtgttatcctgggctctggagcagtttaggacatgctttattctttaaaatttgaaagaagttgataataaggttccaggcccagtgagtttttttaaaaagcaaattcagtgtaatgctatggcaactctctcagctttgtca

SEQ ID NO: 119623 - DNA, 1033 bp, Homo sapiens
taatagtgctttggtaataaaagtccttttacatgtttttcaagtactatatgttatgtgatttgtttattatttatagtttgaaaatctgcaggtaattcatgtatttcgttttttaaaagtgggtcttagccttttgttacttacactgtgttaatacggatttcatgcaagcattccatatttttctgtctgaagcaaaactaccactgagcacaggatccagtttctgcatttaatgtgtgtttttttccaggactatttcaacttcactcatcgtttcatgagcagtaactaaagtttataaataagaaaaattgtcttattccaaagattgcctgtactactctcaaattatattctggatctgataattcgcaggaagcaaataagacattgctgtgggcgatacatttatcaggatgaaaatttagttatttttgactattgttgagatgtaatgtcctatatttcaaactagcttgcttcctttgttctgttctcccactttgccttggcaagttggatcaatatgcaattgaaagacgtttgatctgtaaatagaaggttctctgaatttcttggcctttctggcaagatagggagagaggcaggtagatcagagtttgaagggcccatggtgtgcggtgtctgccttttatttatttggagtaggataccatattggaggttacatcttccatggccagtgagcagcggtagggtcagcattggagacaacttctgagctgatgcgtttatttaaattgtacttacacatttgggatatgtagaatgttatataattatcaatattgtcttcagttcagtacaaaatagtaccctgggaatttgttccttttgccattttaataagtacctagaccagtgtgttaaatttggaatcgattactgcccatgtcatgaagtatgtatatccttataaagtttaaattaattattattgaaatagagcatgcacatatttacaaaatccagttgtgcccagagccccaggtcaaagaacagcagg

SEQ ID NO: 119624 - DNA, 1080 bp, Homo sapiens
gcttgaaactttaaaaggtgaattccaaggtaccagaaaaaagaagctcaaagctaacatggtgaacagatactaacaaaaaaattaaaaggccttatgggaatcgaggccagatatatgcctacaggcttacctgtcctgagatagcatctgaggttcctgaaataagcctagtcctcctgtccagtgactttgggccatgtgggaaaaaccctaaccgcttaaaagtaaaaccctatatctataccatgcaaaaacaaacaaaaaaactggcccagagtcagttgtctgaagccaatgaaactgttaaggtcccaggcagaagcaattggaaaactgctttatagagatgtttctgcaacccagggtacttaggattccatggaaaacaatcttgctgaggataaacttacaattaaaagtaaaaagcatgcaaagaaacaaatgagaaagagccagcagtcataacaagtggagaattcacactccaagaactacagatcatagtgtagtctgaacgggactttaaattaagtatgtataaaatgtcccaagaaataaataaggattagagaatagaaaacataaggtaaaggagatgttatcaaagtagaggaggcagattttaaaaagaaaatataaactgataaataacaaggtattagaacatatagataccaaattttcttttgttcacattttagtcattggagttgtacgaccacaatctgtacttttgcttgaataggaatgaaatttgccagtgtttacaaatgcaatagcaaaatcatactacttaagcttagtaaacattcttttcccttaaggaaatctgacaaaacacatgaagtccaaggcacatagcaagaaatgtgtggatttaggcgtctcagtaggtttaatagatgaacaggatacagaagaatcaggtaaggctttataccatatttttcataaatgctatttataatgtacaatttttttgcttccataccctttccattcccactgattctgcctaattctgttttcattacctcttatttatatgcagtagactcctaattagtttttccatgt

SEQ ID NO: 119625 - DNA, 1067 bp, Homo sapiens
ccccgcccctcaggcacacattccaggtctccagatcttgaacatagcattgcccaccttaatcccctcagtcagtcaagtagccgttgatgcacagggagctccagaaatgccagcttcccaaagcaaagcatgcgagacacaacccaagcagacttctgtagccagcgcaaaccaggtcagcaggaccgagtctcctcaggggttacctacagtccagcgggaaaatgcaaaaaaagttctgaatccacctgcccctgcaggtgaccatgcaaggcttgatggcctgagtaaaatggacacagagaaggctgcctcggcaaatcacgtgaagcccaagcctgaactcacttccatacagggccaaccagcgtccacgtcacaacctctgctgaaggcacattctgaagtttttacaaagccctcaggccagcagactctctctccagacagacaggttcccaggcccacagcactaccgcggaggcagcccactgtgcacttcagcgacgtgagcagcgatgatgacgaggacaggcttgtgatagcaacctgatggattttattttttatttgctttttttttatataacacttaaaggtttctttgaaaaccctcctttccttaaagcacatttttctgacataaactcatgactaatctttgtgcaatcatgaacttttgaccaataattgttgttttgtgtcagctccagccatttttgtacatgttgtatagacaattgtgccttttaggagctttatgtttagaaactgtacagattgttgaatatctatatacataaaaatatattatatatgtatatgaaaaccaggtagttatttgtgtttagtaaggaaaacctgtcaaataaatcaaatgattaaattatatgttccactgttgaatataaattttatggctatggggcagagtttctgtgtataaattagtatgtaaactccatatttattgtattcatattagtctttgaaaatgggtctgtcctccttgtgtaagacagtaactttacacttcagacagattttctgtgttatgaaatgtt

SEQ ID NO: 119626 - DNA, 1011 bp, Homo sapiens
tcaccactaacttcatagctctgccttttctgaatgactcctaagcttccatcctagtttgttttctcttcctgtccaaggtcccttattattctagcaactataataaaagtgagggcattttcctgaagactgcctttcaaaataagttataaagcagatggtaggttttgctttaggaaactaaactcttggaaatgggactaaatcaaacaaaatgtgtgtgtgtgtgtgtgcgcgtgcgtgcgcgtgcatggtgcatgtgttagagcaaagagaaccttcagatgatgggtatttatgccctgttgagaagtttcgacaaaagagaaaactgcatagaaaaacaagatgcactgactaagcaaccatacccttatggctggaagaatggtaactgaatgtgccagagtggccaactgccttggaatataattttcctgtcttgatgatttgtggttttaatcatgtatatcttgtcacttcttaaatgtttgcctctgactttggagctgaagacaagtttatttagaaagctttggcattttctatggcatgctgtagtagtccatggttcccactttggaattgttaatcccctacttctatgtttcagattcagcgtatggttgtgaggggtctcacaaaggaccgataatagtttcttttaggagcaagattgttttcccaaccaagtgatattggaaattagtctattgacccctttgcttagcccaggaggaacagagccaaagcagcagttagtaaatgttgtttaccttctactagtacttttatcacaaaacaataaaataaagtgctaaacaagagtttcaagtttcagctgctactcaattaattactttgtcaccagattaaacctagtgacttgcaatcttttattttggttaaattgctctggagtccaatttaaagattggctcagacaggacttatctatgtttcatctggaaataaataagccagacaagcactcagtcccttctatat

SEQ ID NO: 119627 - DNA, 1039 bp, Homo sapiens
ttctcccggaaaggcagaggagagagtgtgtgtaaaggcatgagtgcaaatcgcatgcacacattgcaaagaacaagaaagctggtaggactggaacctgtcgtgggaccaaggacatgcaaaggatgagactggagagggagctggacaaggcagggccccagaggcttttgctccaaaaagctcatgataacaacatgagaaagatggatcagagcagcccgaaactagaggcagggaggtactgggttgatcttaaatatttggcaagacatgataaaggcttgagttagagcagtaataggaatggaaaattaatttaggattaagacatttttaagaggtgagatactcaggacctagtaaacaatgaccatgaaggattaaggagaggggtagatgacctctaagtttccaccttaggtagactagtggttctacttaccagttcagaaatcagagaagggggcagatgctcacaggactggttaatgagctcacacttacacaggggagtcttggggtgacatcgttgtgaaggattcaagcaggcagtgaatacatggattgggaactcaggagaaatattcatcctcactaaaatcataagcaggtaagatctgggtcaaagattcttgcccagtggattgaattgtgttaaagtgtgcatcccttcaaagtctggatccgggatgctccagtaggaccagctcaagttcccacaccagggtctgccatatacagtcaggctattgctttacccgactgtaacttaaaaataccaccctttcctatatttgccatgacatggcaaaaagttaaggaagctctatgctagggaaaccatggagagagatggaagggaattgggatcagactcccatggaacatcaattttaaaggactgcagaaaaataggagccactacaactctggggagggatagaagttggacaagggcaagactgggggaaggggtgttctggggaaatggaagaaacagcaggttcaaatgcagcagagagaccagggagaccat

SEQ ID NO: 119628 - DNA, 1050 bp, Homo sapiens
ctttaaaacgcatataatatttaagcaaacctgagtttatttctgtatcttttggctttaaatgggatatttttaaaaatatacaaatccacatcagcctagaaagtgctgattatgtagccaacactgtctttattttccttttccttgttgatagaagaaaaacatgagaatttttttctgttgtcttaacacactcctcattaccgtttacaatttaatttggtccaaaataagaaaataatctttctacttgtgctgaaaaagcttactctggagagttggaatcagtactttcagcagcctctggtaaaccagaaacttaatcactcgcagcagctgaccctcctgtccctggtgatctgaatgccaccatcctgcaaagacttccacttggctttgcagagcattccacagccattgtcattgggcagatgtgagctcagcttctaacgggaactcagaaatgccttgtgttgcttagaatcagttctagtactccattttaatatttggaatttcatgtatcctaagtaaaatcccacttaacgattaagcagaatggatgtattattttaaagtttgtttttatcttcattaatcatttatacgtctcttccctaacttaagaatataagaaacctcaagtactagttatgtaaccaaatggatccttacgttcttcttactgctcacttatagattgaggaaataagatgttcaatgatagaataacatggaagagtcttaaattctttagcaaatgtagaaaactagttaggactctttacatgatatagcttgttacaaaataccacctttaatacaatcctttttccattgagtcaaaataatagtggtgtatagaaggctccaacagcagtaattttcattcattttaaaatacactcatgttcaaggttagaaattttcaattgtcccacaaaaatgtgtgtggtgtgcccatagcatctatgtttaatatatccgtggattgctggaaatgatgaagaattgggtaatacgcaaacattttgtactttattcaat

SEQ ID NO: 119629 - DNA, 1100 bp, Homo sapiens
acatggcgaaaccctgtctctagtaaaaaatagaaaaatcagccaggcgttggagcactcgcctgtagtcccagctactcggtaggctgaggcaggaggatagcgtgagtctgggcagcagaggttgcagtgagccaagatcacgccactgcactccagcctgggtgacagaatgagactcaatctcaaattaaaaaaaaaaaaaaacacctcaacaaaggaaactgagcaccacagacccacgcttccctccccaagttccctacctcatcagctgatgtaactaagtggtgatatttccaatttctaccacttagcgagatgagggctttgctttgcagaaatgaaaatctagaggccatggtcaggagagaaatattatcttatcagagttatttctaaggattttgaatgacttagtgatgatatacaaaatcacctatttttaatgaggacctcataggtgatggagaggaacgaaatataataaatgagaataaattcatcaggacactgagaatatattgggctgtaaaattttatttcaccttgattcactgttctgatttttagatggaaaaagattccaacattaattttgcaatagttgttattatccttacctatcaaaatattaataaagtgagaaattagttaatttatttaaggatatccataaatctgacagagaaaagtggccaaggccttgtctgggtgcccattgtgcccagaatattctagtgatcatttctaagaacacaaaagaaatctaaatcattgcctctgccttctaggagctaataattctggagggagataagatacgtaagagaaccctaaagtaacaagaggaggcagatttgattaaattctgcattgaagacttgaaggcataggaaataaatgccaatgcaaacattgcaagatgagaggaataatgtgagttagactttgaaaggaaggtaggagctgaagtagagagagtattcggagaagaaaggaagaaatcattccaggagaaatgaatgtaaggcatttgcatcagctgaggtcatttggatgatataaccaccatttctttgttcttcttttgtatgtca

SEQ ID NO: 119630 - DNA, 1016 bp, Homo sapiens
attcacaactatgaatagacatagaaaaaatgtggtgaaagatgacgctggtataacccagaactcagaactaattttgaactaacgctatagcatgttacactcttttgcaattacaaaaagttttgacagacattatttactttaatttttccatcaacactgtgtgatagcttttcattattcttattatttccattatattgctaaaaacactgaaatccaaataaataaatgacaggcacagcaaacccaggtcttcttatctcaaactccgtatttatttcattaccccatagaaaaatgaaatagaacagtcatataagcaagaagcaatggcaaagaaaaatctcaaatccaaccattttctaggctagatgtttagtcatttctttggttagaatgagtttcaaaggatgtaaatctctggagttcatttttaaaatataaagattatcattccatatgtgcaagagaaaaatctcaaagtctgggcacttcaccaaaaggctacaacccaagaagatgaagagtgagtgggcaacacatgcagggagactaactttattttttcagtattttctccctattacaaactttttcctagactccagttaaacgaattgattttatgtctcattgtatgccattgttttttctcttaaagttaaaagagtgactcctaattttaatatgtgtagagttcattagggaagtcataatgaagagagtgagctattcgatctagaaaatattgagttaagaaagtttggaagttgaagccaggtgccgtgcctcatacctgtaatcccagtactatgggaggccaaggaggacagattgcttgaggacaggagttcaagaccagcctgggcaacatagtgaaaccccagctctacaaaagtaaaataaaatttagcacagactggtagcatgtgcctgtagtcccagctctttgggaggctgaggtcggaggatcacctgagccctggaggtccaaggctacagtgagccct

SEQ ID NO: 119631 - DNA, 1025 bp, Homo sapiens
aatattccgtatgaaaacaccagtatcggggtataggcagcgacagcacttgtaaattcagcatgagttgcatggttggccaatgttggtgagtcctgtggagatctggagccagaatggcctgaccttgagcacaggggatcttactgagacatcaggaagaaataatgcccctggagtcacagtctaggtcaactacaaagcactagatctgggagactgtgaggaaggaggaaacacacctctactgtccatctcagggtcaccggcatacactgggggatggctcttatcacagagatacttactgtttagggccacatccccctcccttacaagcccgagacaagagaagaatgatcagtggtaagttactactcatacagccattaaaaagttcaacagagtttcagcaaatacttctgctttttcatacaccacagggatcatgatgcaccatgctatttgcgttcagcagggtctagaacaaggaataaaggaaactgaaaaaaaagcacatcttctctgatgtgtgtgcacatctgagaaacttttggaaccaaaattatatctccatgcaccttctactactaattaattacagcaacctacaatatataaataaccttgtaccagattctatatgtaagagtctagaagtggccaggaagacccctctgcaattgaagcaactgtgttgaatgaacagaacagtgacctcttctttggaagacatgggttccaccccagagctaccccttaccacctgtgtccttgagcaagtcattgaaactctcagaaccatagcttttcacctttagatggggactctgataaatacatcacaataatccattaaagggctttatgaactctacagctgtataattgtcagcagcatttgctaacatatacagtatgtagagaagttatgaagttggagtctttactgtatagattagtctgctcaggctgctgcaatgaagtaccacagactgggtaactcaaagaatagatatttattt

SEQ ID NO: 119632 - DNA, 1007 bp, Homo sapiens
cacaaagcaactgtgtggtaaagggtggatattattaaagggagacatgtcttcaagtaggagccaagaagtgaatgttcccatcactaataccaacctaaaatagcattagtccaaatgtatcatgcacgtggtcagcatagccaaaggttgcctcactgcaaggttaaagaagaagctaaacaaatttcacttccttacaagggcaacaggactggactccatccttcttgacatgggttgtttcctctttcctatttaagaatgagcacattgggtgcaattctccaaggctccccactggtttattctgccctcctggcctttgcccttagaaaggtttatagccttctccctaataactcagtacataatcattaagaagcatgagtaaaatgggactttaattactttattaaaggtaataaatatgtctatgcccttgagatcatataaaaatagcttaaaatcattggccatagttatattttccacgagctgagttttaaaatatgtataaagtctgtggtaaattaagagagatttcagcctactaacaattcctaaaccattctaaatgggtcaggaattcaactgggatatctatgatttttttgtttcttcttatttcctgataatgccatatgttttataatttagcatcttattaaggaggtgagagccttaaaacttttaaagtcaattcctgtttttaactattaaaaataatttttagtggagagtttgcttattattattttgacacaatgcctgcattcattttaagatttaggggattactgagctattcttttacatatctccagcatatcatgcagcatctggaacagagaagacattttcatttatgtttattaaataaccaaaacatacatatgaattaacaaataaactatatataaaggcaatagttagggctttcttttagcatttccttttgtctttaaactagtctcttttatagaaactactcattacggccgggt

SEQ ID NO: 119633 - DNA, 1037 bp, Homo sapiens
gagatcatgcagaatatggaacagcactggctccagaggtcatcaggtgactagcctgtgaggctaggctgtcaggcaaattggccgtgagctctcactgtgtcccaagagcacttaaaatgtcaaaaccttcactcaaattttagcacacaaagtcccacgaccccgttgctgcaaatccaaagagccatatgacagttaggcactgggcaaccttgaacttggtaggactgattaaacgctaacagcttccatctgagaccatgtctccccaggaaatgtccgaatggataaaactgttctcaaatcatataggggctcccagctgactccagaggcccaccctgcatgctctctagtacgagagaactccttagaggtgggatgatttttctggtatccttatcaaactccagctctggagtagcataatgcatcgcacatttatctcagcccctctcaaaatcagagaggatctcagggcctcaaatcctgagaggtctgatgatttttgtggcccagaatcatcagcagctgagctgcaaacctttgggcatgtttcatgatgaagaagaggaagcgatatcccaggtgttcctgaataacaaacacgtcactgttcacaaacaggaggtggtcacagaggtgacctgtttacaccctactcatttttgacacttttgaagatgttgtttctgggaacaacctgaagcagactctgaagacactcaattccactgagtggtctgagacaacttcttttcttttctttttctttttttgtttttttgttttttgataaggagtcttgctgtgttgccaggctggagtgcagtggcgcaatttcagcttactgctacctccgcctcccagattcaagcaattctcctgcctcagcctcccaggtagctgggattacaggcacaagcctcccaggtagctgggattacaagcacatgccaccatgcccagctaatttttgtatttgtagtagagacggggtttcaccatgttggccaggatggtctcaatctctt

SEQ ID NO: 119634 - DNA, 1490 bp, Homo sapiens
ggagcaatcaggagacagaaatcacacggtcaactgaaaaaaaggaacaatattaaaaaaaatcattaaactatgacagtggagtaactataaagaggactcttaagggcagtctagagctaaggaaaagtaggcaagtcaggacaaatttggaactgggacccctcctaaggactgaggttcaggtccactggagaaagtgtccttgaagtccactggatgatggagaatttggctgagttgtccacaccagagctgatcaacagtcactcggcagcaggaactggccctctgtgatgaaggtgagcctaggttgatgggcagttcacaagggagttggagctcaagtcctggagtatgtcttgtctgcataaagacggcttcagcaatgtgatgccagggcaagccagagcagtgaggtgaccaagggactgcatattctgggtgtgcagctggggagcctttggatgtccacacacacacacatctgcaccaccagagtgagagcaagaaaatgcaaaactcagcatcaaaaccaggaggagccaggggcagtggctcacgcctgtaatcccagcattttgggaggccaaggcaggtggatcactttgagctcaggagttcgagattagcctgggcaacatggcaaaaccctgtctctactaaaaatacaaaaatcagtagggcaaggtgatgtgcacctgtaatctcagatacttgggaggctgaggcaggagaatcgcttgaacccaggaggcagaggttgcactgggctgagatcactccactgcactccagcctgggtgatagagtgaaactctctctcaaaaaaaaaaaaaagaaaaaaaaaaaaaacaggaggagaagtgcccttcttcctgcaatgtccctccagtaccctccatggacatagtagaagagaaatgcttagagtccagtttactatcacagagcaggtactaagaggtgaatttggagctgagctataataaatctgaccagcacagttgcccaaactaaactccttcctactcactcctcatagttagttgccaaatcttgctaacaacttagcagataaatgtctctagaattgaacccatctgcttcgtcacccctaccacctctgagttagttcatcctcttctttgctctcacatggactttggccacagcctcatgactggttgtcctgccaccagtacattctcattccagccccatacctgcatgactactaggtagcttcctaaaataacaaaattatctttattatgcccttgattgaaaacctctggtacctgatcagctagtgcgagatgttaataccaggcaaaactgtgcgtggagaaaagggtaatacatgggtatctctgtaatgcgtggcaaaaagggtaatacattggtatctctgcctgctcagttttccataagcctaaaactgctccaaaaactagtttattaacttaaaacgaaacaaaaccaccctc

SEQ ID NO: 119635 - DNA, 1037 bp, Homo sapiens
agcagttattttccaccagtctgaaaactttatgaggcagaaatcacttctgctttcttcacatttgtatatcctacagatccatagcaggctgttaataactatttgttgaatggacgaattaatatataaatgaataagtgaatgaacaagtaatctataatgttatttccaatagactttatctttttcaaccctaatgttctcctctgttggctcattgtagttgcgccatgaacctttccatatccctaaaggaaaggccaagctgattggcaacagacttaggagctggatggttctgcatcattagtcaaaacagacttcctgttctagggtaatctggccagtaggtgatgctgactgagacagttgaaaacacctagtgtcaagtcatggctgggtgttggtaagctgtacagagcccctgagattatttggattgtttgaaacaatcatgatcatgacattaacataaaagctgagaaatatagttgggttgaagggaaaatgtctcagtggaaggaaaggtgattaaataaagaaagaggtatatcccagccagctctaaggccttaagagcaaaacccatcatggtgactaggatagggttgttggtggtggtcatggtggtgatgcagatgataacagtaaactataagatgtatgccttctctgtgccagttatgatgctaagtatttaacacaaaccacatttatcttgacaataatcctatgatataggctttatttttatcccccttcaagacttgtgaactcgtcaaaggtcacacagttaaagtaataatggtcaagatttaaaccctgaccctgcccgattccggtacctaagctttgaaccccatgttattttcctctaggaagaggtaattgaggccatatttatctttcaattaggtttttttatgtgttcatcatctacatttcattcacatgcacttactcaaagttgctctcacattctgaagtatttgaatatttgacaatttagtgatatattaaattttacttccaag

SEQ ID NO: 119636 - DNA, 1075 bp, Homo sapiens
attatctactgttctaaagacaaggtattgtgcaaagagttccgcagtatatgagaaaaggaatcaaagctactcatacctattcagggaaataaaacatgtacataaaattttaacaaaatatagaaaatgacagcttccatgagaacagaaaaaaaagattattgaggatgataagagggagatattaattctggctagaaaaggctttagagatgtttttaacctaagagtcttgagagctgaataggtatattttaatacaggagaatggggaacagaaagagggaggcaggagacattttcagcaaaggaaggaaagtaagtggaatgccaattcacaggggaaggcacgcctggagtgtacatgaggcatggtggccaggccagttttgttgaacgagagggtagagagaaagggaccgatggtagatgcattgaaaagaatttgaataccaagcccagaagtgacatggtcagagtttaatctatgtgttaggtggagtgaatggaagttgatgggggcaccatcagttacaaatgcaactgcagcagtggagaacataatggtaataaataataatgataataaataataataatagctctcacttgttaattgcctagcagttacttcttagattatgtcctttaatctgcacagcaagcctgcatggtaggtacaaatacagctgttcctcatttttccaagatctgtttaggtacaaacacagtctttccttgatatccatagggaaccacagtgcaggttcctggacacctccactctgtcccgcagtcccactacccccgccatgctcaagttcctgatagaaaatagtgtccgtagtatttgcatataatctatgtacatcctcacacacagtttaaatcatctctagcttacgtataatacctaatagaatgtaaatgctatgtaaatagttgttatactgtattgtttattacatttgtgttatttttactgctgtattgtgattttttattttttcctcacattttgaacccccccatggattgaacagagggctggctgtacagtcaatcctcattt

SEQ ID NO: 119637 - DNA, 1377 bp, Homo sapiens
agcttctaattagaaaagtaagtgctactgggttatgggccgagggagtgctgactctatctgttacaatgagtgtgagaggtgtggggaagtatgggaaatgaatattaaattaggaaataggaaagcccacggcctgtgttttgcattcttttaaacttgctatgacatttctagagattacaaggcattgttctgcaatgtttagcagcataaacatgctatctccatgatggacatggaccagaaaattaatttgcagctacacgttaaagaagagctcactaagatcctgaccagagtggaaagggtgatatgttaataaattatggctgctctgtattatttatatgaaaatactcttaaaacttcactctgcaaaaatctgcaatgaatttttttctctatatccattcttcagaaatgacattaaaatgttatagcgctgagacattttaactattaaggagctcattttcaattgcttggtatagaagattcagtttggccaaaagtctttctttatgtattttgggtctttcttttcttttatgagacagggtctcactccgtcacccaggctggagtgcagtggtgtgatcaactgctcactgcaacctcaacctgccaggctcaagcaaccctcccaccccagcctcctgagtagctgggactataagaacacaccaaaatgcctggctatttgtaaatttttttgtagagacagaatctcactaaacgctgttgcccaggttggtctaatttctgggctcaagtaatcctcctgcctcagcctcccaaagtgctgggattacaggcatgagctgccttggtaggctgaatctttctttaaatgcaccagccagtgctataggtaaaatgggccgattggtcttatgatcatccattgaaaagatttggcatttagatatgcttttagaaatatatggggcgggaggaatgggaaaatttaattccttttcccccttctgaactttatttctgagaactcaacttgccaacatctatgaaaaatagaagaggcttagcaatcaatcactgggggagggggtgatggaaggggaaggagacagctggccaaggaattctaagcttcaatcattttgtagttcggaacaagagagcaggattgccgacttttagatttcttttcagaggtggtgcgtgagcagcatatggaatattctaataaagtcaagtataggtttaactcctttaggaaacaatcaaacaggtaaaacgtgagtctttgggtgaattttaaataaggtttgacttatgtgtaacctgggatcttagaataaaaagggactttgtagagcatctgattcaacccttccatttgactcaagaaga

SEQ ID NO: 119638 - DNA, 1067 bp, Homo sapiens
ccacttactcaagaggctgaggcaagaggttgtctgaaccctggagttcagggctgctatgagctatgatattgccactgcactctggcctgggcgacacagcaagacctggtcaaaaaaaaaaaaaagaaaagaaaaagtaaaagtcccaaggcagcgcaaaacatcaagtcaacaattggtaagtttaaatttaaaaaaatctttatatgacaaaggactcacaaacaaaattatgactgaaagactggtactacacataaagccaaaaacaatggttatactagaagaaaaaagagtctatataaatcaatgagaaaaaaaaatcaataaacaagtggacaaaatatgagcaagtaatttgtagacacagaaacctgaatacctaaaaggtaatcaagatatagcaattaaataacccagcattctgaaaacccaaatgaaataatggtagtaccaagtaatgatgaagtggaaagagaaactttcatacactgttgatgagagggtaattgttaacgatcactttaagagctatctgtcaatatctagttaagctaaagttgcacgtaccccatgacacagcagttctacttatattctttagagaaacctttgcacaagggtacaaaagagaattgattaggatgctcactggaggattgtcattgacaaaaatttacataccaactaaataaccctctgtaagggttgaagaatcttgtgatagaatcatctattggaatactaatgcaacaggaaatatgaatgaactaggtttacatgaaccaacatgcaataatcttaaaatacgttgaggccgggcatggtggctcacgcctgtaatcccagcactttgggaggccagggtgggtggatcacgagatcaggagttcaagaccagcctggccaagatggtgaaaccctgtctctactaacaaaatacaaaaattagccgggcgtggtggcaggcccctgtaattccagctactcaggaggctgagacagagaattttttgaatccaggaggcggaggttgcagagagctgagacggcgccactgcact

SEQ ID NO: 119639 - DNA, 1047 bp, Homo sapiens
gaattgtggttagtgcaactgaggaaatgaatttgaattttattgaattttaattcatttaaatgtaaacagccacatgttgctagtggatactatattgcatagcaccattagaggctgcaaactcagggaggacagttcagaaagatggatcctcaaacaagagaaatgactctcccaggtaaacttcataccttttatacacttaacttgaacaaagggcccctacagcccagggcacatcctttaatatttgaggctaagctggtggctgtgtcagtgtttggtatgatacaatcacaatgcccgttggccaattaagatagaaacatacagagccctttagtattctgcaagggaaataaaagattgcttcagtcttagttgctttaatgaggtcagatggggtttctgcaggtccactgttctaacctgtggggcagagagtaaggcggaaaaggcatgcaatttaaaatacacatttacggaaacatgtaatttgctggtaaatacacaacctcctcttttcagaagggagttaaggggtgatagtttggaggagggacccaaggaattacaaaagagaataacaaatgtttgctcagaacacaatgcagtaaattccctggtgcactcaaccagtataacaaacaggtcctttgtaatctctaagataaggcttataattagccagggaccgggtgacatgaatctgacatgagtagacatagtggattcacctgtggttggcctggctggtagtccagcaaaaggggggtggttgctgaagccctcaatgggtaccaagagggatcgagatctaattacagagacctgcattctacatccatccccctctaggggaggcgatggcagctggacacctgactttcctaactccagaatgaagatgaagctcttattgtgctgatttgtgcagactacttgcagatgagaagtagtagaaatgatagagtggtagaattggagtgatcagaagcctgttgtaatacagtaatttaatatcctcagtggatcgttgacctt

SEQ ID NO: 119640 - DNA, 1101 bp, Homo sapiens
ccttttctctgtgaatttacaattaagtgagcaaacacaatggccactgaggaagtgctttatcctgtttctcctttgctatgtcacgggcagaaatatgcacgatagaggaagagatgttcttgggagggaaggtgagcacagtatcctttcgaaaagcagaaattggtggcaagtcagaaggctcgaaaatagaaggtactaaatggagcgaccttctactttacgttccaaacctgggtatttccgagagtgaaatggggtgctataactacttaggctgaacgataatctaaaccaggcctgagctaagcaaagcagggagaatatggtcaccctgtacaaaaccacagagacagatgtgcaggccccgaggccagtgctgttttacaaacagaaaagaagcgccagttaactttcaaaagaaaacagaagggattgctggaccccagaaacagaggaacactaacatggccctccactgtctaccatctcagttaaattaattaatggaggttgagtatctttgcttctgtacagaattgaatttctttgttcccagtcctcgcactgtttctgccacctctcttgcacctcttctgctgaatgtcttgtctggaaattctgtcccagtgccatttctttcaccaataatttattttctattcctttaacacttctttttctctccaaagttctgatggctcccgtcatcagctcccatgccaccaggtctagtgcctctgccccacttccaggccctctagacctgcatgacacacacgtcttaccactgcctctccttggaccagtcctgggagtcatgcctgactctcctggagtacttctcttcatgttcaacatattgttctttctttcttcctcggctctggttttctttccattctttccctctccttttcttcttggaacactcatctattccacataaagcttagatgtctcctaagttcatttgatttccttcttcccaggtagaatgtgcttcaacaatgtcatatcggttgactgcagcaggagcaatcttctgttgtgctctgctcatattactatgtattaataatatgaaatacacgtgac

SEQ ID NO: 119641 - DNA, 1342 bp, Homo sapiens
tttttttttttgagacagagtctcactctgtcacccaggctggagtgcagtggtacaatcttggctcactgcagtctccacctcttgggtccaagtgattcttctgccttagcctcccaagtaactgagactacaggtgcatgccaccacgcctggccaatttttgtatttttaggagagaaggggtttcaccatgttgtccaggctgatctcgaactcctgaccttgtgatctgcccgcttcagcctcccgaagttctgggattactggcatgagccaccacgcctgacccattctatgaatttttattgacaaagagatctgggaccacaagtggccaggtgtttctgtgccagcaagcttgagacaagaggaataaaccattgagagaagtgacatagatgggaccagatgacacacaagcccctttttttcatattagggattccagactatcccataggcagtaggtcactgtgaaaggctttaagcagggaagtagtagagttcatattttctttttcttttttttttttttctgagatggagtcttgccgtgtcacccaggctagagtgaagtggtgcaatctcggctcactgcaacctcagcctcccaggttcaagtgattctcctgcctcagcctcccgagtagctgggattacaggcgtatgccaccatgcctggctaatttttgtatttttggtagagacaaggtttcaccatgttggtcaggctggtctcaaactcctgatctcatgatccacccgccttggccttccaaagtgctgggattacaggcgtgagccactgcacctagcccatattttcaattcaagacaaattgtctgggcaaaggatatgaaccagcaagtcaaagaaaaatgcaaattcccataaacataaaaaagatcttaccctcactcatattataattaaggatatacaaattgaaactactgagataccatttgtcacttatgactttggcaaagataagaaatcgataacgacactctgtcagctggtgttaaagtagactgggaaacagctacccatacagcactggtggaaagaggagtcagtgcaagatttttggaatacaatgtggcaaaaataatcaaaattttagatgcacttacccttgaccttgtaattcatcaacctggcaaaggatagtaagacaggaagagcattccacatgcaggaaaaagagaggctgcaaagtttcagatttgaggaaggccatgcccagaagaaatggcaaattgccaggaatttaacctacatatatatacttgcagaaatataataagaaggatgtacaaggttgtttgttacaga

SEQ ID NO: 119642 - DNA, 1062 bp, Homo sapiens
agggcgactagtaattgaccaagaagacaaaacagaggagaatattctaaactgagggaaagtgacatgcaaaagcctagggttatgggaacatcaggcagtttaggaaactcagcagttcaggagtgagggtggatggtctgggtaatggtgagaaaagtgggctggaactaaatgggaggtggggaagccgtgagtgctcctcttcagttcctcactgggatagggagaggcatctgtggaaggtgaggatcctggaggaggctggggaagactgcagcagctcttgggagaatggccaaggccacctggtcaactttgttgagcatggagaccctgaatccatgggccaccaaataagtagaatccacaggagaagtgatctgggccataggagagattctgctccagcttttcaggtgccataggtaaggttatttccaactgggggaaccagagcagactttatagaggtacaatgtggacatgaagagatgaaccaagcaggagccagcccatggaaggccttgaatgatgtatcaggaaggtttagtccatggatgggttttaaactggggagctacgtaatcagatttgtgctctaggaatgtcattttggcaggactgtaagttagactggaggaaggccacgttcaaggcagatagatcattagagaagaatctatggcctccgagatggagagtcagaactgcgtggtgctccccaacacggggtgccagtggggcattgagactccctactcctccctgctgtgctgttccagaccatgcttctcccaggcaagcctacaacccacagggttcaaccaggttcccctccagaaatgtggggtatggcagcaggctacatcttcccagaaatgccctggggtctagtctgaccctgagcccctcaaatgtggagcatctctaggaagctcaatggcattgtcatggaacccagcagttggtcctaggtaggttccagcagcctggaatcccctgtgggagcctccttactgtttcagtagcccacacttgagtgggcccaccagtccagca

SEQ ID NO: 119643 - DNA, 1040 bp, Homo sapiens
gctctgttgccaggctggagtgcagtgacacgatcttggctcactgcaacctctgcctcccaggctcaagcgattctcctgcctcaccctcccaagtagctgagactacaggtgcgtgccaccacacccagctaatttttgtatttttagtagagagaaggtttcaccatgttggccaggatggtctcgatctcttgaccccgtgatccacctgcctcggcctcccaaagtgctgagattacaggcatgagccaccacgcccagcagtatagcttttttagttaacaaagatatttgatccaagttggttcaacttaagaggtagaaccaaaaacatcatcctcgatgcctcttagaaaactgacctgcaaaatatccagactggcattacctgtggctccctgtgggagagaactttctctaggtcatcgctaacaatgtcatgcatgggtctccagccttgtgtccatcccgctcttccctttctcagcatctccagccacagcatttcagtctttcacacactcagtccctattagtcgccctgtgtagctttagaaaactagaacctcaattattatctttctctcctgaatctgtagcttcactatcaaattaatcctttacccttgcttttaattttttttaattatggtaaatacagataacataaaatttgccatcttaaccattctaaagcatacagttcaatggcattaagtacgttcacatcattgtgcaaccatcacaccacccacgaggagccggatttattatttcctatcccacgccactattcccatcaggaaaccatgccatcttaaccactattcccatcaggaaaccgtgccatcttagccactattcccatcaggacaccgtgccgtcttaaagtgattccctgtaagatgagcaatggaactttacttgcccagtagaccctttgtctcttaggactgggcaactgagttttaaaatggttttgatgcatttatatagcacgttagccaaagtgaatttcctctttcctccttgtcttt

SEQ ID NO: 119644 - DNA, 1042 bp, Homo sapiens
taagtacggccctagggctcgggtcttccctaggcaagaacctcgagggccggacacgggagtgcaacccaggcacgcgccttcggatggccagagtaaatggtcgcgagattttgcggggtagcaaggggccgggtgcccacggcgggagaaactacactactctggaggcgagcctagcccttcatcccgtcgggtttcacaaacgaagccagagcttcctggagtgagggtggagcttcctgcccgcgccctctgcgcatgcgcccgcccggcgcccgcccggcgacctggagttgatgtcacgtccggcggcggcggcagcggcagcggcagcggcgctgagttttgtctcccgggccgtctgggcgcgcgcgggtgtcccaggtaccccgccgcctccctccttcccgcaggactcgtccctcctggccctgggccccaacggtgcccgcctgcccggcggtcggtcagcgcacagggcacggcttcctctgcttctcccggaccacttagtctcaacccgggtgtgtttgcactactagaggtgaagcatccatcatagagagaatgggacctggggtcttggaccagggtgtttttacttttcccatcaggtggacgcgcatgggcaggagatattatttgcagcatttcctcctagaggacgcctttgtcattgtagtgcaatctaagaatgggtgtccttagacaacagggaccgaccaaatcgtcatgcagctgtttggatgctttaaaaaaataaatccccacactcattacgcgttttatgctgctgacttttttatttttaagacatctgctcccgaaagctcagagccctttagcatttcattttctaaacgaatcctaatctttcctgtgactgaatcggttcagaggatatcttttcaataaggaaggaagccctcccctgctcactggggacgtcgcagggtttttaaacctaaagatttactcttttgtgcacagacgctggaagcatttgggtgaggcagtgcagtgctttttgggaaatgca

SEQ ID NO: 119645 - DNA, 1044 bp, Homo sapiens
tcataaaaagcatgcacctagatccctcacatgcacagttcacaatagggtttgcactcctgtgagagtataatgccagtacccgtccatggcctggaggttgcggacccctgtgataagggacaggtggagggcaaacaaagcctcacctagagccgtggccccagtgagcatgcgttagactcagctggggggcttgctggatccagcctcagattcgacacgtctggggtgggactgaggatttgcatttataacaagtttcctatgtgatgctgatgctgctgagtgggggccatactttgagaactgctgacctagaggtaattttccacaccacacctgtccggtccccatccttaaagactgctgtatcacccaggtgaacttggggtgcacaggtggggaagatggtagctctgattgagaatccaagcaaaaccgattacgtaacacacaactctgatgatggagggtgtgacatctttcaggagtctcagagcagacaaaagttgccagctagcaacccagagcatgaaaaccagaatgagaagctgatatttgtttcctgtgctgaaagtaaagtttcttgaaacgcacactagaactggttaatttttggaaaacagccatgccacaagaaggctgtaaagggcctatttggcaccatggcaagccagcaaccaggagcaagacctttatcttaggaaacccagttgccaggaactcaggggcctgttttgacctacacagggcttgttcccaactcccatacctcagtatagagcaattgccaggatttcagccgtaggatggagtctgagaatgtctgatctcagagggaaggcagcaggaaaatgaaaacgcgttgagagtggcggcccctagttctccaaatagaacagccaggtctcaccactccctggattccaattcttaaaaatgaaccaggcctgccaggcaaggccaccatagctgaaaggaatgacgtttgagcaggtaaaaacctaaccgaagggacggttcctgagtgcgtggacacag

SEQ ID NO: 119646 - DNA, 1056 bp, Homo sapiens
ataccacagtaacttgtccaggtcacaaaatcctctttgtgaagtgtctgcctgtagccagggcaatacttccatggactgctgtgacacagagttcccgaggtgctgggagagcctgcctgtgggttgaagatttgacaatgatgtccttggaccagcttttgttccctcagatctgaactgctcccaagtctgtggatcaatggaacgacactaaatggcacagatacaccacgtcacgcagaatttcaggggatttaacttatctgaacatatcacgtgtgaaaaggctttttccgagccctgtagatgggtcagggatatggaaatgcaagtggaagaaagtacaaggaggctttagcagggacggggagggtaggtttccatgcagacttctgccacagcaggctctttgggctgtttgggcctgggcttgaattgcgcttcacaagccctggcctgatttctgcagagcttttcaacacggaggatgaaaggcattccacagctgaaagggattctgtcctcccagagtactggggctgtcggtggcaccaacagcataacagccgtctgccgacccctgacaggcttaggaaggagccctttcataccgctacagctccgtgttagcggccgcccgtggagagggaactgtttccatgaagaaatacaactcgtctttttgcttttaatttctctagaatgagtggactcagaatggtggcaaaagaggcaaagtgagagtaggcgtctccaaaatgtcaggctggtgactggaccaggggcaggaggagcaaagcagctcaattacctgaagagcttcaaaaagtttttttttgtttttgtttttgtttttttaattgtggtaaaatacatgtaacataaaatttaccattttaccattttatttatttatatatttttggagatagggtctctctctgttgcccaggctggagtgcagtggtgtgatcttggctctctgcaacctccatctcttcggttcaagcgattctcatgcctcagccacctgaatagctaggattataggtg

SEQ ID NO: 119647 - DNA, 1149 bp, Homo sapiens
gtggctagtggcagagaagttggaattagacctgcattggacctcaattcgctgagcagttgcagggaaatctggaaatccttttttttttttttttgagacagagtcttactctgtcacccaggctggagtgcaatggcgtgatctcagctcactgcaacaccgcctcccgggttcaagcgattctcctgcctcagcctcctgagtagctgggattacagacgcacgccaccatgcccggctaatttttgtatttttagtagagacaaggtttccccatattggtcaggctggtcttgaactcctgaccttgtgatccgcccgccttgacctcccaaagtgctgggatgacaggcgtgatccaccgtgcccagccgggaaatccattttttaaaataaattcaattatgtcttgaatgtactcagaaaacgagctgtttaaaatgtcccattgtgactgtaatgtgaacaatgacctctaacttgtattttatttggcaaggatgggggatgtgcatcaaatcttcacctctgggatttcctgaggcttggtctacttggctcaccctccacctgcatccccaccccactcctagatattaatacaaatctagccttgacaccgcctactgctccaccaccgcctacgtttttggccatcagagccttggagtttacagagcagaggccatgacattggggagcttgtttaaaaatcaatgatcagaaccccacattttagtttccttttggggagaaagaggagggccgtggaagaaaaggggtgtgcagctggagcgttattatgtctttctcagcggcaggcatgcccgcctctccaccttctccccgccaggcacaggagccagcagctggagcgtgctctgagtttcaggggaccccccacccagactgactggggcttctgggacttctcataggaagagtcaagacctcctgcgcttctttaaaaggtgatgggctcagtgttcccagtggcatctggaggtgaagccggtactgtctcaggagtggaaggcaatggcccactggcctttttctcccccacgtcacagtccccatttgctggagcccttgagggggccaccgaaactgtggctctcattcagcctcccaaagtgttgcact

SEQ ID NO: 119648 - DNA, 1044 bp, Homo sapiens
taccttaacaccgcagtaatccctctgatactcaattccacctttactggaaatagtgttataaggtgactccttgcagttttttaattgttgacaagttcaaagggatattttattctctgctgcccctgctttggtgcagcctgtgctcttttcttgtggctcctgggagtcctgctttttgcttgctatttctgacctctctttctctaccaggtgaagggcaatgaaccaagtacaaagacacaccctcagtgcttcctatgaggaagcccaatcaatcaaaaggtggccactttgctactaagtacttttgccgttagataccttatatccaataaaaagtggcttcctggaatttgaactttctcaccagcccatcccacccccaaccccagcctaacacgcttctgtggactgtgaaaatgggccttctcctgccagcagtgggtatcccgggcactgagcttgccatctgatactagtgccttgaccttgcagaaccacttggcttgcagaaggccaaggtgtgtgggatggatgaggtagggagggaagcaacccctccttgcttgtcacagtaaagggcagcagaggcagctaaaccaaaccactctcgtgcaaatacccagcagggatcatcccaggaatggcaggctctcctgaatgcttccaggctaggagctcagcccaccaacagtctggtttggggtcggtcaccgggattggagtttaccttcctagatgccatttattcacactgtccctccacctccctgatccccacattccccatggtcaccctctcccctcggcccttccctctctgtggacatcccctgcagaaggctcaagtccccgaggttctcaatctgtgctaacagtagagggacatcctgctgcggcgcatggcctcgctgatcaggtaggcggggctcagctccggctcctcggtcatgatggcaatgttctgccactcgcccgtctggctggacctcttgatggtgtccaccacgcacaaggcatacaggcagtcgtcgaagg

SEQ ID NO: 119649 - DNA, 1076 bp, Homo sapiens
accacatctgaccttctttttctattaatgtgaaatattttaagatctgacccagggacgcgcgctcggacatggtcctgccccgctgaccgctgtcttcctcccacccgcaggcatcggcaagaacgtcatctgcgaccgcacggccacgccgctggacgctttccgcatgacctcggccgcccactactaccccaagctcatgagcatcatgggcaacgtgctgcgcttcctgccggctttcgtgcgcatgaagcagctgatcgaggagggctacgtgggcgagccgctggtgtgtgaggtgcaggtgcacggcggcagcctgctgggcaagaagtacaactggagctgcgacgacttgatgggcggcggcggcctgcactccgtgggcacctacatcatcgacctgctcaccttcctcaccggccaaaaggccgtcaaggtccacgggctgctcaagaccttcgtgaagcagactgaccacatcaagggcatccgacagatcaccagcgatgacttctgcaccttccagatggtgctggagggcggggtgtgctgcaccgtcaccctcaacttcaacgtgcccggcgagttcaagcaggatgtcactgtggtgggctcagccgggcgcctgctggccgtgggcaccgacctgtacgggcagcgcaacagcgccccggagcaggagctgctggtgcaggacgccacgccggtgagcaactccctgcttccggagaaggccttcagcgacatcccctcgccctacctgcgcggcaccatcaagatgatgcaggcggtgcgccaggccttccaggaccaggacgaccggcgcacgtgggatgggcggcccctcaccatggccgccaccttcgacgactgcctgtatgccttgtgcgtggtggacaccatcaagaggtccagccagacgggcgagtggcagaacattgccatcatgaccgaggagccggagctgagccccgcctacctgatcagcgaggccatgcgccgcagcaggatgtccctctactgttagcacagattgagaacctcggggacttgagccttctgcaggggat

SEQ ID NO: 119650 - DNA, 1056 bp, Homo sapiens
agaagtgcctgagaaagtatgttttgtgttttgccaagccccaaacatttcccaagtggtgggagaggtctggcaaagtcccctggtgctctcaatggtggtagaggaacgggaggggctttctgtgcacatgcgggtatgatgggtgagggtcactctgctgcatccatccaggactgtgaaccatcacgccacggctccatgctcagctcgcccccctgagggctctgtccctgcatccagaaatggctgtcttggagggttgccgcatctgtcaatgtgatgcagtgtgaccacgggtgagtggcagaaagcacacgaggactggcctgagtcttctggggaggccttcacaactcactccacaaagaccaggcagccctttgtgtgagaacaaagagctaaagctgggtcttttgaaggctttggggcttgaaccaacttaaaattttaagacaatatcctctcagcagcaaataaagcgaagctatctgtctttaaaatggtggagctgagagataccttccaacctatgttgccgtgctgtaattaggagcaaaatgagatccgtgggaaacttctgacgggttagagtgctatgtgcaaggcagtgtgcctgatcttcatcagaagcttttaagttaaataatttcagaagaagctttactgccctcctgagatccctcatggggaaatggaaaatcagctccctccgaagcctgctgaatgtgttctctgtaaccgagccaaaatattcatggccctcctgagaaatctgtgctatagggaagagtttccagcccagagaccctaaagcccttcaggcagctgctccccttatatcctccaagctcagggtctccaagttgtggctgagtctctgctcctatctcaggacagatcagagctttggtggggctgacacttgatccaaatggtacccctgggagtctgggcaaggggcttcccattcacacctctagggaaagatggagctctgttgtcccacagagcaggtacccgttgctgcccttcatcagggaagttatccctggg

SEQ ID NO: 119651 - DNA, 1604 bp, Homo sapiens
gaggcaggccctggagccacgggttggattcagtcagggtttggagccctctgtcttcacagctggcttctctgttctcctctgtgtttcaaggtgtccctttgcctggagtcttccttctgtttttcaccattcctgctgacagtctcatttgtcctataacgcaatgacagcatactcaaaggtctgcatacatgctggctgtttgcaggagctgggctcctcctggtgaaagctcaggtttaccatacaattatgtgaggcttccttgttactttgaaagctttccttctgcatccgtgaaattaaactctgtattgctgtgtgagtaattatggggcccttctgtgctgaggcagagggtgaggggtaaggtgttgattctcagcgttagtgtagggagtcaggtctctctcctctaccctccttcttcctctttctcctcactttttctccttccatccaaattggtcagacctatattggtctgtcctgggatcccatgacactgactctgagcttgcaaattgttctctacttttttctgccagcatattgggtaattaatgccccttctttccacctttcttcctctcttcctttcctcctttctttctttcttcctttcttccttcctctctctctctctctctctctctctctctctctctcctttctttctttgacagagttttgctcttgttgcccaggctggagtgcaatgatgctatctaagctcactgcaacctctgcctcctgggttcaagcaattcttttgcctcaacctcccgagtagctgcgattacaggcatgcaccaccacccccagctaattttgtatttttagtagagatggggtttcgttatgttggttagtctggtctcaaacacctgacctcagctgatccacccatcttggcctcccaaaccttctttccaactttcattgttgttgtcaggatttaccaagcattaggtagagcctccttcctataaagatgagataacccatccaaacacaggagcaagccagctgcattgccagagccagggctcccagaacacaaattccagagtagcttgctatatttatctgaagttaaggcatcttcccagagtgccaaacaaaacatttgtgcatcatctggggctttatttccctatgttacctgcttttctgatgatgtttacctcagttggccttagaggtttaccctgccaatctaaaaaaaaaaaaaaaaaaaactaaaaatccgtatcattttagaaattcagtagcagatcctatttcaattcagtttctttctttcttttttttttttttttttgaaatggagccccgctctgtcgcccaggctagagtgcagtggcacgatcttggctcactgcaacctctgcctcccgggtttacaccattctcctgcctcagcctcctggagtagctgggactacaggtgtgtgccaccatgcctggctaatttttttgtatttttagtagagacggggtttcactgtgttagctaggatggtctcaatctcccaacctcgtgatctgcccatctcgggcttccaaagtgttgggattacaggcgtgagccaccgtgc

SEQ ID NO: 119652 - DNA, 1011 bp, Homo sapiens
agatggggctatggaggcacagagagatcacatgagggacctaggtggccatgccaggaattgaacccaagcagagtagctcttggactagatctcatcaactctgtgctgtgctacatgcctggccagagatagctgtattcaccctgggctaccaacctaagacaaacagctcagcttctcagcctcttaagcctctgctggctagttttgttctgttggttggatttgcagggcgctggccgactctgcccagtgcttccggcactcacagacctgcgtcacaagcctggctctcctgccagtgtgactgcactgccatctcaagtcatctccaaatatgtgcatcttttctcgccatccacattgcaagatgctaaggaacagggcccatgctttgtttgtgtccagtttccccagggtacctagcttgttagtgggtacttataagtggtttaatgccagttagcctggctggggaacacgatagtctctgctgaagaggcagcctactaatagtagataaaaacctgcttttgattggtgtgagcaagcccttatctgtttttagaataaacgtgatttgctttggcaactgtaaagcagatggaaagcatcatctgtagaatctagaaactgatttctgggagagtcttaggggcttggccctattatgcattctatattggcctctttatatcaggcatctctgtgctgcataattcctaaggtgactcttggtcccattaacctgtgcaagggacggaaccaaactaagctttgagattgaacctcgtttgcttggtagagccttggggtcttatctgccaagctgtttgtttggctttgctgtgggctgctttgcacacatgcttgtttggacaaggcagcacaggctgtcccatggtccagggggtggtagctggggcagccttggagggcagggtcaattcttgcttcagagtggtgctttttttcccatcttggccagggaatgctcatacattcttt

SEQ ID NO: 119653 - DNA, 1041 bp, Homo sapiens
gttccctgcagctttcaggaaagcttttgtttaaacaaaggaaccagcctactggtatctgggtgaacacaggcttcctacttagatggaaatgatctgaatggagggggacacgggtttcttttttcattccttttttccctgtcatccacctgaacgctagtgacttacttgcaaaggattggagtagagacacgtaaaagacgtcttgacttttggggaagtgactttctgcttctgtcttgtcaaggcattattttaaataaattgaataagcaggaaagtggaggatgaaggatttgttggatgatattgaagctgggagaaaatggacactctctgtgtagcatcttggggacactaagtgtcacttggtggaccctagtttcctccacggggtggatggggtctcaagccccctccagctacgccattttctgcatttgcagagtcagattttctctcctgagaatccgttcggacagcatgtgttttagggttcttttactccacttggggtttttgcaacacaacaaaacatacaaatgagcttcttgttcattttgttgtcaccagaacctaagtattgaatggcagccttaattggaaaagggcacgattagaagaaagggagagagtgtgtgtttgtgcatgtgttcttgtcctgtgtgtgtgtttgtgagtgtgtgtgtgaatgaaggtgaaaaaggggaggggacccaaccaacccctagtttttctgaaagcctgttgatttattttcttcctcccctgtggatatatttctcccccaaaggaattatgtagctcatgatttcagattttggctcagtggtgctttctggagataaaacgcagccgttgctttattcatcacagattgttgtgcctgtttgatttgcagcctccgggaaaggcctcgtgtgcccggcaaatcctctgctccctcactagagatcctccgtaggcaggatgagcttccggcctgatcttctcaacagtcccttctgtgatgttcatcctagtcaggccttagaacat

SEQ ID NO: 119654 - DNA, 1005 bp, Homo sapiens
agcccataggtgtgtgctggcagcgtggatgtgggaggatgaagaagggcagatgtccagggtggaccctcatgcaccttcagagctggagggaggtctcagaatccagaaataaacttgggcccagtgtgggcaccgcactaccctagcttctgtgggaagggctggggaaggagatcttactgttaaatgcttattgtaccaaattatatcaaccttagtagatgtggactgtgagatgacttcttcacgatgatctgatggacttttaggttagcagatgaagtaatctgtgtaataggccaaaccctattctttttattcccatccatctgaatacacagctgattgcagcagttccttctgtctgtggggaggaacagtaggagaagagcagtggagaatgtatccagagcaggacagacacacaccagggaaattttggcaaagctggggctttaaaaataacaaaataagcactattttaaagtatttaaagagctctgcatttcttgaagtgaactagggatgttagggtaattacccaactactgtttacattgaaagctgttctctgatttaataggaaacatatctggttttgatttctgaaaacatctggtagcaaaattgctgccaggagacccagccagtcctgaaatgggaggaagtccgaactcttggttttctagcgatgaggagtgctgcccaaagctagggctctgagagcagtcatcgtagatggactgattacagtccaggaggtgtacatggttcacaaataaagaattcatgttggccacacacggtggctcatgcctgtaatcccagcactttgggaggctgaggctggtggatcacctgaggtcaggagttcgagaccagcctggccaacatggtgaaaccctgtctctactaaaaatatacaaaaattagctgagcgtggtggtgggtgcctataatcccagctgcttgggaggctgaggcagaagaattgcttgaacc

SEQ ID NO: 119655 - DNA, 1031 bp, Homo sapiens
tcacctaagctggactacactggcacagtcatagctcactgcagccccaacctcctgggctcaagcaatcctcctacctcagcctcccaagtagctgggactgtaggcatgtgccaccatgcctggctaatttaaaaatgttttttttgtagagacggtgtctcactaggttgcccaggctggtctcaaacccctggtttcaagtgatcctcccaactcagcctcccaaagtgctgggattacaggcaccaaatcagtttttgtttttttgagtagccctttcttcttcttgcagttgccctggattgcccaggtggctctccaagggcagaaggagtcattccacctctctgtattccagcgttaaaattagcccctgttttagagacttttggttctgtctccagagctagggctagaagtcagcagctttaagaacagagcatctcaggaggtacagccagatctctgtccaccaggtttctagaagcatgaccctcagaggctgttttggaaaagtttataaattccttggtggtttagtggtgcgagacactgactttagctgtatgcccaggagctgctgcaaacaacatgcaggcagtaggcagatattgtgcctcccttgacacttatgaggaagactgagtgttgcaatggcatttggaaacttccattttctattcaaatttgttcaccagatccttatcaggtggaagactaataagagcacaaatagtgaaggggacctgaggcttaccctttccttgaggctaaagcaagaaaaggaaaccattggccagccacttttgtcaagcacttcctttgtgcagagaacatgctgtgctctgtgccttataggggtggaggataaacaattgggaggaggggctcccttccagaacatcccatgggctgcatgagagggcaacactgaagccctcaccatcacttgcaagaaatgactgatgggcacttacaaaacaacaggtaaatgaacgagtacattagcgttccatgtataagatgat

SEQ ID NO: 119656 - DNA, 1003 bp, Homo sapiens
tgatgtcactaaaaactccggcaggagttgcccgaagtgtacaaagaatgagcaccattgcatcacatggggccagcccagaggtgagggctactctaaggtcaaggtgtggtaggaaaccttaacaaggacaaccaatcacaaagcagctgaggcctgggatttacatacctcaccggagtcttgatttattcatcgtgcaggccctaggctgctgtccttataagggcctgcctgcaaagttgacccttggctggtgtctggcaacttaactgataaacagtttccttcgccaatatacaatttttcctaaatcataagatgggcttgctgtgccgaagctgcttgtgcaaacagtatgatttatactgaacactgctttctatttgggagtctggaattttgggacatggtaggcagaggctgcctacatcagcagccccacgataaggtccctgggtgatgagtttctaccgaacttccctggttgacaacacttcacatctgtagccactgctatttgctgggggagttaagcacgtccagtgtgatccactggaagaggactcttgggagcttgggcctggtgtgctccggtcttcatcccatgcaccttctctttgctggttgtgcttcatcctctttcactgtcataactcttagccataggaacagctgtatgctgagtcctgctaccagatcacctcttaccaaacctgggggtgatcttggagaccccaaacacactcatggattttcaaagtgactaagcgcaagtgaagataagtccagtgtaattccctggtgttaattcatgctacagaggattgggcccctctgcctgtgctaaaaggagctttagcttagttaacatctgcaactgtggcgtcatgattacttacgtccccctcagccccacctagaatccaaatgttgtgctgtccattgagaggccagatcatttgtggtctaggggtaaaaaatcacagaaatcttggcctgg

SEQ ID NO: 119657 - DNA, 1007 bp, Homo sapiens
gaaacctgacccaccccgcacctctctgggtgtattgctcactgccaggctttggggctgtttcaggaggctatgttcttacagggacaagagccagtgtgtgtgcgtgtgtgggtgtgtgtgtttgtgtgtagagccctggtgtgtcaggcacacgtgcagagagatttagatcagcagacctcagatgacgaaaccctaaactctagcggaagcaactgcatcagatggtggaaaatctcatccaaatgcctttacagtgtctttcaggtttttgatatcaagacaaccagaaatttgctgtgagtgacagccaggaggtgatgctaatatcctggggtctgaagattcctcccctccctctacgaaactcttgctctggtgtccatttgtggggccacctctctccccctcttgcagcccacagaaggactgggaagcattgacagtggtccccagctgccacctgctgtctgtgactcatgcactgtctgtgggagggtggagaatatcatcagtgggttgcggggcagagagtgggaagtgtctgctttgtggctgatgtgtgagtgtgggaacatgtgtgctcctggacgggagtggtggcattgctcattctgaggagctggcgggtagcatggaaatgtgtcttcacttggttttttgggtttctagtttccttttttctttttttaagacatagctactgaaaggccaggaagtaggacttgggggcatgccagtgagttggaagccgcattaatgtcctgtatctttagctcttcagtccaacaaaggtgcaattattatgttatgcacatgccttctgcaggattatgtattggcattgctgattctagctaatgtcttttagcagtttgatgggcttatattagtttccgggagttgccgtaacaaagtaccatcagctgggtggcttaaacaacagaaattaatttttttcagttctggaggctggaagctggaggtatcaaggtgtgggcagg

SEQ ID NO: 119658 - DNA, 1092 bp, Homo sapiens
gggaaggttaagctccttttgcagtctgttttcactttccgtgttgggcagatgtggacctgctctgctagctgtgggctgtgggcagcattgcccatttgcttcctgtttatgagagaaaagccccatctttgattttcccaggtgggccactgaaatcacctgaatgctctgaaactgtccctgacttctttgctcaggtgcccccgagttgtgaagtggcttagctcaaagcctcctgcagggcaccacagtctgtaggaggtctcttgttcttatatgaaaagctcacgtgaactttctgttctactcagtaatgtccctgtgattgtctgaataggaaggttttcattcccaggaggctcagacctcctggctcccaagacagatctgtgcggggccaagacgagcagcgtgcaggccgcccactctatatggtgcagccctaggaggctgtatgtcaggacctatcatctgttcaggtttaatcacctgcagtaagagagcagtctaatctgtctatatatttatttagattcttgctttagtctagaaaggattagaggtgaccgtgatgagtagttcaaaaattaacctgaatttaatgggcaaaagaaagtggaataagcttgcacctgtagtcatgacaatattcatgagaaatttttaaaagctaaaggaggccaagtgtggtggctcacacctgtaatcccagcactttgggaagtcgaggcgggtggatcacttgaactcaggagtttgagaccagcctgggcaacatggcaaaaccccgtctctgcaaaaaatacaaaagtcagccgggcgtggtggtggatgcctgtagtcccagctactcaggaggctgagatgggaagatcacttgagcccaggaggtggacactgcagtaagccaagatcatgccattgcactccagcctggcatgagagagggtgacagagccagaccctgtctcaaaaaataaaagataaaaactttaaaaagctaaaggagtctcttagaagcctcatttcccttcaaccctctgagatcttgcttcaaggtagggctgttgcactttaaaacccacctct

SEQ ID NO: 119659 - DNA, 1036 bp, Homo sapiens
gagtgcatggaaaatcaggtctgcaggaaaacccatgtgtggcactgtggagcagacactttgcctcactctctcgtgatctgagtcatttgggaaaggggaaaatgagtgggggtaaatcacccaaacatctgcaggccagcagagtaactttttctgaccctgacttacagggagaacaaattttatattatgatccggtatatacgtatatatggtttgttttttgttgtatgttgtttgtaaagccagtgattaagtttgaggtttggcaggtaggatttgtttaaattccagcagatggaactagaaaagacccatgatttcactgacctcaagaccctgctggatagatatatatttatctttgtatttatgtactggatcataattagtgtatatagtgtacctatatagcatatatatactgtatcagtgttaaaaaatttacagataacctacgtatgtatgtatgaatataaataaaaataaacataaggtttatgacatgatgcttacccttgtttcattggcacgtgaaatgctatcgtattttctttctttcatttcattaacaagaagaggaaaagctggctgtgacccactgaactgatttcaccatgcttaatggacggataactgtgggttaaagaaaagacccacaccccggtgacgtggaaagagcttgtgatctggagcagtcctgtccatagacgtttccaagaccatgaaaatattctgttttgcgctgtccaacatggtagccactggccccgtatggctactgagcatatgaactgaggccagtgtgaatgaggagctggattttaaattgtctttcattttaattaatttgtggctcctgtgatggacagcacagatctgggttgctgccctgtgcctgcccctaactcgctaattggcagtgagacccctttttccaagtgcagcatctgtaaactgggaggccagactcagtcatctccccaggggctgccagccccacccttctgcattccggtggtctggaaagcca

SEQ ID NO: 119660 - DNA, 2284 bp, Homo sapiens
acacccaggggaaaccaagtctcagaggaactgagtggcttatccaggttgtcacagctgatcactgacagctaagtcaggaccaaaccgaggtctctgcagagttgtgcctattaccttatgaggttgtttaatcactggggaactgtgcttttccaacaatgaagaaaacgaggcggttgacttcttggaagtttctgaaggaaataacctaaaataacaacaatgaaaacacctacatgcacaatagtgttcagtgaagccttatttgtgattactgaaacactggaaacaacataaatgttccacagtaggagaacagttaggtaaatatgataaatataattgataaaatactaaatagccattagaattatgtgtaggaagactagcaatataggaaattttcttatgataatttcctatattttaggtaaagaaaaaggacacagaagcatttgtatattatgatgatagccttgtttaaaatcacacacacgcacacacacctagaaaattaaagtctagtaaggagcccaaatcctaatgatgcttgttatcaaataatgggattataaatttttttcttctctaaatttcttgttttaaaaaaatatcataatgaaaaaatatatttttcaaaagaaagagacaataagatgggaaaaaatggtttggttggggtgactctccagttcttatattctgtgatcctttggctctggactggctgttcccagctgcaggtacttgtttttcacagggcaaaaatgagtttagccttggccaaaggaaaaaggcagtcttctaggaagtggaagtggttgaataaaggtctagggactctcccgttgtttaggagagtaattgggcatgactctgaatttggggagaaaccatagactcttggctgcagggtaatttatttgtatttctaaccttgtgtgcccaaaacccaaacaggtcagaaacagctggaacagtcctatcatttttctctgcctcctgcatttgccccagggtgggaagtgaagctcttgttggcttcattcagccttccaaagaaaatgcgccattcagccttccaaagaaaatgtacaattgcaacatttccattttttatttccccttttctttgcaggcaggtttcttttcagtcaaacctgtgttggtataaatggttagcagttttagaaccctgggcctgagaaaattcatcaccatctgcttgaatctctttatgggctgtgtgtgtggtggtgtgcagccaaaagggtgttggccagagagctggacaggcggttcttgtcctgacaccatactaattagcggtgtgaccttgggcaagtgacttcaccctgctagactttcatttcgttacctatataacacaggcaccagagtcaatttttaagagttccttttagctcccaccttttatgtttattctaataactcactttaaaagcttggtattgacttagccaaattatttaatttggtaaatatttttatgtgctgttttattatgactgctgtcatatggttggttcacttggcttctgctattgcttcttttttttttttgaaatcagttacacaaatatacacagctgtcctttataccagaaagcattctttcttttatctgtaagggaggagatgtattccagggcaaagtagcatggctcattgttggttagtgggacggctgcttgccagtagtgtgtgtgtatgtatacgtgtgtgtatgtgtgcatatgtgtatgtgtgtgcccatgggtgtgtgtgcacatctgcccaatgtgtcatgccttgtttttttcccctctttaatggcactgctgagaacacatctgcatgaataactgctaataccaactgtcaagctagcaaagcagtggggttgggtataattttctagcataaatttatcagcacagtgggcgtttggggttagctccttctgcagatgcctcgtgaagcaggttgtggtccactgcaccaaggaaagatgtagttttgccaaagaagaagtactgtgccatcagcagcagatcaaggggatattatccatcccaagcaactgcaggtcagaaattgtatcatggacagttcacaggaggccacagggagggaggtgattgagaatgtcaccctgtcacacttgagtcactggcgggtacagccactttttatgtgggtgcctgccactgacaggctccctcggcatgtagttacccttcttcaaaggtagaggatgtgacattagtaatctgtgtgg

SEQ ID NO: 119661 - DNA, 1009 bp, Homo sapiens
ataagtctcacgagatctgatgggtttatcaggggtttccacttttctgtctccctcattttctcttgctgccaccatgtaagaagtgcttttcacctccccccatgattccgaggcctccccagccacatggaactgtaagtccaattaaacctctttttcttcccagtcttgggtatgtctttatcagcagcttgaaaacagactaatacagtttcctcagttgtcctagccacatttcaagcactcaaaggccacatggggctggctggtagctaccatattggaccatgcaacatagaatatatccatcattgcagaaagttctactggacagcattaatggatatagcaatgggtaaatcagtcacttatgtgagatccaaacatggatttttgagcaaccccaacctgtgggtgtgtttcattttctcctgggaatgtgttgatagtctccaccttgggctatgggtgtctcaatactaattagtagaggtttaacaaggtctgggtgctgctttctggatttattagtaaggactctattattaatgagaagaagatgtgctgtgggaagtttcctaaattctttattagacatagggactgagcaatgagataaatgacagtgcccctccctgctccacccgccttccctcaggtttattacaggactttaggtagcagatggcacggacctgggtggggtgatgccagggcaggaattctgcctttgctcatgggtagcatcttccttaaccctctcagccatcctctcggggaggtaagaaagacattttccctcctcaaagcaccaagaagcaaagggtcttagtagatggcccaggaaggtggtgaggggaaggaagtatatgccaggcctctttgtcctgcaagaactttcgagaacacctggcagctagctcctgaggacctgggccagggggaggaattttgacttcagagtaaggtgctttctgccctactgccaacatgctgtgcagttcca

SEQ ID NO: 119662 - DNA, 1043 bp, Homo sapiens
caaagtgctgggattacaggtgtgagccactacgcctggcctgtgtgggaattttaaaaaccttttacacagttggtagcatgccattcattcttatggaccttacttttgtcatgcaacaatattagcttgaaaatttatatatgttaaaatttaaatattattttaaaaatatattaaatgtattaaatttattacataaattttatatagtaatataatcaatgttaagcaatataaatattaatataaattatatttaatcagttaatatgcattattaaatttatgtatatttatatctttacatatacagcatatacatatacacatttgtatatatacatatattaacatatttatagatatacatgtatgcacatttttatatatattacaatatataacatataatatatacatatattttacatatacacaaatatatgaaactctgaatgtgaaagtattattgctcctatttttggctacctagtatttcattgtatggatacatcaaaatttatttaagcagttccctgttactcaacatttaggttgtttccaattttggcttatacaaccatgtaatgaataatcttgagcatatgtcattttgcacacatgccagcttgtttgtgggatagatatgtaaattgctggtcagagagtacatgctgattacatttaacaaagatattgcctaattaactggcacctaaaatgacactgtattttttgttaatttccttgttgcctctcccagcaagcgtcttgacggtcaggacgcagacaaggcaaagaagcctcactcacctttgtgtccccaagccagcctgcctgggtccagtcttgtttcttatgcagtctactctgtacaatggggaaagtgagcacatgtgcacacgtgtgtgtgtgtgtgtgtgtgtgtgtgtgtgtgtgtgtgtaaggtatcactctccactttcagtggctcccacagcacctagaataacatccaagctccttggcatgactttcttggcctgaaatggccctgcctt

SEQ ID NO: 119663 - DNA, 1034 bp, Homo sapiens
gaacgtaggaagtgaaaaaccccaaacagttatcaggctgatctggctgttgggagtgtatagatacgagtgtttgcctggaattgaaactagctactttgactcatcctggtaaattgtccttttagcaaaggcctggactttgaattgcttgcccagtgagggtgacaggtctgtagccttcgatccacactcataactggtcacaggcctgtcaaagtaaggggctagggaccctactttgtagggaccctacaaagtgtggtctagggaccacagtgaaatgaaacttcagatcaattgaatcacacacatcctcctttaatttttaaaaatttcctcaaaatccctacctttgtgaatgaggcattcctctgttgtagaggcatttctaccaagtgtactttctacactgtccaaggctgcctcttattaagtacatactgtatgccaggcagcatggtaagtgctgtgtataaagcatttcatttcatgactaaaataatcctctaagatagatattagctccatttcacaaatgaagcaactgagattcagagacctgagtcactttgctcctagacctacagctagagatttgaacccagcactctacctcccccggagtcatttcttcctcttccatcagctgtacctgttcctctgccatagatcatggcagcccaggtcagactgttggagttgtcctttattccatcccagccctggaatcggttcccaaacctgtttgatgccatctgaaactctctgtgtctgttccccatagaagtcaggtcctttcgtagtttctgaactaggttccagtccaccccacccaaccctgcctctagccactatctacactgctgccaggtatggagtatctggcagtgctagagacctggtcatgtcatcgtttcccctttcaggaaaagccccagctgattggcgtgacatgcccagcctcacatcctgaagaagtgagcccagcctcacgtcctggtggccattcccgaacccaagggcttcagcga

SEQ ID NO: 119664 - DNA, 1253 bp, Homo sapiens
aggtgctgctgcatcaggacgtggacttggtgtgcattaacctgccgccgcccctcaccagacagatcgctgtcaaaaccctaggtgagcgacccctaccccgcatcctccgtcccacccccgccctttaaccttctctaggttccttcccccctgcctttccctctccgcatcccagaagcttaccctgcatctacgctgccccggggatctgagatcccagatccgactcagagctccctccttcctcgtccccggccttccccacctttgcgcttccctcctgcctcctggcaccacttggacgcgcttccccacgtgtgtagattgcaggctggagaaggcgtgtgttccggggatccgaactaggaagatcagatgccgataataggggatagggtgctccgcgagaagaggaaagttactcctcagctgtgtgtgtagtgtccaagtgtgtgtgtgtgggggggggggatgggggggtggaggagggttgtgcgcgcgcgcgcctgggagaggcgagtgcgcgcccagaaacgcctgaataaaaggccgcacacgtgtgtcgggttttcttgggtgcgatagaggacctgcccttcagcagcggtggcgccctgctagggtcgtttgtttctttctgctgtgagttagtttagcgtgagattgcagatgttaccatcggctggaattatttcgtctgcgctggaggcaaggacggtgggagtggttggatgggggtgatgatgtattagaatgttttcagaggcgtcataggttagtaaagactgatttggtaaaaccagggggttttaacttttgactgcagcctcccgggaaatgtcttctgccccaatttggagtaatagattttaaatttttaggaggatgggcgcagtagctccagaggcatggatgctttgcatgagaaaaggccctccctaatcgccttcaggaatagtttcggaaggcacagtgttgacccgtgggctggagatgagttcagggtgcctcaccatctggtccctgctcccctcaactcccaggcagtctgaacaatctctgaggacagagtagcagcctctcagcctatgctcaggggaaagagaagggcatgttttgttcatcatcagttcttgcacgtaacctaaaacaatcccaggaaggttgcttgatcttacaattccaagaaaatgagcagctcacctttgaaagctgaagtttctattggtgaggaaaaacacaaagcttat

SEQ ID NO: 119665 - DNA, 1054 bp, Homo sapiens
gacactaacactaggaaaatgaataaagttaacttggagcagcccaagaacaaacttataagtgcatgatggtattttatgtgcaaaactgctttataagtactataagactattacaggtattaccagtgccctcagtgtaaactccttggcccacccatgtaaagtgtacatcgagccctcagggtccctgactggttctccagccgccccataggctatgagcatccccgttccctacacaaaggaccactgggatttattaaaggttatgccttgcaatgcagtacaaagttttatatgatagtgtcttgttgcctgtttctacaaaagccaagggtgtaacattaaatgcaattttgcaaggggctgaggtgatgtggtccaagtatgtaatcacttcagggagccatatgtgaccttcatacactgttgataatggccatgcctcccagtcaggcctgtgacacctgctggacagcaggcattccaaggcccctaagcactgagttagctggtaaaggttaaggaaaaagctgtattcttactactttactccaaggtagtaaagtgtatggaagatgtacctgacagaaataacttaagcatcccctgagaatgaccctgtatggcagatgcatctgacagcaataacttaagaagtgagggttgccacgtggaggctgctgaggggagggtgctgagtgaaagtgctatgtaaactgcatgctttttataagtggttgcagttctgtccagcccgcggccactggaccaccctgtaaggttccccaaataaaccctatgtttccttcactagctccaggtctcttctttggcctcttgaacctggtgccatccctactgaagttaacagaggtctggcccaacctaagggcatcattttttaaagtcccatggaaaaaactcccagcagagttcagcatctgggaacggttggcaggccccacaggaaccacagcttctgcctttatgatgctgagaaacacttcactgttgacttcccccatctaagggggccagagctaaattt

SEQ ID NO: 119666 - DNA, 1059 bp, Homo sapiens
atggtggatgtaatttgggttggcaggatattggagtggggaaacagtcaccaagattgcctctgacagtggtggaaagatgctcgggccgggcgcggcagtactttagttggacgaggtgggcggagcccgggatgtcgaggctgcctggagccgagatcacaccactgcgctccagcctgggcgacagagcgagaccctgtctcaaaaaaaaaaagttcgtctcctttagtgtccaccaactgaaaataagaggttgctgtgagaattaaatgaggtgatttgtaaactgtaagggctgtacagacttagtgtatggttgctttgctgtctgatactcgacacagagagctggctccaggcagacattacttaactgctttcaatttataacagtgacctgagggttagaataccgtgggcaccctttctagttttcatcaagtctttcagagaatgtggagttttgtggacccggtcttcccatagcttagaggtatgggggcagtttccagcctaattcatttctttgcctagatgtagggcattcttaaaagcggtaacttcagaagcaactccggacatactatgtacatgactttctattaattttaaacgttttcattccaaaagaaaagaaaactccttccagacactattttggagaagttaaccacagcttcacagactaagtaagtaatggatctttttatattacttgcttatatacacccatctttgaattatatactggtacatttatttgaatccatataactgaaggaattgtagaacccaaattcaaaagctaccttggtatatgaatttgatgggaaagacggaggtaacgttctacttcttattttaccatttatttttgttcattcccatagctagcttttgaattcctgatcccattgtgttcattcagtacattttgttgactgcctgtcattgtactagggcatagtgggtggtggtgaataaaaagtgttttgaatcatttagtggggtagcaggcacttatccacaggctctgaaaacttgatttgtcccata

SEQ ID NO: 119667 - DNA, 1400 bp, Homo sapiens
ggtctgcctcatttcatttggagaaatcacaaaggattaatttaatagtttaggcacaggagacagggaacagcctcaagggggctgtggcccaatggagagagaaatgtaaatggacagaatacaatacagaagcatttgcacaggagaaaggccacacaaaagcggaagtgatgggaggtgggggggggcaaatgagaaggtaaaggtgacacttgagcttggttttaaaagatgaaagggaatttgccaccaaatagatttgctcttacgtttaatgtattcaggatctgagtaactctttggtaaagtttttttactgaaaacttgagagtcactggcctaagcaaaagggggctgaatttctgaatttaaagccttaaggggagaaaaagaggatagaaaaaaaaaaatttagaaggctaaatttagtagggtttgatcaattcccaaagacgactatagcttttcgctttaaaccataaaacaccaaagatgctaaatgaagtggggaacaggaaggacaggttggtggcaggtaaggcaagtatgggacaaatcaagttttcagagcctgtggataagtgcctgctaccccactaaatgattcaaaacactttttattcaccaccacccactatgccctagtacaatgacaggcagtcaacaaaatgtactgaatgaacacaatgggatcaggaattcaaaagctagctatgggaatgaacaaaaataaatggtaaaataagaagtagaacgttacctccgtctttcccatcaaattcatataccaaggtagcttttgaatttgggttctacaattccttcagttatatggattcaaataaatgtaccagtatataattcaaagatgggtgtatataagcaagtaatataaaaagatccattacttacttagtctgtgaagctgtggttaacttctccaaaatagtgtctggaaggagttttcttttcttttggaatgaaaacgtttaaaattaatagaaagtcatgtacatagtatgtccggagttgcttctgaagttaccgcttttaagaatgccctacatctaggcaaagaaatgaattaggctggaaactgcccccatacctctaagctatgggaagaccgggtccacaaaactccacattctctgaaagacttgatgaaaactagaaagggtgcccacggtattctaaccctcaggtcactgttataaattgaaagcagttaagtaatgtctgcctggagccagctctctgtgtcgagtatcagacagcaaagcaaccatacactaagtctgtacagcccttacagtttacaaatcacctcatttaattctcacagcaacctcttattttcagttggtggacactaaaggagacgaactttttttttt

SEQ ID NO: 119668 - DNA, 1049 bp, Homo sapiens
aacctcttggcattttgttttttttggattcctagaatataaagttttctgcagtaagtatattagaaaaacataattcaaaatttttttaattactctatatgaatgtaattactaaaactgggtgggcttattatactttagatgtatatacatactacattgacctgtttttcacaagtaacttaatatataagccattataagggggaaaagtataattatgaactatctccttcaaaagaacattattcaacatataaagctattagagacaggagaataaagctggatcttaccccaagcattattcaaaaactggacagcagctcttttcactggtaacctcttgttggcaagagacaggaacttatttactagaaaagaaaggtatttatcatttcacagttttatttgcagtaaaaagtgagaaaaatagtccataaaaaaattaccagtagtcctgttggttcctggcccatataatgaattatgtatgaaggcttgtgctgcttgttgccttgaatctctcagatcttggtcttttagccttacggccaagtagcttttattctggctgttgatcaatataaaaggttaaataagaattacacatgcttactttcttttttttttcttcctgagacagagtctcgctctgtcacccaggctgcgcgatctcagctcactgcaacttctgcctcccaggttcaagcaacttgcctgcctcagcctcctgaatagtgggattacaggtgcctgccaccatgcccagctaatttttttattttcagtagagacggggtttcaccatgttggccaggctggtctcgaactcctgaccttgtgatccaccagcctcggcctcccaaagtgctgggattacaggcatgagccaccgtgcccaggctacatgcttactttaaaatatttttatcatttgtctcatagtgataaatgaaactaattttatatatgcacagataggataaaactaaattacaaggactacaagaaacagacactcatattttagtagagcacatggt

SEQ ID NO: 119669 - DNA, 1206 bp, Homo sapiens
tggagatggctaggcagcctgtttggtcctatccacagaggtggaagaacccatcagtggaaacttgtaatgaaaacctggtgccttttttagttttagttagtatcaactgactttgatcaaccagaagggaaataattccttactctccactccaaatatcagataaaaaattgtacctttcccatcatagttaatatggaagtattttagtatctgatactttaaaagtctgattctgccagagtttatcttatagttgaatacacaatacccacactaccttgtcagaatagtatgtccaaggcggcatctgtcttttgcttagaaaccttcatttgctgatatttcagagtggtatgggagtggtagtttttaaagtcattgcagtattctcctgattgaaatgttttttaaaatgtcttgctaattgctgttctcatttttaaattatttttcctcagaaacccacaatctgccaaagcaacctccacttgccctagcaatgggacaggccacacaatgtctaggactgatggctcgatcaggaattggatcctgcgcatttgccacagtggaagactacctacattagctatgcatttcaagagctcacacttatattgtggcatatagtcaacatggaagtagaccagctctgctgatttgaaatttagattttttaaattatgtactggggacaggtttttgtcgctttacattgcttcctagtttacagcatgatgcaaatgattttctaacttagtgttaggagaaattattttccatctttaacctcttagttgtctaagagttaaatattactgaatttcagacgttcaaattgatcatcacaaatcctttaaaacaattacctaaaagaaaccaaaaatcctgccttctttgtgggggaggggggagagaggggaaggaaatggaacaagttgtgtttgtgttagcatgtgggtgatgtaaacttcaaattgggagatgttccgacccccactcccatataagcattcaatcagtgtaacttgcaaaatgcataaacatccgacagtttgaatttatagtgttgatggaagaaatcatttttaatgtgtactgtaaaacttgaaatactcaggagctgagtgaatatgtttgttgctacttacaatcccgacctgttagtcccagtagttttgttttaacatggtctttttc

SEQ ID NO: 119670 - DNA, 1072 bp, Homo sapiens
aatgcttatatgggagtgggggtcggaacatctcccaatttgaagtttacatcacccacatgctaacacaaacacaacttgttccatttccttcccctctctcccccctcccccacaaagaaggcaggatttttggtttcttttaggtaattgttttaaaggatttgtgatgatcaatttgaacgtctgaaattcagtaatatttaactcttagacaactaagaggttaaagatggaaaataatttctcctaacactaagttagaaaatcatttgcatcatgctgtaaactaggaagcaatgtaaagcgacaaaaacctgtccccagtacataatttaaaaaatctaaatttcaaatcagcagagctggtctacttccatgttgactatatgccacaatataagtgtgagctcttgaaatgcatagctaatgtaggtagtcttccactgtggcaaatgcgcaggatccaattcctgatcgagccatcagtcctagacattgtgtggcctgtcccattgctagggcaagtggaggttgctttggcagattgtgggtttctgaggaaaaataatttaaaaatgagaacagcaattagcaagacattttaaaaaacatttcaatcaggagaatactgcaatgactttaaaaactaccactcccataccactctgaaatatcagcaaatgaaggtttctaagcaaaagacagatgccgccttggacatactattctgacaaggtagtgtgggtattgtgtattcaactataagataaactctggcagaatcagacttttaaagtatcagatactaaaatacttccatattaactatgatgggaaaggtacaattttttatctgatatttggagtggagagtaaggaattatttcccttctggttgatcaaagtcagttgatactaactaaaactaaaaaaggcaccaggttttcattacaagtttccactgatgggttcttccacctctgtggataggaccaaacaggctgcctagccatctccaaggcatatataggtaatgttatttgggctggtggggagtaagtggtggtgg

SEQ ID NO: 119671 - DNA, 1286 bp, Homo sapiens
atggaagtaagggagtgaagagcttgaatatcagagaagctcaaactgatccagtagagggcaggattcctagctggtcctcccctgttacctggttcccaaccattttgcttgagctaaatttgcaatgggtagcagcagcctaagccactggtatcacagctcccaccatgcttatgaatatgggcacaaggggcttcctgatgacttgtgagtacccggcaggatcaagccttgatgtcacattctatttgcatttatattagccggattcaactacatgcccttacccaataaaaagggtgggtgaggaagagaaaagcaatttaaaaggcgaggcttagccaggggtgagcatcaagtgcgaaacgctaattcgatgttcgtttggttgccattcctatgagcagctcactgtagcgtttgtgattatagtatttatatactgaacaagtactttttatatgaattgtgtaactgcacatattgtgcatttctatataaatgtgatagggtcgattgtttacataaaacaagtttgagttttgggcagttctcatcaaaggtaatttatataaagagtgagttttcatttgacttcagagtctaattcccaggtaattgggactccagtctagtttagaagtctgtgctgtgctgtttggccctgcaaggttcagggacttttagtcacatatttcaaactagtttaggaagatgagggcagtgccacaaaaagtagattaaagagtagtttagatagggagacttgcaatgagggccaggactcttacagcaagaatgtaaaggaagcaatgaaaagcattcatatttaagactcagtctgtttctttgcccttagaaaatttattaatttgttaaggaccaatactgaagtttgggaataggagtagtgtcctcagtgttgtagttctccggaatttaggatttgtatataaatgtgaattttctttggttaatgtgttatattttcattggttctacaaaattcatttagctccgttggtaaaagtaacttagtaataatgctggaattgtaaggaaaattatggtttactataaatgtctttttgaagttatattgtaggtaatcattaagacctaattattagatgatactaatctttaaagtgaccagttttcttacaatttagtttcttgagttcttcaagggaatttaattgttgagcaccattatctatagacacatatactcttacatattgtgctatattatgtagattcagccataaatagtgcttaat

SEQ ID NO: 119672 - DNA, 1035 bp, Homo sapiens
ggatgagaaagggcaagagtacagttaatcagaagcctttcccccacctctgctttcataacactagtaagataactagagaaatgatggaaaatgggtgtggaatctggttttttgagcagctgaacctaggagatggtgctctttaggaatttcagtagtcagtattttcaaagtgttgtgttcctgaactcacaaattgacagtttctgcagcaactctccatgtctgccttccaaattggtaagagtgttctgaatttctctatttttatatttgtataatattgctctggattagggtattgacttttggcataataataagacgtcatttattgaaagattagaatgaactgatactgctaatttcatttagtcctcatacaaatctaggaaatagggcctcttatagtccccattatgcagtaatgaaactggcacttagattgtcaattgccaaaggctacacagccagttagtggtggagcttggacttgaagccagtatctgaaaccaccattagtatgtgcctcccatagaaagaagacaaaaaatataaagtagttgtttgaaaagaagacgactgtcagtcattttaagttttgaagaggtgtggcttgagatagttggaaatactgaatgcataaacaggtcctgaagggcagcctgtttaattttttcataactgaatttgagaagatgacatcccagtgagatgtgtccagttcctaaatctgttgaaaaaaggaaatgcagacaggccctgtcctttgactgtcacattcatatcagtagtaataaattgtgaagtaaaacatctgaatgttttgccttccactctccctacaccagtactagttcattcctttgaaatttttttttcctgttttgtgtttagggatgggaggaagttgaatgagaatggctgtccacaggaaaaatgaaaataaattaggctttgctgcataatttaatgttcaaaaatgtagagcgtcccagtgctgggagtaaatgggtttaaagtttacattat

SEQ ID NO: 119673 - DNA, 1184 bp, Homo sapiens
ttcaagagattgagaccatcctgctaacacggtgaaaccccgtctctactaaaaatacaaaaaagtagctgggcctggtggcgggcgccggtagtcccagctactcaggaggctgaggcaggagaatcacttgaacccaggagttcaggttcagcctgtgcaacatagtgagaccttgcctcttaaaaaaaaaaaaatagaaaaatgagaagagtggcattgctttatatttttttgtaagtctctttaatgcttggtttaataggtgagctgtattcgcatacagaccagactgcctttagtctgttgtggtatcacatgtcttgtgcctctggaaaattccactatatagtcagaggaaatgaaagagaaaagggcaaggaacatcttagtactattatacaaataattttgacttcacagatcccctgaaaggtttttggacccaggtgtccctgaatcatactttgagtactgttgttttagggcatatttggaaataaagaatttttttttttttttaagaattcttaagactttttttacactaggtcatctgacttggttttctttttaaaactttatgctaattgagcaggatgaaatacctttgaaaatttaagattatactccattagcttactttgtgtttgattcttatttacatgaagctcagaagatggcattatatggccaattctcaaagatattccttggttatatactgaattgtgtgaagatgtatcatctttatttaaagagtatagatgtctttgattttgcacctctaacttctaagcaaatgccagctactttcagagactttcttaatactctgagctgcttccatctcatttcccaaacttatcttgatctagatagggataaggtgagcaactgacccaccttatatataagtagccaaagaacaaggccggatgatttgagggcaacatgaagagaaaacaggtttagaaatcattccacttctttttgtcacttcagttcacttgtaattgtagcattttttaaaattgtagcatcgtttttaggtttgcataaactttgagtcatgtgactcagaagttcatgcaaatacacacacacacacacacacacgagagagagagagagagagagagagacagagacatgagagagagagattgagagatttgattaat

SEQ ID NO: 119674 - DNA, 2056 bp, Homo sapiens
tatacagttaaattattttatcaatcaagatatataaaactattttcttagctgggcatggtggctcacgcctgtaatcccagcactttgggaggccgaggtgggcggatcacaaggtcaggagtttgagaccagcctgaccaatatggtgaaaccccatttctactaaaaaatacaaaaattagccaggcatgatggcgcgtgcctgtaatcccagctactcaggaggctgaggcaggagaattgcttgaacctgggaggcagaggttccagtgagctgggatcacaccactgcactccagcttgggtgacagagtgtgagactccatccaaaaaaaaaaaaaattattttttcaaagtggtatttttctaaaagtagtgcatttaatcttttcagttagtataatatgctgtcttctgtatttttattgtagtcatttagcttttcttagctttcaggagcattttattacatctctactacgtcagttaaggcagcctgagtggcattattaacagttttcctttttttttttttttttttaaatgttgcttaatgtagttttagggaattatactttttctaaaatttttttctgacataagtaccctctaacactgaaaggttgtcccctctcaactgcatgctgaatactggatcctagactcttgagagctaaataaagtatatcttttagctgcagtttcatattaaaaatgaatttttaacaatctgcatatttagatgaaatattagggaatagttactaaatgtacaaaatggtataagaaatgtatgttcgtgtcctcattatactccattccataaggtagtaaaatacttgtctgtttttcttacagaagttgattcaagtcagttgagacgccagttgtgtggaggaagtcaggccgccatagaaagaatgatccactttggacgagagctgcaagcaatgagtgaacagctaaggagagactgtggcaagaacactgcaaacaaaaaaatgttgaaggtgaatatattttttcttgaaaaattatgaatatgtcagaggaactaaaatgtagttttgtgaaacactgagcagtgtaccagaaattcttgttagggaactgggacctgaccttccccctggctccttgcccatctgagagtggaaatatttgatgaagttaggcagttctgatctactggaaagagcattggactaaagcaaaaaaaaaaaaaaaaaaaaaaaaaaaaaaaaaaaaaaaaaaaaaaaaaggattaaatcccagtgctagtgcttatcaacattgtgtgtcctcgttaacttagtttcttagttttattttctcagctgtaaaatcagcagttactaggagcaatgtgggcgtgcagataaaactataggtctgagatctcattttagtaaatgttgttcaggtttatagcattttggatgtataacacatggttctcattttgatgggaattagtgaagaattgggtcacttttcatggccagaatagttaaaatacattttaaagtctcttctggattgttgtccatgagctgataggatggatacaatctaattcagtaaagtagccacagttttgtgtaccagttgaaggtggaggggctttctcctaacttaagtcagcattgcagttgtagagatgtacagctctttaacagttggttcattgtaaacattttcttctgaatattttggaagaagactgaaattaaaggggagatgaatgcagtggccttgagactaatgtttgggtatggtaggaaagggcaagcaaaagattcctgccgctgtttcttcctgacctggactgaaagttagtacaggttgagtatccctagtccgaaaatctgaagtgctccaaaatctgatacttaagagtgccgacatgatacacaaggatatgctcattggaacattttggactttaagatgagagatgctcaattagtaatgttttaacatttgaaaaaatctgaaatctgaaacatagcacaagtgtaggacataacatgcttgcctggcctaggatgtg

SEQ ID NO: 119675 - DNA, 1225 bp, Homo sapiens
catttgttatgttttcacagtggttaagacacagtagcatatttaaccttgaacggtgacataagataaatttacaactgattttttctctgtgtgtgagttttttttggtgtaaatgtgtagaatgttttccaagttcaaaactaactttacaaataatcttttttgaaagcctgcctttaagtagcttgcatatagcagatggttaagtcatttagtaaacattggtgtgaggatggttttgaggatttgttgggcaccaaacattctgctaggtagggtgtctcactttgaagaggtttgaaagatgatatctcagtcagtgtactatgacccttgatatactcaggtttaatatttatgaaacctaaaagttcatgaagtgacattatttgaattaaatactactgtgcagtagcaaattattgtgaattcaccctgcccaaatcatccaggactgggtcaatttaatattggtttggtctataacaaaccagttggttacattgcattttcaggaaatggtcatcagtgccacattttcttattaaaggagagagagcctaacttttagcatggaatcttaatggaaatatgattttgcagaaaggattgtatgtaaaaaaaaatctgtatttgaaaattgggagattaatctcaatttctgggttgtctgtcacacgtgacaaaaatttactgaagtaatagtgtgtgtgattgatataagttgtaatggagaaccacaaaagtgtatgagaagagcagaaaaatcgtctttcacagcagaggtgatatattggaaaatataaaatcaaaatattatagtttaaaaatagatggaaatgtaaaaagttaagtacttcatcatgctttatactaaatgcattggtactttatcattgatcaaggctcttgccaatgtttgagggtaagattgcagtcagtttgtgagtttttctcttgaatactatccctacagcaggaagttgctaaacagatctattattacctgagttcagggaagcaagcttaacggaagggtctgatgacacaacatcctcctttgtctgcagtataaaagggaaagaaagtcaactttgaactgccttaagctataagttattttgtagttggtaatggctttcctaactgtgaagtaggcaaagatggtattaactatttaaaccattttacagatgtagagcgggatatcagaaaagtaaat

SEQ ID NO: 119676 - DNA, 1049 bp, Homo sapiens
ttactaactttcttttctgaggtcactaagtttatgttttatctacttttgtaaaagttaatcgtttgctttcttttactgaataggaattcagaaattggtattagcaggaagaatgggagaagccattgaaacaacacaacagttatacccaagtttacttgaaagaaatcctaatctccttttcacattaaagtgagtttgcataataaaatgctatatttgttatatattataaatatttgtcaagttatgtaataaaagacattttcgtgcttttgtaattttagtttttttcgtttttcaagtatatacaattttgtaatgtcatttaagcaacatgttatgaaaaatacttttgtgttaaggaccataagcagaaggtgtcttttgctatgtatttgcttttattattctatttatgtgtttaaaaatgtgaaaatcttatttagaagatgggtgtctatttttccttctcagaagtaccttacatttaatctctctggcattttaaaaaattgtggtaaaatatacataaaatttaccattttttacattcacatcattgtgcaaccatcaccaccatccgactccagaacttctccatcttcccaaactgaaactctctattaaacactaaccatccattcatccccctagcccctggaaaccaccattctacattttgcctctatgaatttgactacccatataagtagaatcagagtatttattcttcattactggcttattttagtgtaatagccttaaggttcatctttattgtagtatgtatcagaattttcttccttttaaaggctgaattttactccattgtttggataatactgcattttgtttatccattcatccactgatggacacttaaagtttgcttctacctcttggctgttatgaataattctgctgtgaacataggtgtacaaatatctgagtccctgcattagatttttttggttatatacccagaagtgaactttctggatcatatggtaattctatgtttaactatttttttttaataatag

SEQ ID NO: 119677 - DNA, 1360 bp, Homo sapiens
tgcattttactgtgaaatctatttaacatattcacacagaaattatccgctcttgatctttaccttgttttgtactgaaaaatacttgttataactattaaagatataagacataaatacagaaaatgaaaatatggtaggatttggagttgcaagaggaaaaatcagttttggatgtggtatcagacaaacttgtgttccaattccatctctgccatttgttagcagaacgaccatgagcaagttatttaaccttgaatcctcattttctctgtctttgaagtagaaataataatagtggcctcacagaattatgattaaaccctggcatttagtagccactcagaaactcattctgcctttagatgtaacaaccaattagtgacatagccaaaagaatgacccctgtattttttgtttacttgaagttatcaccttttcatcttgattaaccttgaaaccatggagtgtacctgaatgcatttctgagtttgggtatattcagattcatccttttcctcccttgaaatacatatatttgaggttttgtgttttttttttaatatagagaatctccactcttcctggcactgtgttttgcttatagttatggtcttatccccttccctttgtaaagttaggcatcccaaatatacagaatgaaaacagtaaatttaagctattaaatgccagactagctgagatcatacttttatgataactagctttaacatgcagtttatagaaatgtatcatatataaaatgtgggataaacctgagttatgtgtttatagttgaatttctgtaactactatatgacataatcttagaacaagaattacatgcacatatattagtagcataataccacgtggtataatacaacgtagtccctgaataaataaaacagagatcttgggtctctttgttttttcttgatgattacattgcaggaagtgatattttttcatctaacatataatgtattttagatcatttgttttagccttctaatattttgattgggattttaaaatatgaagtaaatttatagttctattcttttaaatgtaacattaaaagaattattaaatctaacataaaatggatagatgtttaatgaaatatgctatcttacagccaaatttgtatcctactgtggggcttcaaacaccaggagaagtggtcgatgccaattttgggcaacatcctttcgtgtttgatatagaagactatatgcgggagtggagaaccaaaatccaggcacagatagatcgatttcctatcggagatcgagaaggagaatggcagaccatgatacaaaagtaagagtgaagaaatttcaattgatgctattca

SEQ ID NO: 119678 - DNA, 1004 bp, Homo sapiens
tttaaaatacagtcttattgatatttattaggtttatatgacatgcaaagaaagagatcttttctctaaccaccttgggtgtagaccctcagaaattaagctccaacttgcactggattcattgtataaaggaaaataaatcagaattgattctcaagtgtctttttaaatgtcaccattcattcatttgaaatgtatttccttggacttttcagcagaaggctgtatagcagttataatcgtttattcatccaagctatatagaggcctactatgtggcaggtaaagtgcttggaatatattattcaacaggtagtaaaggtctctgccctcttggactttatagtattcaagctgtgaaagagaatgagcagtacatgaaaaacaagtaaagtagaacatattttaagggtgttaagtatactttggaaagaaagggaaaaaacagagaatgggaataccaacggtaggacacaaggttgtacaagttgctcccctttgctcaaggtgagacttgagctgaagcttttggaggagtgagggagtctgccaagtggatatgtagagcaagagttttcaggcagagggaggttagagaaaaggtgctcaggcaggagcacagatggcttgtttgaagaagagtgtgaagtgtggtagagaggagtgaggagggcagagcatatgtagtagcagatgatcagagataataatggggttgggggtaagctattaatagatcatctagacctgggcaagccattgggagggcttggaaatttactctgagtgaaatacaaagacattgtggacttttatttgtcatgataggacttcagtttttatgggatcactgtgattgcttagttgaaaagtagactaggccgggcatggtggctcacacctgtaatcccagcacttagggaggccgaggtgggcggatcacgaggtcaggagatcgagaccatcctggccaacacggtgaacccccgtctctactaaaaaaa

SEQ ID NO: 119679 - DNA, 1033 bp, Homo sapiens
tttttaaaattttgtcttgatcaaaattatatatttttacatatgaactttgaaataattttgctcagttttaaaacttctgttggaatatgtcttgaaatgtataaatgtgtgtctacatcattttagaaaggttgtcctcctttttttgtttttgccctccagcctgagtgacaagagtcctggtctatcactcagggtggagtgcagtggtgtgatcattcatgtctcactgcagcctcaacctcctggggtcaagcagtcctcccacctcagtcccccacatagctaggaccacaggtgtgcaccaccgcacacaactgatggttttgtttttttttgagacaaggtttcccaatgttgcccaggctggtcttgaattcttgggctcaaaagatcctcctgcttcagtctctgaaagtgctgggattccaggtgtgagcctctgtgcctatctgaaagattgccatttttatgctctccagttatccagaagttaactatatccatttatatacagcttttaatatgtaattttgagccttccttgagaaccttattcctgttttatgttttctgtagttattgtggctgtccagctggctatactagaagaaatattaaaatgttcctcttacatgtagtcactttgccagaatgcctaaataattataaaaggttttggtagattctgtggttttctatgtatataatcataccaactacaaataaaggtacttttatatcttttaacatttatgctagtcatttagttttcttattttattaagctttctaaagcccctaaaacagtatttaacaattataggcatctctttgttcttgattttagtggaaatgccttcagtgtgttttactgttgaatatcttgcttgctgtatttgggggaaaagtctcatagttaaataatttccttttattcttattttattggagttcttattaggaatggtggccgaattttatcaaatgccatttaaaaccttgataacaataatgggcaattagcctt

SEQ ID NO: 119680 - DNA, 1062 bp, Homo sapiens
ggtgattttgtcattgtaggaatatcatagaatgtacttacacaaacctaaatggtatagaccataccacatggcttattaaacacctaggccatgttgtgtggtctattgctctgctcctaggctacaaaactgaatagcttgttattgtgttacaatagggaattgtaacacaatggttttgtgtatctaaatacatcacataggaaagatacagtaaaaatgtgtggtataaaagatttaaaatggcacacttgtatagaacagctccattataatcttataggactattgttgtacatgcggtctgttgttgaccgaaacatttgttatgtggaacatcactgtaaataggtttttaaaagtgtttcttgcattgccagcatgtgatacatatactaacttaatcaagaatgtaatagatcaaagatgcattaaaatcttaataaggtagtcattaatatactgccaaaaggtatagcagaaaactaataatggccataaaacaaaaataagaattaaaaagaacacagaaaaagatggagagaacagatggacagatagcaagatagtaggcttaagcctatcaataataggaattaaactagaatgctgttagtctccattgtatgttaggcacaaacattacttacataactgttaataaatgcataatttgtgatgatctacgttgacatattgatctgaaaaatcttcatgttcattgctcttggtaaacacatagtaccacaataataaatttcttgttcacataaattttgcctgtccctcactgttggattgagtttgtttttatatgtcagatagcctttatatatctaccagctattcagtttactgtgtgtcatgagccacacccagccacaactggtattacaaatttccctttgtcagataaccctcctttcatcacttcacagtaactcacaagtggtaactcttatgacacccatttcccaggcataaacttaggtgtttttcaaggtaaaatactcactttcttgtagtatttattccataacaattttttgttgttgttgt

SEQ ID NO: 119681 - DNA, 1131 bp, Homo sapiens
gcaatttatgtttgggtgggagagaccttgttgtatgtatatgctgaggagaaggaatcactagtgagtccaggagaaggctgaggaggcgaatgaggcaagtttctttgcccagtaggtgggatatggggttttaagtataaattaggaaggtgggatgctgtgcggaatttatttattggcacttatcactacttctggaagcctgtcttgacagccttttcacctccaaacaagatgaggctcctctgttaacaccctttcacagcatcttgtacttccccttcatagcatttaatcaccttcataattatttatttaagatctgtcctacccgttagagtatccctttagggagggcacagacttttgtctttgccacagctttatctgtgtcatcctacacatagatatttagtaaatgttcattgatcagagaagtgaaggtattgaggaactgtgagatttaaaaccacaaatttgtgacagcggtttacatacttacaattttttactatatacccagctggttagagaggaaagttgaattgtatgattgatgcaaaatgggaaactataggttaggtaagttggaagaacaattgtagtaattgaggttacgggtgagggaatatctaaatggaccattttagttcaggctgggtagggaaaaaatgaaatcagcacggagctgatatactcagacaaaatgagagatttatatattgctgtttttagtgagttttaaggagatgcagagggatttctgaggtggatttgctgcatttggctaagtgtagggcataacaatgaaagacaagagaagaaaatctttatcagagaggcttttttggtctgttttgtttactgctatatccatgttgtgtagaacaatgccagacacaaaataggtgctgcataaatatgttaactaagtagaggtgggtagggataataacatcttttcttttgtaatcccctagcacttgctgtgcatagtacagagtatagatagtcaatatttatggaatgaacagaatgtgagtcttggattttggatatgttctaaaaaccattaagaatggtaggagccacatttttggtggagagaaaaattggttatttaagaag

SEQ ID NO: 119682 - DNA, 1105 bp, Homo sapiens
ttttttttttgtggagatgggtctcggtatgttgcacaggctggtcttgaactcctggcctcaagctatcctcctgcctccctaagtgttgggattacaggcatgagtcactgcacccagactgccttcaatctttttgagtagggaagatatatgatacctgctttagaaagataatacaaagtggggagaggatgaagtgtgtgatggcggtctgcaagactgctacagagtttacgggctagggctaggagttaggttgtgaggcggttgcctgaggatagagtgtgatagagatttaaaaaaaaaaataacaggaggaaaataacagacgaggagatttagtttgtcgagtacctgttatgtgccagatactgtgctaagaacctaggattgacagagatggagacagggctgtaaacatggctgagaaagggtacctactttccagaagtttgcaggtaagaagggaaatgaacatgtaagtaactaataaaatccagtatgagatacacagtagtagacatataaacaaattagagaagtatgttggaggaggtaaccaacactgttggaagacagggtggtgatcagggaagtctatctaggaagcttacataaaattacagaagaggaatacagttaaacataagcttctctgtccttcagttgctcaggtatccttcacaagataggatatgaacagagatgttaaagattagtagctgttttagaagctgactagttacttttgttgagaaatatagtggagatgtaaatcttggctctgctacttaactggttctgtggttttgtattttttgacagactctctcagtctgtgaaaaggaaataatagtgccaacctcataagactaaattacataactcacttaaagcacttattagagtacctggtgtgaagcaaactcaaggtagcttgatgctgctctgaaaaaagatgcctggtgcacagcaaactcgtgtcttcttgctgctgctgttgctgctggctgctgccactgctgctgctggaggaagctcagcataaagttttgtgggaggaatgtgtctggagatgatcatgaagggacttctaatgcta

SEQ ID NO: 119683 - DNA, 2962 bp, Homo sapiens
aacatctttgtaaagtatggaccagaaagagtagctgttaggaaccttttgtttgcagtgatgtgtgcccatctgagagtttattctgcttaatttaaaactgaattttcgctgggcacagtggctctagcctttagcactttgagaggctgatgccggtggatcatgaggtcaggagttcaagaccagccttggccaacatagtgaaaccccgtctctactaaaaatacaaaaaattagccaggcgtggtggcaggcacctgtaatcccagctacttggggggctggggcaggagaatcgcttgaacacaggaggcagaggttgcagtgagccgacatcacgccactgcactccgtcccaggtgactgtgcgagactcagtctcaaaaacaaacaaacatacaaacaaacaaaaaaaaaacactgagttttcttttaaacagtgtttatcccagatctcagtttttaaaataaattgtccttggcaacaaattttctcatgaaatggcaagagttggatgtgaattgcctctttcaatagggtagaaagaactggtgttaatgtattatgtgcttgtaaagacttttaattcctatggtgtacgttatttctaggtttaccctggaaaattaggaatatgactgtcatgattgttacttgtatttctttattgcctagaaaatgagacctgaagaaagttccttttattgagtgaaagaatatatttcattttctgccatgagttttcatttaaactgaacctaagttttgtatatgtgcagctaaataaatttattaggactaaatagtctttaaatattattaatttaaaaataaaatctaatgcatttcacaagaaaaattaaatcactttatctacatgactttttttttttttttttttgagacggagtctctgtcacccaggttggagttcagtggcacaatcttggctcactgcaacctctgtctcctgggttcaaggaattctcttgtcttagtctgtcctagtagctgggattacaggtatgccccaccgcacccagctaatttttgtattttcaggagagatggggtttcaccatgttggccaggccggtcttgaactcctgacctcaaaatgatccacccacctcggcctcccaaagtgttgggattacagacgtgagccaccatgcctggccctgcataacttctttagggcatatatttaacgggtgtgtgtttactttcccttctttttagtgatcattgaccgttgagatgaatttctttaaggagtctgtatcttaggtactttcagttcagggatttcattcaaattttaaattatgcatattaatagaggcagtggacatactgttaattctaaatgtgagagagaacaaaatttttatttgaaagtttttagaattataatttattatgaatggtatttttagctcttcaaacaaaatattgatgccactctttgacagtgtttcagtaagaactggcaagtaattcagtctctctgttctgttcctaaattcttctgctgataataaagtgcactctttcagaatgttccttttatgcttgctgactttctagtttatttcttggcgggggaggagaacaaaggtctttcttcctgtctagctttgaaaactagaaggatctttccttctaggtttgattcgttgtaagcagcaaatggaagcacagggtaaatgtgaacaaagagtaaacaatacatttattataagtaagcaatatatttatttaacaaatatatgttgaacacctatgatatagcacatcgtcagcagctgagtggggataagaaattattttattgatttgtcttattcatagttcttactagaggacctgacatttagtagaaactcaattaatacagtgagtgaactgaatgtggtccctgcccttgaggaagatcaaatttagtgtagtcatatgtcacttaactacggaacatgttctaagacatgagtcattgggcgatgtttttttatgaacatcgtaaagggtacttatgtaaacctagatggtatagcctactacatacctgggctgtacctactacatacctggtctgtccaacagaggactacatacatagtcctttgttgaccaaactgttggtatatggtgtttggaagatatggtgggacaaggcaggaagcagaaatatgcaactcttaagacataatatactaagtacttagaaatgagaccatgtatgggaaaactgaggagagagtaattaattttggctcaaggaaatatttatacaggaagtagtagttggtagaccttacaaaatgagtaagaatttgagaggcctttttggggaagaacattccagactatggtaaatggccagaatagtctcacaggaagagtgcaactttgtggtctttggcagagatacatggttcagtattgttggggacttggattataaggaagagttataaaagtaagaacaggctgagtgtggtggctcatgcctgtaatcccaacacttagagagcccgaagcgggtggatcacctgagataaagagttcgagactagcctgaccaacatatagtgaaaccccatctctactaaaaagtacaaaaattagctgggtgtggtggcacatgcctgtagtcacatctacttggggagccaaggcagaagaatcgcttgaacccaggatacaaaggttgcagtgagccgagatcacaccactgcactccagcctagcgacagagtgagacttcatctctcaaaaaaaaaaaaaaggaaaaaaagtgagaatggaatcagatgttatagagccttgatgatagttctagggtgaaatatactctataggtagaagggagctttcagttttttgttttgttttgtttttgtttgcagcagagtcttgctctgtcacccaggctgtagtacagtggcacaatca

SEQ ID NO: 119684 - DNA, 1955 bp, Homo sapiens
aatttgcataaaaggctgctaggttcaatttccatatttggattctgcaatcttaataaaactagtaatagtgtgaagagttctgtggttaacttgggctattttgcatattgggttcatggtgatgataaacgttttattgagtatttgaactgataggagcagaaataatacatcattccaaaaacctatatgttcctgaattgtttaaggttttcatctttcagtgaatatctcatgtgacttcttttttccttcctgtttctatgcaggtcatggcaaaaccccaaaagatgccgcgtcagttcgagccacgcatccaataccagcagcctgtgggatttattattttgaagtaaaaattgtcagtaagggaagagatgggtaagtaaattttggtgagaaaaatcgtttgctagtttttttgttttggttcataatgtttatgatgtaattggaaagttggaatcctggaaattttgctaattggaaaagtggaatctgaatatttcagtataacagattggatctggttatgcttaaatactagctgaagttaaagcttgagttggtgatattaactaagcttttctggtaggtttattattaaaatggagaatttggaattaaggaatgaagggatggtgactcattttccatgacttttcttacactgctttttcgtgaattctgctaagaagttaaatcctctcaaactagtaatcatagtcagttggtgattcataggtattttacagatgttggacttagaattttaggtttcagctgggaaatgtgtatttgtatgctctcaactagaggagattttcaaggtttaggatgtggtttagaaatttccaaatgagaattccatggtagggcctggaaccaaattttatatcattgcttttcagcttgggattggtgtgtggtttgtatgggtatcagaattcacttatgagactattaaaaatatagtaatttttgggccttaccccaaaagttcctaaattaggattttcagaagtagagctttgggcaagataggcattttgagaaagctccacactgaattttggtgcctatccctggttaagcactaattacctagaatcattggatctatcctatagtatttcctgataactttattgcatatcagaggtctcttaaagcagtcatagggtctttagttgagttaccaagacaaagcttattgagctgtgtggataagttgccctgtgaggtcagtcagatggacctcaaatcaaacccctcttagtggtcctcctgtgtttaattaaccaaataagtgtattcagtagattactcctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagcttgtttaaaatctttttctgaaaaaaaaaaaaaaaaaaaaaaaacatttggttggtggtttcactattgctagaaacttgagaatttcctgcttttaacttttctgttcatctctactgcctctccctttgtcagatctcaattatttatctgctgaattactctcagatagttggttgatgggtctccagttgctgcctgttttgctcttattctagtctataactgttgt

SEQ ID NO: 119685 - DNA, 2069 bp, Homo sapiens
atctaatttaaattttaatttaaacatgaaacaaatctttttagttttaatatttacagaatttatctgcaattagtgaatcctaacaaatataatggatccttgaagatttataactggtactttatagtaatttttgcataatggaaaaatgtatgggattttaattcatgcatggatctaatatatgtttctaccaatttggggctgggtatataatgtgtaaacattttatttttttttctgtaggcccatgacagattacagatttcttcatttcaaaaagtgaggttaaataatacctatttcgtaaatgttgaaagagaaaaatccatacaaaagcacccaactctttgagagactgtttactttcaaatattggtttctttctcttttcccgtagaagtagtcagaataggacatggggatatgtgaagtgatccccgaatgttcattgtaactaaatccttcatgtgggttcagagctcacactagatcaggtttcttgaatttaaatcccagcacaaatcctggtttggaattcgcttttagcagtatgactttgggcgagtttcattatcttcccttggattcctcaactgtgaaatgataatagatagtacctacctcatggggttgttttggatattaaatgagttaataaacttaatgctcttagagcagtgcctttcacacggtattaaatatatgtaactattatttgttattaagaatactttgggattactttatcactaaaagtttgggtcactccccttaaaaaatcagtggatttagaactgcagttagattttgtttagatagttttctatagatttatttgtaacaatctaatttttaaatatgtagtttccatggccttttctcaggtaacttaattatttgaacatattttgactgaaaaatgtgttttactgccaccataattaaattttattaaaaagtgactagtgcacagacttgtgcaattgtttcttttctgctgcttagctcagtgtaaatctattacctgcatcatatgttgaagtagttttgatgcatgtaaatactgttgcttccatttttgtcttgcctagccaagcttgttgactccttatggtcaccaggctaaaagaacttctgcccataacccaagttttcatggtaatggaaggagtggcagaattcattccatttttttgtggggggagtggggggtgtgaacatgtactaatttgcattgcaagtgtaaacttaagtgtttaatagtaataaggcatgtgttggaaatttgataaatttggtcaagtgtgtggtaagggaggatatgatctcattcatgtgtgatgattgtatatcttaagatacaatttttgacttacaagaaggtatttagttttaaaacaatcataaatttaaggagaattctgctacccatgaagataattttatagtatgactgaaagattaatgcgaagtttgtattgcgtggagcatatttaactagaacaccccaataatgatttagagtattgtttctcatgcagtccttttggggatatggagacttgtctcactcatactctatgagtactttctgacatgctacttcaacttctttctttattcttccatggttttgtggacatattttctcttaatattgtctacatgctagctttcaaggtaatttgtgtcttgggcgagaggtaggggaagtgattgtgagtttagcaaaccctgtgggattagaattgaggaatagctggtttaaaaagtttgaaagccattatctaaaagattttctaaagtgtcagcagtggcatggtgttacttctgttgtttaaaaagaaaaaaatacgtttagaaattagatgtatttctcaataagctattattggcccaagagattttatgaatcagctttaattaataagactataccaaagaacaaaactgtaaattcttaagaaagctgttttgccaattcaatctaattgtgtaagatttcacttagaaatatacaatacagatgcttctggtttaaagagccaggactttggcaagag

SEQ ID NO: 119686 - DNA, 1031 bp, Homo sapiens
tactttatgtgtctggttttacaagcaattttgggttggcatttagagtatgtgacaaggagcatctgggaaaagatcaattaggaggcttttttttttttctcttttgaggcagggtctgactccattgtccaggctagaatgcagtggtgcgatctaggctcactgcaacctctgcctcctgggctcaagtgatcctcccacctcagcatcctgaatagctgcaactacaggcacgtgccaccattcccagctaattttttgtatttttttgtagagaagggggttttgccatgttgcccaggctggtctcgaattcctgagctcaagccatctgcctgccttagcctcccaaagtgctaggattacaggcaggagccactgtacctggcccagttaggagccctatggaatattttgttgagtttagatcttattctgtaggagatggagaatcatcaaaggattttaaatgggaagtgactggctcatatcttcatttttgtcagattacgcagctgattggaagatagattcaagaggttacaagagtgggaatagtaaattcatttagaagactattgcagtagaccatgttagaattgacctcagctgggtcagtggtaaggccagagaaaggcagatatatttgtgagatatttaaaagtaatactgagaggatatgaggaatgatagtgagagaaatcaaagaaaatgtttgggtttccaactctgttaggatgatgtttgggtctttagctgttaggctcttgcagtgaaccatgaataaaataatgattgtgaaggagactgtattacagtatagttggagataagtaaaaatgggaatctcagccctgtgatctgacttcatggaaaccagaagaagccaaagaaacaagccttacagaaagaacaggaacaggtcttttggagttaaggggactctaactggtcttaatagtcatgacttaattctattctattaaaatgactcagctccaatcactagtttctggttgttttatttc

SEQ ID NO: 119687 - DNA, 1034 bp, Homo sapiens
ggagcccgaaggacaagttcagctacatcggcctctctcagaacaacctgcgggtgcactacaaaggtactgggcgtgtgtcctgcggtgggagtggggcactgacccgacgtggccggccgccgctgcgccgctctcgacccgcccccgacccccgccctcgcgggctctgccctcggaggccactcgccgcctgttgtgctgctccgggtgggcgcgggggtcgcggtgaagggtccgagggtgaggggcgagattcttggaaaaggaaggtgagtagaatgccccagggtagaaaggagctggtaatcctagaccaggagcaggacaccttgagggaatccgggatgacaggacagaactggctttctgatttccctgggagataaatcttggggcttgggtagaggaatccatggactcggagttgggttacattgttctccaggtggtgggtcaggcgttctcctcttacaaggggggaagagaggcacgattctgaggtatgatttctaattaagagagagcagggatacacagggggaggagtaatcaaaattaggccagagattgtctagggggacaaaaggacaaggggcccaagtttgccatcaatatattttagtaaaagcaaccgggagggtaagagaagggaaccccaggaacaccctttttcttaggggagcagaaacctacccctcccgattggaagtgccctatacaggtccttaggtgttgatatcacatgaagtcttgttgaaaacgaagatggaacaaaatgcagcttagtattttgaagaaaattggcttatgttttgcacttgcagttaaaaacaacaaccttaggcttgtgcttgcccctttcctccctcacctacctctcctaggttaaaacaaagctggaagcaaatcagttgtatataaaattatgaattgctatgggaactattgaaatgtagcccaatttaatagcatgtatcaagtttacttgtgtggaagaaaaaaaaatcaacctaacgtatcagtcttgtctg

SEQ ID NO: 119688 - DNA, 1030 bp, Homo sapiens
gatctcctgacctcgtgatccgcccacctcggccttccaaagtgctgggattactggagtgagccaccgcgcccggcctaagtgtgttttaataaagatatgtgtcgggttgcctctagtgatttttaaccctgtctgaatattcagccgtcttcttgctcagactttatttgaatttggtaacatcaggtgccttttttattcttagcataatgagaaatagggcagagagagcatcttgcactaacacaaaactgaatacacatgcagaaactgagtactcacaactgtttgttgttttctcatttttgacaatttgcttttagataaaatgtgctataatgataagtgaagctaatactgaaactcaaaaaagtaacctacttgtgttttggaactgccactggatttcaagagttaatccaagcttcgttatacaaaataattattaaggctgtgttacctgtctttctagtcttacaacaacagtctccacccataaagattaaatcacctagtgttactaaatagttactgactatagcatgtcactggtgtctggaagaggagaaactcttttggttacctttatctttatgggttgtatactcaggaagaactgaattcacttgatataggaaaatgactgtgtgtagctaaccaacctgggaaaaactacatcaaggacatcaggaaatacagggcatgaatgtagattaaagccagtgaatttttttaaaattttatatggagtcattttaataacataactaggctgatatatatgtacatttttcaatcatgtaacatttagattttactcattttaagtcattaacatcatccagcaaacaaaaattttccagaaatttttttcacaattacagttttagtctttaaaccaaaatgaaaaaatttctgccgggcatggtggctcacacctgtaatcccagcactttgggaggtcaaggtgggtggatcacctgaggtcaggagttcgaggccagcctggccaacgtggtgaaaccct

SEQ ID NO: 119689 - DNA, 1072 bp, Homo sapiens
ctcgtctcgcggggttggacggcggggcggggatctcagctacagcctccccgaggaaaggcccggcaggccggagggcgggtcctccaaggccaccggcatctgcccggagcgtgggtcgaaggtccgggcccgccctgctcggccgcggtggcggggcttagcccagaagagacgaattcctgggaatcccgggcgctaaagttggagggaggtgcgtgctggggcggggagttggtgcccgcccactcctagggtctgcttttgggcgccgccttccaggagttctgtttggcagcgcccagcctgttgggcgttcaaggggaaggggtgtgtatgtttgagcagcaaagctctgggaaatgaagggattgctttacagtttgatttcaaattctgatggaatcattaattcgtggagtcctagcgtctgccctgtccctggcgcttttctagatgtgtgagatatatcagtccacaaaatcttccctctggagcttaattctagcagagcagacgcagtaaatatgtgtgtgtggatatacgtatgcataattgatgtatatataatttatatatacaaataatttttatatattcgtaattcgatgcctggtatagaaaaataggataaggcttgggaagtggaatgggtctccagttgtgaatttaaatagggtgatcagaatcgatttcattgagaaggtagcatttaattagagtcatgcatctcttcaggacagtcgcctactgagaaatgagtcattaggcgacttcttccttgtgtgaatattgtagagtgtgcttacacaaacctggatgctacagcctactacacacctagactatcaggtagaggctagtgctcctaggctacaaacctgaacagcatgttaccgtactgaatactagaggcaatctgaacacaatggtatttgcgcatctaaatgtagaaaaggtagagtaaaaatatgtattatagtctcatagaccactgtcgtgtgtgcccctctgtcctgggctgaaaggtagttgtggggctcatgactatttaaaggaggtgagagagatc

SEQ ID NO: 119690 - DNA, 1053 bp, Homo sapiens
aatgctggctggcagctccattccttttttctagtttgttcattattctcctgtcctggacaaacaaaatccaaataaataaacaagaatattagcagagataaataaaattgagataattaatgcaaatgagtggatgagtaccttagattaaagggtaaggtaacatttaaatagggatttgagtgacgagaagatttgatcaagagcagagcatttcagacagaatcagtgcaaaggccctgaggcagagagagaagacaggagagtcagatgaaatgcggttagaaagaaaaggggtggccagattgctccagactttgttattcagtgtaaggacttgggttttattctatgtggaataggaagccattctaggactttgtgtagagatggtctgggaaagatgggagtaatttggttaacattttagaaatattcttccatgtagagaatggatgtacatggaagatgcaagggggcaagattggtagcagggagacttgttaggagccaatgtcaatagtccaggtgagagatggtgtatttaccacagttctaattttacatttatttatgtgatcgattgataccatcgtcactagactgtaagctccaacagggcagaaacaatgtcttttttttttctttttgcctaaagttgtaatccctgtgttgtattcccagatgtagtccccgtatgttgacttaactgtcaattcagcattttccatatttcacacacacaagatatgtgtgtgtatcatgaccaaataaattattgtagctggcaggaaagtattcctaaagtcagaatatcaaggcctttattcatatatgcagattagagttggaagtccttcactctgattctgacagtggaatgacttacaagctacatattaataagtagaagatgttttcacaggaagtcagaacatttgatgatccaaaaagatagcacattagttataaccacaggatgtcactgaaattgttgaaattgttatgatctcttaatcatgataatgtatggatagaagttactcagca

SEQ ID NO: 119691 - DNA, 1092 bp, Homo sapiens
atggccagtcaacctcctgaagacactgcggagtctcaggcctctgatgagctggagtgcaaaatctgttacaatcgatacaatctgaaacagaggaaacccaaagtgctggagtgttgtcatagggtttgtgccaaatgcctctacaagatcatagactttggggactccccacaaggtgtcattgtctgtcctttctgcaggtttgagacgtgcctgccagatgatgaagttagtagcctgcccgatgacaacaacatccttgtaaacttgacttgtggaggcaaagggaagaagtgcctgccagagaaccctactgagctgctgctcacccccaagaggctggcctctctggtcagtccttctcacacgtcctccaactgcctggtcataaccatcatggaggtgcagagagagagctccccgtccctgagctccactcctgtggtagaattttataggcctgcgagtttcgactctgtcaccactgtgtcacacaactggactgtgtggaactgcacgtccctgctgtttcagacatccatccgggtgttagtgtggttgctaggtttgctctacttcagctccttacccttaggaatctacttactggtgtctaagaaagtcacccttggggtcgtctttgtcagcctggtcccttcgagcctcgttattcttatggtgtatggtttttgccagtgtgtttgtcatgaatttctagactgtatggcacctccttcttaactgatatgcaaaataagaaattggacacacattgccctgtttgagtgtgaagttagataatttataatttattttcttttatgttctttatgattagtatccatgacattaacaaaacccttggccacatgttgacttgattggttttcctgtaggctggaagtaaaaatgttcatttctacttaggggttagcaaaattgtataagctcacacttcatggagcactgacagcagtgagtcttcccagagaaaggacagggtttctctcagcactgccagacagacggcaggggtgtggtgtgttatactatagggagagcatggatccctcctttcgtattcatgga

SEQ ID NO: 119692 - DNA, 1041 bp, Homo sapiens
ctgcctggggccagcggggctggccggccgctccgactgcggggcctagccaagccgacgcccatccagaacttgcgctggcctgcaagcaccgcgcgcagccccggttcccgcccgcgcctctccctccacatctcaccacaagctgagggagccggctccggccttggctagcccggaaaggggctcccacagtgcagcggtgggctgaagggctcctcaagcgcggccagagtgggcaccaaagcgaggaggcgccgagagcgagccagggctgccagcccgctgtcacctctcaccttcagcagtctccgtggaacacgtccagtgatgggacctcactgttctcggggcaacaccttccgttacttgaatagctccaattattacacttcatgtagtaccaagcttttgtaatacagttattagtaaaaccgactaacgttaaacttcaccattttttttctttaaagttctattttgcattcaataaaagggtgctgtgtggaaaagcatgcatgcatctgcctcttggcccataatcaaggcaccatcattcacctggggcagcaaaagtatgaggcacttggatggaaataaacagcctctgagttttgaccttgctgatggtggtgagcgcacacttcaccctcgcttctgtggttagcagggccttctgcccaacggtgtccaccaagaacaaatcaatgctaacaggctggccgactgagtcataagaagcacaattcatgagtgagaagcacagcatcttcccttcctgccacaaaagggcagggaaagaagtggagccgtgagtcatacagcagcgctggtcatgggaagatcccaccagagttgtcaagcggccaggagagacatctcctttgatatgttccgttacattcctttttctccaaccagccatatttgaggagagattaacagctagactcccttcagtccaattcaacaaggatttgttgtgtatacgctgaccattttccccgaggggaatgactgcagtgatgaagctgattaatt

SEQ ID NO: 119693 - DNA, 1036 bp, Homo sapiens
ataactgattatgcaatgatttttaacaatgacctgccactatttactcagtcttagatactcaacaaacattctaagtcattaccactattgaatctctgtcgctctattccagaagcttgttgggcagactttcaaagtttccagttgtcttatgattgtagagcctgcatttccaataatgctggaatcagtttagaattaagccctggttggtgtgtgtcttctaatacaggatgaggagagccatttagtccctggcaggacctgcccaagtgtcagattttccacttgctcatttgtttgggccctgagtatgctccatggttgccagctggggatgaggtgctcatcactggaggtgttcaagggtaggtatgtaacacttgtgtagatgttaaggggaagtgtgaaaggttgtactaggaaactgtggttgagcttggctcattgctgttttctcttcttattgggcatcaactagatcacccttcccaaactcccttgcagttttaaactcttattttgtgaaatcactgagctttctgtatttacttgttttagcagctagcagttacctcagctaatacagtaacctttagcattccatccaatcagagtctagggtcataaatctgttctttctttctttttttaagatggggtttttctgtgttacccaggctggggtgcagtgctcactgcagcctcgacctcccatgctcagcctctgaagtagctacttcagcctctgaagtagctgggcctataggcatgcaccaccatacccagcttttttaaaaaaatattttgtagagacagggtctcactatgttgcccaggctggtctccaactcctgggctcaagtgatcctccctcctcagcctcccaaactatgggaattataggtgtgagccactgtgccttaaggtgataaatcttgacagacaagactcagttatgatttcttttgactttctccccacttatagttgattcttcttatgtcttctctcctctctccacagggtatct

SEQ ID NO: 119694 - DNA, 1027 bp, Homo sapiens
cttagctttttttcatggtagaaaaatcctgttaaaatggcttcacatgtcgcttacttttttaaaggatgccctgcacagcgtaaagaagagacttttaagaaatacagagcggagattgtcctgctgctggctctggttattttctacttaacactcatcattttcacttgtgtaagtatcttcttaaaacatcttctcttattaaaagattacccagggcaccaatccaagtatctcttgcagatagtgcgaatcatttaataatggtgagagagattattctttgaaccctggactttttgaggcccctagactgggagaatcattacaggaagctccctgaaatatttccagcttttgtctagtggctacgtttagagcattgtggaaaaaaaaaacaaagtaagatataggaaggacgtttgggaaatgacaaggggttctatgcaagagcagaggccctgtaggcgcagtgctagaagttgcagcgctgagggtcccccatcccagagcagaggccccgctcttcctgtgggtgagggagtgggccccactgccccagggatgccaggggatagatcagcctcctttggctgccttcaaactatttctcgtgggggttctccccttctatttttggtatttctgcccatgccttaagaattaatcccaagaagccagagcagtgaggcacagtgggaggcttccggggtgcaggatggctggccggtgctcaggcaccctagacatgcccatgagctgttggttgcaggttctggctcaaagccctcagagattctttctgcatggctgctcacctgtgttgatgatggttgtgggagagtagggccacatgtgtgtctgacccctctaggaagtgatctgccccctttgtctccatccaccaggcagggctggctacctaggggccaggacagacttcacccaggagctaccccaggactggttcttgccactcactgtgtccctctattcacttacttgcctctctggctgtgcactc

SEQ ID NO: 119695 - DNA, 1045 bp, Homo sapiens
tccaccatcttttaactggcccaacccaaacatctgggcatcatctcagacttactaccggacccaattcctcaccaaattcctcaatagttctcacatatacttcctgctgccccaccaccactgccaaatttcatattgtcactgactcttgtgttgatcattgaaggaacatgccaaacaatctccctgcttctagtcctgctttctcccacactacataccagaggaatcttttgaaattccaaccagattatgttacttttctgcttaaaaatctttcagtaatttcccattgtcttcaggatagaacccaaacgcattcacagaacatacagagtccttcatgatctctccctcgcctcccctccaacctcatcgcttaccatcctcctacctaccagtccttccctgcagtcaccttgatcatttgcaccttccccaggacattttcaagtctctgagcctccacatgtttctctctgaaattatttctcccttctcattatttctttcaagacattgtgtcttttcaagacatcttttaagacttagctctgttttcctttgggacgctttccccattctcctgccctttctttccttttaactaactgctccttcactacctccaatatacacacacctcaaaagtggttttcatgcctacatcatccagggtcccaacagaaaacagatgacaccctctgatcaatctaaatatgaggaaagtttatttacaagcaactaattataaagttgtgggtgtagttaagtgaaactacaggaactggtacagaaactttggactagcagcagcagtggagctctcattatctgtaggtcgtaagggagaaggtaagggagacagtaggtgagtttgggatgagcagtgatatttgatggagtcatcttcccaaggagagaaagaaatactccagagctgcctctcctctctgccccagtctcctaaagtgctgcctgtcagttgaagccaacaagaaaccagacggcccaggagtcttgttgacgtggtccatgtaga

SEQ ID NO: 119696 - DNA, 1001 bp, Homo sapiens
aaaaaaaaattaaccgggcgtggtggcgggcgcctgcagtcccaactaatcgggaggccgaggcaggagaatggcgtgaacccaggatacggagcttgcagtgagccgagatcgcgccactgcactccagcctgggcgacagagagagactccgtctcaaaaaaacaaaaaaaggaaacaaaagaaaaaagaaatgccagtgctagaaagaatgcacaagatcatctatttcaggcggtctcaaacttgagcctgcaacagcattccctaaagggctggttaaaactacacagatagctagacctcacccagcgtggcccattcagtaggtctctgttggggtttaagaatcttgcatttctaacaacttccctgagaatgctgttccagggaccacactttgagaactactctaattttattgatgaagatattgaaacccagagcatgttagtgattcatgtaagatcgcacacattctaggtgaccaaacccaagtcttaggagaatgtggtggttgggaaataaaaagctatgaagattttttaactaaagcccttggtattagtgcatcttatctggtttttacaactatctgccttctctttccacccaagcctgagaagtactgccaattatggtgtggggttgtgacagcagcagaggaggtgggggcgggtacggagcatccacaaagccctggatgttcttgccggtcttaacaccctatctccaagctctctgcacagttttcagggcataagtcagaactgtgagaactagcaaggactcagcgagagcttcttacccgtgcttcacgacacattaaaaggcaaaaacgtgttcctgcagatcaacccggaagagcctgctgcttaccggttggcgcccagtacctacacggcaatagctgctgcagcctgacaaattcgttgaaactctctgaaacacaaaggaatcaccgccagcctccctctcccattgtaaccctgccattgtgc

SEQ ID NO: 119697 - DNA, 1070 bp, Homo sapiens
tctacctattccctagagtctgctaacttcaaaagtctagatactcacacagctgtttacttgcagcagtatttgaagagataaccttggtgtctagaaaggtctcagaaactggaggtaagagacctggattcaaatcgcgccttggccacttcccaaaaggcaaccgagagcctctctgagcttgtcagtttccgcatctgcaaattagtggtgatcaaacctgtggggatgattatgtgataaataacagtaacctagtttaaaactaggcacgttattggaagctttcagtaaacgaaataaaaagccttttcgagagggtattttccttattatttttaccttttcaaaaaatctgaaatgaaataattttatctaatgttcacttcacaattggaaaaataaatgatcttttgtgccctgaatactgcaaaacttgtacgctggtgccatttcctgggaaggatccaatggggcagactacagtagggccacccaaggtgttttctaaaaactttctgatcattaggactggcatactgggaatctccacgtctccacgttgttaagattttaaccagctttctgtaagtttaacgcagatacctcattccctaggcaaatattaatgaacaaaggtgagtttcttttctgttcccctaactagccctggggcctggacttctcagtcctgggcttgcgaactcccctgccaggctaccagctccaggtcacctggtgtgaaaaactattgtgtaaagttgaggcctcagggcagaggggaaaggaaggaatttgctcatttccaaaagatttgaataatattagtgttgttttccctgaaagagaaaaaaggttggccttcttagtggttgaaagattttcctgttgtgaaagtaacctactcctaatgaacttccttcccctaccatcttggcaagaccatccaaggcttttcttgctccttcctcctctttttcattttctgtaagtcaaatgcagcttttcttatgatgattttcacatctcaaagccttgacctcttcaattggaggggcagggatgag

SEQ ID NO: 119698 - DNA, 5625 bp, Homo sapiens
agcacgctctgtacacagacgcgaggcgctgtcctgaggtgacaccggctgcacggcacaagcagcaggcgccgccgatcaactagttcgcaccgaggattcctcttggtgcgtggcccagttttccttaggacgggctccaacccctccctgacaccgcccccctcaccgccacgctccgaggccttccccggggaagcctcgcgtccctcccccgcggctccgggccgcacgcgcgcgattcctcgattccacaggcggttcgcgccgcgggtgggggcggggcgcgcggggagggggctggcggccgccaggggaggggggccggggcccggggggcggaggagggccggcgtggggagttcctcgctcgcggaccacacgctccgcgggccaatcccgagccagcctctagcagtgtcgcacgcgggacacgtccaagcgtttgttggcacggccagtgagggggagggggcgaggaggagggaggggagttgagtgacaggctttgcggggcaggctgggaattgtagttcccagcttccgtggccatagccattttgtagtcgggggactacaacttccagaagatcaaggggaccattctaaggtgccccgggaataggcggctctccccggggccgggcgtcctggggcactcctacccagcagcccggctgcaggtagacgcgaaggcagtggcgggggctggcgtggggcggccgtggggtgagcggcaggcaggggaaagggggtgaggtggagcgacggagcgtgccatgcattgagctagggagcctctctcaattccacgcctgggctcggcgtgggagcgacgcccgagggcttgcctgggaggggttcgtcgaggtcgctcgggtgtctggttggccaggctgcgggggtgccctggactgggccaggggcggtcggcaccaggctaagcgggcgcctggcggctgagcggtgggagttttcggctggcgcccggcggggaattatccgaggagccctaacttgtataaaagcagagtccatttaaagttgggctggatagcctctctctcattggttagggggcttggaaaaaagagactcggcgagccctcgctgtggtgctgccgccgccgccgccgccgccgctggagttgactcttctgctcgcactgctgctgcagcacaaacgtgacttccaacattttttatttatctttcccttttcttttccaagatgtaactacggatcagacactaaggaccttcacgtttcgctgatgtagtttttggaggaaaaaggggggggagtgaagggcgtcggtttttttttgtgtgtgtgtgtatgtgtttcgggggaaattttccattatgagtgttttactaaagtgaatttttttttgtttgcttcgttcgtctttggctctttttttttccttcccaatttcggatttatttcaaggcgaatctggctttgggggaagaggaagaaaagtcggattacaagatcaaccaccaccaacaacaataaaaaccaccaggatatttttttgcaaatttctgacggctttaaattcatgaagcaattgtccccttttgcaatcagcatttggatctcagaatgagcaaggaaagacccaagaggaatatcattcagaagaaatacgtaagtgctcctaacaacacatcctttgacttgcagttttaagcaatggctgtgaatgtcaagtttatagataattctgcctctgaagggttttaaacacagcgtccgataaggctgtttcttttttttctgaaagagggcttttcaagcaaagtggtgtctgcctagtttggttgaaaaaacagactggtgtagagatacctcaagtgaataaattgacctcgaatgacacaaccataatctacttttagatgaaaggcaagggattttggtggagcttgaggtggggggtggctgcggtaatgtaactaaactgcattctcaagcggatttggccccgtattgcactttgcatgcaaatgagcctgtgttattattattaatgttatttggaaaaatcgtgtaacgcatgtgtgttggaagccctttaagttgcgatcgagggtccgattatggcgatcttctctttgcactggcacatcaaatttaatgtctgtggtcgttttggcttatctggtttgcaacataaaccagttgggaatcatgttacagcgaatgcatttgttgggattgactttaataatgaggctggttttgtttaaaaaattcatggtttccagttgtaggggaaaaggacacacactatggctaatgtttttaagtgtgtacgtgaatgcatatgtaagtaactacaaataatttctccctgttaactgggcttctgaaattgggtgattattcctagatttaaatggcttggaatagttaaatttgttttgtgcatagtacagctacgttttgattggcatggggagtgtttttgttttgtgtgtggtggcttttttttttttttaagtttgaggggagggaggaaagggggaccgagggattaaccaaatatgcactcgagtgatctgtgattagctgcatgctttaaattaaataactctttttttttttcaaaaaaggccaaatgaacataccttaggaataatgcaacgtaagaggaaagtttatttaagttgggtagacaaattggtgttaatattttccctttttgatcattgtggtgtgtgtaatgagagatgaccttcggggcactggttttgtaaaaaaatatatttaatggaaaagctgaatgcctcttcaagagagctgatccttatctagacacgtcaacttcaactatgaaagaaatgcaaggttaaataatcaagcccaacttagaaagctgttccataaagaatttaagaattaaaatacatccgcattgcagagggctgggtagaatgcaaaggactagtttaaactcgggctgtagaaactgcactgaggcaaccttgtcttggagcgtggacgccttcccggggcacgtccgtttcggatgcagccacaaagcaaatggggtagaacttggacgagaaccgcaccccgcctcccattccggacctcgttgaggtggagagcagcgtggggtgggttttctttcttattgcgggcgttcagcggatcgtgtctccgagtccgggcgtccggctgcaagcccgtggctggcggcggctgcgggaggcacggcacgagttaatgcaccgggagcagagccggtgttcccgacgtcctcgagccggctgcgaaagggacggcccgcgggggtcgcggcaggctgggccggggctgggcgggcgggcgcgcgcgcgcggcctatagggggcatactccgggctctaggcgggcgcgcgaggcgggcaccggtctacccgggccggcttgcaggcgggcaggagggcgggtggggcgcgggggtggcgcggcctgcggggcgcggggaggggagagcgcgcggggagggggtgggagcgggggcgggggcgtgggcgtgccggggagggggcgcgcggcgcacagctgcagcgggcgccccccaccgcgcacacggccgagcatggcggcggcggcccggccggcttcccgcggccctgcctgcgggctccgacgcagtctcgagagcaacaggttaagccggcgagacgtcagcgcgccccctctccgccccccggttcttcccccgccgcgcgccggcgccccagcccttcttccctccctccgccccccgcggcgctcggttccccgacgctcccggccgcactctgttgtcattgtgacgtcacaaagggacgggctcgggtggaaccttcccctcctcctccgtgacgtcaaaagtcgggcgggaggctccaggcgcggcggggcggcggggggaggagggagctgggcgggggcgggggctgccgcagagccgggctgcggcgtgggaggaggaagaggaggaagatgcgctcggcctctgccttccgctccggagcgtcgcgcttcccaccaggtgagggccggggagccgtaggtccccaaaggagtgccactggaccctgttctgatgccacttgggaagcggggagcggggaggaggcgcctcctttctgcaggaatgttttcacttcctctgttccaggtctcctgatggtgttgcattactagcgtggtgcatgtgtcccctctccagtgcttatgtaaagaaatgaaagtattcagggaaagctgtgctttgttggaggaccgcgttgtggatttggccaccttgtcacttgaagtcgtgttaggggtgcttcagcaggatgtggccggatgcctttcatgatgatgctgcacagcagcaactgttgctctttctggaagctttgtggtactacggtgggggggctttcctttgctgtgccggctctgtacctactgactgttattttggggggctggaccaaaggaagacttgtcattgataaatgtactgagaagagcacaggactcctttaagtctcaaggtgctctgggcttagttcttctgagcagggaaaccagaggctggcgttctgttttctcttttgtaaaatggaaaaatacctgccattgccacttaactaagtcactgaaaagatcatgtgcatggaagatgtaaaacagtatgcctctttataagtaaggtggcattattacttgagctggtggaaggcagcacgtttcccacaattggtctcaaaagcccgggatgcctgctgagttgccatttagtttattaccttagcaaagcagagttgggggtgcgattgtcgatagtaggctttgggagaaatgattgttatatttcgtaataaatgatgtccttgagaaactcataagttgcagtgtaatcctgtcttaattgtgttgagcacgactcccactgcaataccttaaataactgaaaacatttgcctttgaaagccccaatcgacttggacaataaaaacagttgcatgttttgctctagagatattttctgccgtttccatcattccactgcctggttattcctagggagaataacagataggatactggggcttcaccactatttgatcaggtatcagtttgaaatagagaatctctgccttatgaagatagtaattcctgtagttagcatgaaaacaaattgccagtttgattttctaggacagctcaagcagaatttgtaccactaggctgtaagttttaagtatctaattttctgatttgaaagtgtatgatttaaaaattggaaaaagtttttgttataagcttcaaaaggatttactataattacaactacgtaaaattacaaagaaaaaagtaggaagaacacaaaatatacagtggttggatttatgaggttttttgttttaaaacttattcatcacaaattgttcagtcacgttattttacagttggtggggtggtggggaaatttgcacgttattttattgctgtattttttctttcctgggatgtttacgtggcttttcagttacttgtttctagtagtggaaaatcttgctctgtgttacttaggtgcagggcagtggcagtttagctcctatcactgtacagggacagta

SEQ ID NO: 119699 - DNA, 1063 bp, Homo sapiens
caagtgattcccttttaagaaccaaacttcagttatgcccagacttccccaacaatcaaaacagcataatgtagaacaacagaacgttcagagacttaagctcagaaagaagacccatggcctcatatcaaaaaaaccgtaattaaaagtagatttgtctgtcagttaatacaaaatgttagggaataccttttttttttaaaaattgtttgttatctaacaaacttgttcccattaactaaccaacttctggttcttgtcatctctgataagagtgcttccaactgtgtttagccttaatccccgcatgctaaactggactccctgtctgcttcatgccatgtaacatgtaaagtgtggatcagtttaaagtagtcctactgaggtgattgtattacttttggagttaaaataattgtgccatttactgagtggcagggagcagaaagattagtaattttgcacctaattcatggagttcagaagcttctatcttgtaatctggcaactttaattatatattgttttacttatgagatattgtggaaggtctgttccattttaaatccttaagccttacctgttaataaaaatgaaaccaaatgaatctgttttttcatgtgctcaattatctttcgttttttttccgtcctccagataactgtactctttatatcctgtgactccctaagacaagcctcaattgcttttccaggcccccagtctttgtttttctgattccttttgtccataaaccttttccatacttgcctcacccttgcaggcatcttttattctaggaggtgagaactccgtggtatctgtctacatttttgtagaagaagagtgagcgagattttattctcattatccttctaggttttaatctttcttgggacttcagacaatcctataaccttctgccagcttcaggtttttttaataaggatttttttttttgagacagaggagtctctctctctcacccaggctggagtgcagtggcgtggtctctgttcactgcagcctccagctcctgggttcaagctattctcccgcctca

SEQ ID NO: 119700 - DNA, 1629 bp, Homo sapiens
catgtttccaggacttcctgttcctgtcacttcttgcaggtggcttttgtctttcttgctctcttaggctgtaggaaagagcccacgcagattgttccagagggcaaagtatagatcattcctgcgtgagcagcgactggcagctcgactaccactctgggtttctggttttttttttacacttgtaccacagtttgtcttgccacagattttactattttaagggtgctgcccacctctactggggttcttttttccatttgaagaaatgtcccagaaaagcatggattatagaaaacacctccagatgacgacacaacacccacttctcttaacgggattgtgaagagaggactcagtcaattctgaaataaccgcctacattgtgagtttgtctgagaaaaggggtttttgagtccattttatagatgagacaagtaaggtgaaaaaccagtcagatggttagttttctgaatttgctccccccttttgagttcagaggacatagaagtaacatgaacgatcagtggagccccaaaaaggggagaagaaaaggttgtaaaagggactgttggcagcctttggagaggctttttgcttgggaaagttggaagggagggcagttttgtcagaagtgtccgtcttccctgcatgtttgtatttgttgttttttgaagaaccagttggtggagctacccccttatacccagctggctgtctctttgagtcatcattggaagactgacatcccgtgtcccttgggactggatggtttgtgctcttctagttttacaaatgcccccaccacattcttgggtgtatctgaggcccagtgtgggctgcagttctccagacttgcaggaaccagtttgatttcccagggctgttgactttttcttgtacttgtatcattgcccctgactttgaggcttaggggaccatggagcactggggaaatcatatgccctcagtcctcactaggggctgggccatccattaaacaaaggctgtccagatgtgttaatgaggcggtgtgagtaatgggaacattatacatgattacttacataatcatgggacagatgcgggtgttagagaaagaggaaccctactggtagaagtttttgagagctattcttgagagctggtgctgcctaaaaggtctcaattggattttaagttctaattttgtaagtctgtcaagctccaccacccatgaagaggaaggccagtgaacactgaaatattatcaacagcagtgtttatttaccatgctcctagaaggttaacaaaatacatagccacagggccgggcgcggtggctcatgcccgtaatcccagcactttcgaaggccgaggtgagcggatcacttcaggtcaggagttctagactagcctggccaacatggtgaaactccgtctctactaaaaatgcaaaaaagttagccaggcgtggtggtgggcacctgtaatcccagctacttggaaggccgaggcaggagaattacttgaggaggatggaggttgcagtgaggtgagtgagactctgtctccaaaaaaaacaaaacaaaaaacaaaaaaaaaacaccacaaaaacacacaaaaacaaccactgtgtaaccacagttt

SEQ ID NO: 119701 - DNA, 6198 bp, Homo sapiens
aattcttaacagtaactttttttcgggggaggtgaggaggaggagtgaaaaggataggttgtgtgactcttgtctacctggagacctggtttactgggacaggagaatgtgggagatcttctgacacccagtttattgatctcttaaaatcttggtggttctgtctccattatttcccagccaccattttggtgagagcttggtctgaagtggtagtgtattatctgttggttctctctcggtttcagccagctgttagagtgtttggtgcctgtgggggcagaaacaggtgccaggaggaaatgagaagggattagggctgagcatgtgtttcttgcatttagtccttctataggtttgcagaagggggctgagtgaatgcttattctgttaagcagcagacttttgtgctttgtgtatatgccttattactgctactaaatggacctaagtaatgaaatgcctcagatttggacaggcttgtgaatatatggggtacctctgcagtaatggacaaggttgggaatgtgagcctacttcaagtttggccttgtgttaaactggctgtgtgactccaggcaggctatacaacctcgctgagctatttcctcatctggacaacttatttcatgcacttcacaggcttgttgctgggagaggcaggggaatttttgatgtgaaagcactttgtaaactgcatactgctgcacaaatgctcaaggtattattacccagttggaaatcaccaacctggagacatcaggcctgccggcggccttcctagctgactcagatataaatgaatcaaatgaattctgcactttgattcttaataaagcaagctgatagcaagtagcagatgcacattgggaaacagaacaaggctttacggattagaaggtgatgtaatcaccttctacctctgtcctatattagccaacacttgactcctaaatacacctggatggtgaattggaaagagggatagattgagaattaagactggagtggcactgaatctgtgcacgaagatgtttaaagaagacatagtccttgaaattaaaaatctgattatgatgtgaacacaattctttagtggctctctggtcctcaggatcgaatctaaaccaactttgttcccagcccttcttgatgtactctgggcttatcctgccacccatccacttcacacatccggggcttcagctgagcccagcattttattcctctacttgcttggtgaatggattgcctgaggagcccaccgtgtttgtctgaagcctgtcaccctgttcaccccgtctggcagagccaggctctttctccctgttggctggtctcctcgcactttatttttaggtgctggagttatttgcttacatgtctctcaccctattaaccccacaagagtaggggctgaatttatgtcattgtaggtcaatgttaatgtctaatacatagtatacattctaggaatatttgagttcaagtttggtggagtatttcgagtactacttagtagtgggagggaatcggtatgaatctagtgcaaaaagatagacttaactgatcacaattttggacgctataattttatagttgagaattcctgaggtttctagtactgttgtaaagtgacctgcttgtggtcgcatattttatcagacacagctggggcatgaaatccaggtcctgatacagtagaaggccctctctgttactgcctttggaaatacttttcttttcagggggattttcagttattcatggtaactgcagtaattgattcattttcatggaaaaataaaatccacgtgtaatccccatacctaattaagccaatagcattttactgttgtgcagatggccttttttgcttaataagaagtgattcaaatcagacaagtactcaaaagatagaaatcattgaaatcacatactggacattcctctacttgcacatacagttttatatatatgggccatactctttaagtgctgtatttttgttacctcctgtttgcatttataacttgtcatggtaatcaaagacagtgatttttaatggcttcaaggccgttggttgatagttaccactattttcttgactcatctcttcgggatgggtttttcacagatttggggctgttgtacaaaatgatgcatgcagcctgctttgcacgtgtctgtttgcactcaactctaaattcttactgtgaaattactgacttagaagtgcccgtatttacgttttgatctttcctagtacattgctttcttggagagaggctatactaatttacagtcccacaggtagtacacgttaggccagcgggttggttggtttgttggcttttaaaaaacaatacaggcatttgtaacaagtagtaaagatgtcagttgagttttatttaagtttctattttcttcctgtgtcctctctcagggcatttagaactaaatgagataagatatgtgaaagcactttgtaaaacaaaattgctctaagaacacaatgtgttattagtcagaacagctccagaagggaagggaaagggagagccttgggtaattgtacaatgatgttcttattcttatatgtatgaaatgctttttgttgtgaggacatagagatacttaagtaataaagatgacccccaatcacattgttttcatatgtgatctcagccttgtttgtgaggtgggctttgtatatttacgaagatccctttgggctgtggcttggaagactgttcagttaaatacagctggcattttttggttgcttaccatgttctgacactgtgttgggagtttgaaaatacgacattgcccttgtctgaggggcatttacagtttagttggcagcagggatgtgaaacaatgggaggagagcactggctttggagtcagtctgaagttgaggatctctgctctgtcatcttgggtagatcacttcacctctccaggtctcagtttcttcatctttgaaagggggagaattgtgccttcattattggcctctcaaggtcattttgtgggaggctgaatcaaatgttaaagtgtgaagtgctttatgaactgtgactatagccggacgtggtggctcacacctgtaatcccagcactttgggaggccaaggcgggcggatcacaaggtcaggagtttgaggccagcctgactaacatggtgaaaacctgtctctactgaaaatacaaaaattagccaggtgtggtggcaagcgcctgtaatcccagctacttgggaggctgaggcaggagaattgcttgaacccaggaggcagaggttgcagtgagccgagattgcgccactgcactccagcctgggcaacagagtaagatcctgtctcaaaacaaaacaaaacagcagaacaccaactgtgactatttagaccatgttattataagtcttacagattcttgtggctgtaattctccaagtgcaagattgaagaggaaactgtttctgggtcatctgtgctgattatagtatatcccagttgttcgaggaagaggatagaaattcagataataagggtgcttagcacctttccttctcaccaaggcttggtttttcttcctaacttatggaaaaatgcagtgtgagtctctttacacccagacatatttttggatggatgggatttttatcttccctctgccttccctggtttgtgaggatgagggtagtgttcacagtgtgactaagaagcagcatgacttttttgcatacttttgaatgaactactttgcctgccttttattctccaggcaagatgtacccttagagatgaggtggaacctaacacttggttttacctaaattgcctccttttccattcttacactgcccagagcactaaagctctgtttgttctattttcagcttgtaataatgtcttgatgttggaggatgaaagagctgatgtgaatagaaggcatttaataaggagtcatggtctggagtcccagtcaaattggtagcacatggttttcatctgccttgaagggcttggttgcatggtcttgccttcccagagctgtgacagcaccaggctggaccctatacacaatgccacatctccttctcaaactgatgatttggagtggcaaatgccactggctttgagagatgccaaaagaatggtggacttggcttcttaatcttttgaagatcataaaatgtttgctagggctcgctcatctgcacttaggacaggggttagatgggtatgttggggagatgaggttattttagtggggtttggttaacgttcagttttaaccactgttcagccttctcactgggactcctagctggttacatttttttgatgggggttacttttatatatttatgtatttatgcccctcattctaaaaaaggattttaaagccacgatgagctgtcattccaggagcaaataatttttacttagatctgactcaagttcactttccaaatgcaaaaaagggacagtcagattaaactgtggacagcagagtagttgttcattcatctcaatgcagcagtgtttgggcctggcagtgtttttgcttttggtttgaggtcttgacctaaaactttaagtaaaggcaagttttgcttaatagtattggtattgacactctgacagatcttttaatctgaaagaattttaaagatgcatgaaagtaatccccagtgatgattacatcttcgagtggcagagatcagatttttatttaaataccaatgcagtttatcacttttttccacagtgcagggggccagggagggtctggatttgggagggtctggatttaatagtgaacttctgaacttgacttactttgaggggagcgattggtgggtgttactgcatgattcagtgttctgtgtctttaaaaatgttttgaaatactcattctgtattgtaatcctcaaaactactgttaggattccaaaccattgtggtttaaacttagctggaatctaaaaggtggctgacagagggaaaggaaacctcctttaaataaagaacatatttggcttgcctaagtgtcccagagtctgggctctgggcatatctaagccatgggccaagtctcatagttgaagaggtcgggaaatacttgtctcaaatataaacaccagctcaatataaacaccatcaattagttctgcagaaactcctggtacaaataagaacttgcaaagcttcatgttcaatggagttcttgtctggatgagataaggagtgcaatactgcacgctcttctgtacttgtgataaatcaaaactctaatgatgctattaaaatgggttttcttttggccctggtaagctggaaagcattgggaggtggggaggatagatttcacttggaaatacctgaagctaaaaagtggtggctttttcttctttcttctaaatgtactccttgctctaattaagcgatgtgatcactgtcccaacactgacataccccaggatgaaacacactttctattcaagtagcctttttttcccttgccttcttccatgagacttgctgaaattgtcatgttatttctttccagaatttattggagcattaggcaaaagcctcttgggagtataaataatgatgattataaagaacagtcagtttaccaaggaaggccattatctttgacttgcaaagcttttacagccaaacattgtttgcttacagttctttaatacaaatgaagaccttaatggtaagaagagtcctattactactccctttgtacatggaggtcatcccaataaagaaaggacgatgtcactttgctcaggcattaacagcttgtttttcaggacaggcattatatacggtctatgaaggccttggatggtgttttttcttcttcttctttttttttttttttttttttgagacggagtcttgctctgtggcctgggctggagtgcagtggcgctatcttggctcactgcaacaacctctacctcccaggttcaagcgcttctcttgcctcagcctcccaagtggctgggactacaggcgtgcgccacgacacccacctaaattttgtgttttttgtagagacagggtttcaccatgttagtttgccaggatggtctccatctcttgacgttgtgatctgcccgccttggcctcccaaagtgctgggattacaggcgtgagccac

SEQ ID NO: 119702 - DNA, 1035 bp, Homo sapiens
ttcagttcatgcctctgaagtgatgtgctctgttcagcagagtcctatgctgtgccctccccttctggggctctagcttgccctttggagggtgtgtgtttgtgtgtgtgtgtgtgtgtgtgtgtgtgtgtgtgtgtgtgtgtggtaggggtcctcattttccttactgcctgtcactctccatgtcactgtgggtggccaagagtggtctcatttcctctacccctttgcaaaccgtaaacactggtcacacgtgcttgtgctggaatcatatgctccagtggcttgatggtgggacttcagatttcctgcattaccttaggttttgactttcttgtggttacctctgtcagcattctttggcagaggactatggggagtagaatgacctagaaattatccctgattttcttctccttccaagcctgctgaaccaaaaatggtttttatttttctttgaaaaactacccttcgtaatgaactccattaagaaataggagttcttcaaaggaggagggatgttactgtattcttttgatttctctgaatttactagatttattttccccaagttggtgtgaaattgttgagattggtccttaactagagtcagacaatttttttttttttttttttgagacagagtctcactttgtcgcccaggctggagtgcagtggcgcgatctccactcattgcaacctccgccttccggattcaagtgattctcctgcctcagcctccagagtagccaggattacaggcacccgccaccacgcctggctaatttttgtatttttagtagatacagggtttcaccttgttggccaggctggtctcaaactcctgacctcaggtgatctgcctgcctcggcctcccaaaatgctgggattacaggcgtgagccaccgtgcccggctggcaatttttattttttagatacagggtgtcgctgtgttacccaaactggagtgccgtgacgtgaacgcagctcactgcagccttaaccttcctgggctcaagcgatcctcccacct

SEQ ID NO: 119703 - DNA, 5364 bp, Homo sapiens
ctgtaaggcaacataagagaagtggatggtggggactgcaaatgtcatgtggcctagtggtattgagaagcattttgtgaagcagagagtgcgtgttccgattctgtaggagcacatgtcttggtgtgggtgtctttgccttcctagaacttcctgatgataagaagcctgtaaacaccagtgtgtccgtcagtatttggaatcttgtttattacatagtcctcaggttcattgtcaaaaaattctttactgatggtattaatcagtatttggaatcttatttatttcatagtgctcaaggtcattgtcaaaaaattctttactaatggtattaatcatgcttctcacactccagtttttctggtatggttttctgttccaaattgactcctgtgctcaggtcattagtttggcttactaacaggagccctgacagctatattcaatatttttctctgcagtggccaagtagccaagaatttactagtttagacacccacctcagtttagaaggtaggtgtgagtgtgtgtgtgtgtgtgtgtgtgtgtgtgagagagagagagatagagagagagagagaatatctaagaaggagttaatattttaaactttgcattgtttaactggaaatctgtgttctgccgggccgcttttatgtggtgtacctataacctatacacatacttgtgcctttcaaaggctaacgccacatccctcctactaaaattgcttattagagctaattttaagaattgagttagaactgccctataatgtaatgcagaatatttcccaataatgcctaggttaacaatgatagtcttgctgtattgtgcaaaaaaggcttctgttcagacccagctgggtttcaggcttaattcattgctctatggtgggatcaccacagctgctgtggggcctttacaaatgcaaaaaagctgtcagtgtttgtttcatcagctgcataagtgatgaggccaagttgaggaatccattccagtgcgcagtgtgcaggctgtagctattattgtttacagaattagtgtgttggagctttaaaatagttggcacatcgtctgccctttaaaagcacaagactaaggaatgagaccagttggttgtccttgtaatgttggccggatccagcccagcccttgtcttttaacagctactgctccgggctgtgctgtgggacttgactactctttggaggaagtgggggtgcttgctgagttcttgtctctgtagttctgcatcccaaacttaggtttgcattaaaaaaaaaaaaacaaaaaaaaaccacgcagtcatttagagttccataagtgtaattgagatttaaagccttaatcatcctcccagccccaaataggtataggactgtcagctgggatttcaaatatctgtgcagtaacattccagatttggctctgtgagatttattttgtgaagtgatactgctttgggacttgccctcatctctccccatgggtacagaagttaaggctacttcttggctggcagccaagaagccaggaaagccccattggacaggtcactttccaggcaattaaggagtattctgcagggctctccgtgaatgctgtcttaacagtgtaaggtgaccctcttccccagggacctgatgagcccgggcagcatgttcacttgcttttggactgggcaagcaggaatctgggaccagcatcatggtcattcacaggatagtgtgggattgtcccagcccctccctcatttacattcagaccccttctccactcaggggtctctgcctcatggaaactggagggcatgggcggtggctggtctgttacggttttgaaagtggagctcatcaggtctcctagccaacgggggtgaataattgtgcttccttcctcccagctggaaaaggtcccaaagtgctctctcatattcataaaagagatggcacgaggcttagtgtctccaaattaaaggtcaatactgatcagctttctctcaaagaactgtcacatatgctctcctggagacatttgtgtcttcccattttaccttaggaagtctctggagcccaggaagacaagtgtgtccgatgaatctcctgtggtgttggtactgattaagcagagtttggggatccttgtatggcccctcttttaaagagctttttagcacggtctctgccaagtatattttaactattagttacaatgatcttccaacagagagcaaacaacataagtaatagtttagagttttacttcttaacgtcttcccaaattccttctctttctctttcttacctgcaccctggaatagtagtaatgaaaaggaaaatagcaaaccgtgagctccatatcctctcccgctgggggaaggactaatttgcagggcctcataaggaaacagcagtttcatggtcattgttgtcagcctagcagcgcttggttgcacttccgttgctcaacgtgtttctcctggctagggtgtttgtagtatattttgagttttaggaatctttcatcaaagtttcttctgcttttttgtcattttaaggcaaaacattttcttttggtagcttgaaagttctacactctcaatgtttaaacattttttgggggcagggtgagaaacagctttgtggacgcatatctgattgtgtgtgtttgttatttcatgtcagagtcatctcatgaccccaggagacctcgccagtggcctgcctcctagaaaatgcactgctgtaataacaatcagggcgccagctgaccactggttgtccctcagccacttattagctgcatgtccaggaggatcaccaggccgtggtttaaattctcagtgttctccattgtaatgtggggtgcacgtgcgtccctgagtggagattaggtgctctaataggcacaactgtgcccctttcattgtaggcattctcttccacctgtatattagtattgcttctagctgcgtgatcgagggtttgggttaatgctgacatattgcaacttactggatggcaaacagttaagttgtcttctttggctgtggggagagatggtgaattcaacactctgaaactctgaacacagtgtccaaagagaccctgggcttcctggagtgttattctcttactctcctaaactattctcccactcccatgaaaaagaaaatcttaaagcggcttatcagtatctgacataagacagagtgaggcctttccttttatctacatagagatagctcaaagatctgcttgaggggcagcaaaaggcatgtcagcaaccaccaggaaaggatcctgaagcctaaccaactggttataaacagcagtaggtgcccaggagggaaccgataccttctgcaagagcatcagttgtgaaatggcctaggtacaaggatgttcttagaatcaggtttcaaattatagtaacatgtagacagactctgaatgctctgggaatggagtaagctggttctagtgaattttctggttgactgtttcaagccatggcattaactccttatgaaggatattttttggctgtcctgtcttcagaagtccggtgtgacgcgcgaactcaatggttgcgttcccgaggaccttatggagtgcttcctgtctgtctgccagtgctttgttactgtgcacctctgtagatatgcagtagggggtttttgggtggtgtgcatgctgatccccagagggtttatattttacctgcactcctgaggatgtgtttgtgttgcttggggccctgagaaaaaactgcattcagcggaggatttagtaagaagaaagttggttccatgaagtgtacatcagcagcccccgaggatgctgtggggttgcaactcctaaggcttaactgcggcggggatcggttaatagtatggacaaccccacaccccagaacaggggataggtgatggacgacagtgggacaccatacctaatgtgcatgcctgcttcctagaaattgtgatagtgtggtgactctttccttctctgaaaagaccaaaccccatcacttaatatggaaatttaaaaccaaacctccaaacccttctgacagcatttttgaccaaattggcttttcgtaagggtagagctagattttccgaagagctttaaaaacacagcctagaagcttatctttgtgaacttttgctgttgtcaacagtggatatcttgctgctgctaatagaaaacaaaaaagttcatttgccaaaatgcttgtcatttcctcctgaggagtgcagcttaacgccaggacttcatttagtcagagggaaatggttgctacctccctgttaagcttctttccattatccagttatggcagaatgagtgttggggcggcctggggagatgggggtaaaataaaggaacagctaagaagtggttctgcagaatgtgtacttatatccgaaagcctggatggaaaggacggtggctttggaaggggtgtaaaatgggagggggtggcaatcgctgaagcatgacaagcctccgaaggcctctgggacttgaacacaaaaaagggagctttttgcagctctttcacatgcacacgtctccctctgccccatccatcctcccctgctgttttgtaaatctcccagttggaaatttttaacatgggagagcttcttcctgtgcttcagttggcagaatgctcacacgcagctgcaaagaatttgcttttccttttcacagcatctctcatttaaaagcattagtgagactacagaacaaaataaaaacttcaggatttttcagaagtggaagccaagtttaattaaagtcaaggaagttcggggctctaactcttttgttaaacctcttaaagtcaggcgtgtgcgtgtgcccatggcaggcaaggtaggaaatgccagtgcctgtttctcgttaggaaatttaaaggcctacttgtctggtgtgtgcttggggaatgtcctagaatttatcaaaagatgtgctgaaccatcatgtctttggtggcctcaaaatgcttgccagtggtgaggtagttgcccctttcttgagggaggaggaaaaccgttaaatagctttctgtctcctcccaggcctctgtaaaacctcctaatctgagtgccctgttccctgtgctccacccttagtccctagaccaggccactgggctgtgagcattcttgttggggggggcggaaagaagtttctgactcgataactgcctcctaaagttggatttttaatctttcaatagtatttgaaccttcagcattttttacattttattttaagagacagggtctgttgcccaggctggcgtgtggtggtgtgatcacagcttattactgcatccttgaactct

SEQ ID NO: 119704 - DNA, 2100 bp, Homo sapiens
aggaagagctgtttgatctctccttgcaaaatgtttctgggctcaggttcaagagtggagaaaccctcttgaacatggaacagttggctcttggggtcagtagcaaagacaggaatgagctggaaaactttgtcctgacctaaaaggaggttacatagacagggttttggatctttggtgtttccttttttacaaaggccatgtgcacagctgtacttccagaattggaaaatttcctacatacacagcttcttcattagatactgataccggttaattcacagtcacctgtaattggaaacagctgctgtttcccagctgactaggtgttcaagtcagatgctttgaattagctggacttggattattcacattttaattaaagtccatttaccgccccccccgcccccccccccgtcttttgcctcttcaatgaccaggtttttacagtaatacatttgaaattacatgagtatcccagtagaaaggcataatgtaagttcaaggacttgcagttgattatggcgttacattattaaatagtgaatttaacagcattgcaattcccttttctcacccactgaaccttgcctctctagtggggaaaatttcattccatttaggaaagttgagacttttgtcccctttccttctcttgggacagagttgtattaacctaattgcttgtgtcactgctacagggaaggtactgcgtgaagtgggacaagcaattttctggtactttttgtctaatggggtttgcaaattaagccatgactagtggggatattttctcagaagggggaaaaaagttaacaattgctatggtgtggctgttgtccagtgcttctgtattgatgtagaatgttcactgagcagcttgtaggagaaaaagactgccttaatttttgggcaaaaagttagaagggaaattgctttgcatttttctctccataatgttaatgaggaaaagaggcaatgctggaggaaaggagataaatggatgtttcctcccttccctatttaagctgcctaagttgactaaagttcgacttgataaatgtcctagttaatttaattttgtgttagtgcctctcctcccctcgagtgtccagtccattttcagctgacttgcagaaaaaccaggttaatgcaaatccatcagattctgcatgcctgttaaaatgcttaagcattctacatggcgtgggagacatgatgcttgcctaaaagggtccctggagagataaagtatattcctgccagtgcatttagggagttatacatatataactgtctcatatgatttggcattgtcacatactgagcactgggagagccaaaggaggtctggggttggtaggctgtttggaggtaaaagtttactactggaatagtccttccagctcagccgcttccatttccacattgcctcagaagttgcctaaaggatgtgcatcttgttggcagccccatgactttctagaagccctgttgtgtctgtttagtgctttctacattaggtcggagatcttttttcattaggtcagagatactggactcctttttgttatggaaataacagtctcttggggttctctggaatgagccagggggtcctgttggcctggtccttggaggagaggtccaggctgttgctttcagtatccatgccacctagaatttccagtgactgttgagtcattacattgctatggtagtttcttaggaataggccggtacaatttgattgtgtttttggaccttcccccaagttacaaggccaccagcactcagactgtgggtataccatatggaccagggaacacattggacaaggcgaaagcttgttaccatgaagttcgttagaagatgagactccattcaaattttcagttcttcatgaatgagttcttagtaaaagtgctttgttgatttttttccatggtagtaactaccatgttttgagtgccttgttaagtaacataagtacataatattctcacacacttttgcaaagcagaatctattattttatttttacagatgagcagatagggctttggagagagaagtggcctgaagtagcacgcagtgtgg

SEQ ID NO: 119705 - DNA, 2527 bp, Homo sapiens
aggcaatcagtaagtattggttgttatcctaattttgcattccatattaacttgcagatcatctggatgaatttgattaaatccccttccctcactgactttatatttcgggaaatttcatgtctagggaagttgaaggaatagcatgaacatctggggcacttaccacctagactgaaaaattaacacctggtcgtatgtatgtatattacccattgtctactttcttctgtcaaatccgtgactttggaaattttgaaatagtgctcttggttatccattaaaaaagggtaaaataaacatgctgttgctcctgctgcagcacttcagtagtaataaaaaaaaacttcagtgacttgggtttttttctgccaaagtaaatgttggctctctttcagatgtagtaatgttgcttctctaaattcgttcgagttaaactaaagcagggccaagttgagaaattagtttctcggttttttcccttccaatttagaaaaaaattaagttttggatattcttgttcctgtaattttcttccgtgttccttcctcctcctgcattaaaaaagatcataaagattcagctaagatgtcagtgaaaggaacaaagatccagccttttacattctttatgtggagttattgttggtagtaatcttaaaatagggtgtttgaatccatgttgaggcagttaattcagtagtacagtttcttgttaaccacaaaatgctaagtaaaggtaaagccttatccccacaccctgctttttttttttttttttgagatggagtctcgctctgttgcccaggctggagtgcagcgatgtgatctaggctcactgcagcctctgcctcctgagttcaagcagttctcctgcctcaacctcccgaatagctgggattacaagaatgagccaccacccctggctaatttttgtattttcattacagatggggtttcaccatgttggccaggctggtcttgaattcctgacctcaggttatcctcctgccttgacctcccaaagtgctggaattacaggcatgagccaccgtgcctggccagccccttaacatgtgatttttgcctttttgtgatttttgtcttatgctgcaaaatacgcttgcgttattactagctaggaaatccaagcaggtatcacaccgtgccgtcatatgagtgataactgggagttttcatgcattagctggtatttgacaggtttgcaggtatgttagaaagtttcagtgtgtcagtgtttggtgtgtataagcgtgggagagcccaatacgcatgtgagatgcagcttccagtcagtgcgcatataccacttggagggcatgctggttgcaacccttttattctaataaggaactggtttggctaggtgaactacgaagtcattttggatttgacccacactggctgtgtctcactctttactgcagtttaattcatgtgatgctattaagataataactttgtccaagagcaaaagaacgtgaatacattgtggtatgtgtgaattcacaaacaacattcaagatcagtttcagaaatgttcagagcaaaatctgaagtccccttatctcctattgtactgccttcctcaaaagtaagccatcagtggtttgcacatccttctagcctttctgtgtatttacctgcatacatgcatgtttatgtaaacatacagatgggttccccgcgtggggggccccccacttcacttggggcctatttatataaatggaatgtaaggttatggcctgtgatttagctttttctcacgtaacaatatctcaaagatctttccatgccattctatttcatgctgcaagtagctgataggactagtgtactgtagtttatttagccacttccttctgatgactttcttcctagaagagtccttggcatttaggaggcactcagtagacctttaggttgttcatgctgttttgtttgctttaaaacatttctgtccatacacctttcaaacatatggtaatattagcatatgattgaattggaagtgcagggtccagggtatgtgctctgtgtgtgtgtgtgtgtgtgtgtgtgtgtgtgtgtgtgtgtttgagacagagtcttgctcagttgccaaggctggagtgcagtggcatgatctcagcgaactgtaacctttgcctcccgagttcagaccattcttgtgtggtagctgggactacaggtgtgcagtgcaccatcatgctcgaccaatttctgtattttaagtagagaccaggtttcaccatgttgcccaggctggtcttgaactcctggtctcaggtgatccgcccaccttggcatcccaaagtgctgagattacaggcgtgagccacagcgcctgtcatgtgctgttttagagtaggaagaaattttttccttccgaaaaccttcagccaatctacacacccactaacagcatatgagagtctttattttcctcccttcttgccaacacttagcattatacagcttctttggtttttgctaataaatat

SEQ ID NO: 119706 - DNA, 1049 bp, Homo sapiens
ttttttttttgaaaggaagtcttgctcttgttctccagactggagtgcaatggcacgatcttggctcactgcaacctccgcctctggggttcaagcgattctcttgcctcagcctcctgagtagctgggattacaggcacctgccaccacgcccagctaatttttgtattttttgtttgtttgttttagtagagactgggttttaccatgttggccaggctggtctccaactgctaacctcaggtgatccgcctgcctcggcctcctaaagtgctgggattacaggcgtgagccaccgcgcccagccgtcagtgtactttaagtatattttcattatgcaattaattacaatatgggaagtcagttaactaggttattactttgtgaagtaaagttaaacatctggtcatagaatgacttaaaaatgacaaataaggaaaaaaatacatatatatatatataacatgaggtaaagttaaacccagatagagggtatcattgctttcatgcgtggactttgaaattgctttttattcctgagaccttttctagttctctaacatgttccccaataaacgaggttagaggataacaattctagaaaagaaggcagcatctcgtaagtcattccacattgcatacagtaagtgtgatttctagccatgcatccttttaaaaaaattcatcttgcaataaaagaatttggagagcctttggaatcttgtataaaggaattttgctggcataaaacatgcattatgtatcacacttgtattttaaagcccacttgatgaaagagcagcaggttgacagtggttgactcaacaacctgcaatttctgatgtataactatgagcagtgggattattctttgtaacttggttatatgaagtttgaagtttttcctttcagtgcagtgtttcctttttcttgtttgtttgtttcctgagtctcactctgtctcccaggctggagtgcagtagcgccatctacaagccaattgcttgactctcctttgggtgagtggctaagtaagttaacaagtacaa

SEQ ID NO: 119707 - DNA, 2060 bp, Homo sapiens
atcaggactcctgtgctttgtgtcagaaatagatgccatccctttttctgtaggaaggaatttatagtttggagaaggtagagttggatttggaacctcagttggcctgcgttgagaactgctggtttcctgctcagttaggccagttagggggaaataagaagactgccaaaacctgtggcttgtgtctcagttccctttctccagccactgcaccagagtttgggcgccacacagatggttctcagtggcagttcgcagagcggtcctcatttggccggaagctactcaggcagcctctgtttcctcacttcagcggggtgggcttgggtgtgggtgaaagagataagatatttagcagtgagtcatttttttctggtagtttgacctggttgctttgaggatgattgcttcatcctttctcgtactttacccactgtcccttaggaaaatgggggtcctgtccggccagtgttgttggtatctcaggccctgtggatgtgggattctgcatatctcttgaactgcctgtttcctcccaacctccaaaaggttataatgtccccattcttctatgagtgaccaacatggaatgccatgtatgctcaaaatatgatttctcattggcccagtgtttgtaagaagaaacctctgatttagggtgtgcttctttatctcctgcatttggggttgggataggcagaaatctgttggaaaaattttccgcagtgaaggttggatgggtgttctgtcctgtttttaattctttgaccacaggaccttttctcttgtaaacacttaaaaacctctaaggctaatgagcaaagcctggtgtgatgtatattttaaggaaaggtgtataacaatacatgtgtacaaggagggaagcggagaagggcatgggagtagaagggatcattcccctgcaattggataagtgacatttaagctgcattccatgtaagcttttgggcctggaaaccttcccctcccatcttcctgagatactgtgcttgttgtgagctcattcagagtaataaactgtacccgtaattcatgagcttgcaaggccttctttaaccgcttgcagccaggagactaatgacaacatttaaaattatagattgctcattttggagtctatctgtttcgagttatgaatgaaatttcttagccacttactggacagtagaacctgtttgcaaagacccagtgtcctcatgttgtgtgtgtgtgtgtgtgtgtgtgtgtgtgtgtgtgtgtgagagagagagagagagagagagagagacagagaggaggggtggagaaagggagcaagcagtcccccctttatgtatgattcttagaggtgttacaggatgcagtaaccatgaggactctggtgttgcacagaagttgaattcttacttggaaagtttaggtctgggacggaagggtgacagaaaaaggttaaggttacccacactctatcagtggtagttatcaatgagtgactgttggtagacagcaagcaaatgatactggggtaagaaggttctggatatgaaagaactaggtaagattgcaaatgtagtctctctataaaccagatactcaaaagcaaatgtttaaagcagcgtataagtaactgggttgtccataactatttcagaaatggctacaattactcaaatcccaggtctttaaaaattccaaaggaacagcaagggccacataaagaggaaaatctgcaaaatggtagggtggtacctgagttagcaaatgggaacttgagctcttctttactataaaatttttttcttttttcacagagtgccgagagtattagcagacctttaatgcatttggaagtgacaccatattaatcatgtggatttcactttctgtcatgagttctatacattttggcttgaaatcagtcatcagtgtgatattcagaggtttactacatctcattcatacctttattttttttctagccctctcacccgggtttcatctgagtgactagaagtggcgtttatttattgactgtggaggttaacttacactgatgg

SEQ ID NO: 119708 - DNA, 1941 bp, Homo sapiens
agggtgcagggaataccctcaccccttagcagcttctagtcctcttccttaatcctttacctgttttctcattattatactagtgaattttgtttaattcctttgtgctggtttggaacaagtgccatgttaaatatcatttctatgatggagtgcattctaggttttaaactgcaggtttataaatgaacttttagaaggtgggcgatttgaaagtgattctgtgtggaaatagaagccagaggggccagattcaaaggccatctggatctggagcctcatttattgtcaccaagaactggatgtttgtgctgtttgtcatttccctcaactcagcctctctaaggataatggcttttcacagaagcctaaatgtaatgctttcttcattcccttacttccctttaaaatcttgcatataaacattgatagaaatccagaaagagagagtcctgttttctcccctgtggttaaatagtgacggttgatctactgaataccttccttccttaaaaacaacgagattaggtaattacagcaaatgtggtcattagcctcatctgctcttattatcttattatgtatttgttactgtgagagccaaaagatgtgaggataagccagactctccctactttgaaaagacaggaattgtaaaaacacgtggtcactaatggaatctgcagtttgatccaccatgacttttgcttactggtgaaattggttttcttatattttgtcaacagtaaataggctgtgtgcttggataatagttaggctaatataggaaaatttaatcatggcttttctcaagtttaatttgaaagagtgcagtggggaagtcccctgcagggtggaaatcgtagtagttgaacatgagtgacctttttggttgactgactgcccttcctgtgaagctggcccaatatctttcccctgtcaggattacttcctgtctcagcctgaatagtttaagtagctgcaagattgatgttggatatctctgggaaaattccattctcttgaatttagctgacagagtacctctttcatttctttcattgtgttccatttttgacctcggaaggaactaaacattatttctcatccaacagactcattgttcatcatctttgggcttaaaaatcctgtgttccctcagttatttcttttatgaaggtttcaggtgcctcattattctctatgtggagactgtgttagtgtctttaaaaatcgacattccatgttttaagcatctagtatacattataagtagtgtgatattttgcatccatttcactcagccaccctgcttctaggaatttggccacaaggatgtgtagtaagtattttactgtgtatcccagtgaaaaatggaaaccaataggggattggttaaattatggaacgtctgttccgtgcagtcattaaaatgaaatggtagcaagaatgttgactgacataaaataagtgaaaaaagcaagtgagaaaacagtatttacagtttaatttttttgtcttatcttggaaaatttagtaaatatatgtatacatataatatataaagcatacatatataaacgtgtgtgtgtgtgtgtatatatatatatgtatgctttgacaaatgaagtggtggtgtaggcacaggtgggaggggcaactaatccacactgagggatgacagaaggcttgaaggacagggattagccaggtgaagatgggattggccagtagtgtgttccaaagtgaaagtggaaagcccagaggtgagaagtggcttggaagagtttaggaagagggatggatgctcaggagataaggcttatctatattttctccaggaaacgtgtattactctgtaataaacaaaaaaaatggtacctagaaagcttcttcttccaaagaagaaagtcaaggaagcagcaggaaaacagattgctt

SEQ ID NO: 119709 - DNA, 1135 bp, Homo sapiens
tgtggattttggactcttaatgagattaaggccagggaggctttcccaggttggctggatgggctggggctgggtgtctctggtgaaacagatgaattccagataggtaatttaatttccagaggtgccgcacaaatgcctttgcctcctgctactggttagagcaaaacaagcatgtgatttatgtaaaaatacatgaatattagtttttatcaaaaccctgcagaagaaaaacagtagaaaaaatgatacttcctgccatagcctctttgtggaatgaaattaagaaaatcaatattctttacaaatgactagtcacagtggaactggtctgttgaacctaccctttgtagatagcattaatacatcaccctctcccacattactccaaccataacagaaatagtgatttacataggaaaatgcgagctgaattaaacaaggatggccctgaattctgctgtagggattcttaagatggcacaagctaggctgtgaatgccttggcctcccctcttctcccctgtttctgggtcatgctcccctctggatttcttgctgggtagttctggagggaaggggatgcccttctacataagcatctgcaggtgcagagatgggatgggcctaagtgttctgagatcttccaggagatgggatttcaatctccagaattcccatccccgcttggctctttggtggcccagttctggaagttgagatttagaccaagattatagtcttaaaataaatcttggatgtgactcctgccaggatgacttgtaaataatttcgtgccagaaaccgagctgactttggtttgtgggctggaggtggctgattccaactctgggaattcattctaatttttggtgccctgttcaccctgagttgtcttctcacggctgcctgcccagtccctgtgtgggaatgggaaccgtcatagagtgaatatgaggacttcacatcctttgggatgcgggtattttagttccagggctaacatggcacgttggcagtgagatagttgctataataattctctaataagctgttggtctcagagacccttccgcgtggcgtatcaatggggcttgtgacagtaggagttgggatcttagaggattcatatcac

SEQ ID NO: 119710 - DNA, 1542 bp, Homo sapiens
tccttcctgttatggttcagtagtctcctctctttctgtctttctgtgttcttcctgtgactcactcattgtctgtgtttctttttttccctgtaagcctggcctggtcctttcgtgattccctgtagtctttttctcaagtgggcattaaagcaaccttatctttcacacacactgaaagaacctagtaactgagagatgatccagccagattctgcccttacctttacccctcaccaccccactaggggacaaaacaagcaaatatactgactgacccaagccttgttgttccgacgaaaacactggcgttcagcatctttcccgcaaaccgagctgcagcctccagtttcagaatagtgccttccataaaatctgtgggagttttccgtttatgttgcttgtttttaaacaatcttcttggaaaagaattcagtgctgttaatggattgccgtcggagctttttttacattacacctgtcctctgcttcctgatctccttttgatggttagggagaatatgttgacttagaatagcaaggagccatggcaccccaaggaaacaggaaaaatctcagttttcatggatgagaaagtcccattctattgtctgtgtgtgcctgagtatgtacactgtaacatctcatttttagttgtatgaagaaagcgctgtggctgagaaccagtgtttggaggttggggtagggtagcctgggttcatagtcactacatatcccagctccccaagccctaggaggtactgcacaagcagtacagacagggtcttgcatttgtgcctcttcactggtgacttcccattttgaagagtgccagcttttctgggaagtctgctgccaacactgagccgagccagggttgctgttcacatctacgcaggctgttggtgccgcggcagcatgctgtccttgagagcactgtggaatttgcagtgtgccgtacagattcagaaatggtgtatgtttcttgtggcattagtgttttgacttgcaaatctggaaaagaacaggaagtcttggtggaaacactctctggctgatgtatagaaacctgtggagttaactgcattttaagcaccaattattagaaaatgaatttcttcttacttggggagatttctttcagatcttaaatacatttgtcatctaaacctcttctcctaggggcagatgatccctgccttgggcctaggagagtagacattggtaattacctttggcctgtgtctccccaaatatccttataccttctgctggcccatggctgtctagaagccctcatggaggtgctgcttttgtttttatctcttcatttggggagaggatactgcatctggacccaaggcccaaggtgtcctgatgttgagtccttccaattctgggtagccatgaacagtgatgctgttcatagataaggtcaaagggacgggcttaaggttaagctcagttagtggatggcagaggctgtattcaaattaatcttgatccactctgcaggttgctgtggctcctgtttcccccact

SEQ ID NO: 119711 - DNA, 1299 bp, Homo sapiens
tcttgaactgaaagtgaggttgaacttcatccgtaaaggtgagttttccccaaaggtacctgaatgcttgccgtgtaactgatgggtccatagtccactgccagaaggtaccctcttgcgtctcggaggtgctggttctgaagtatcttttttgagttttagttggagtttctcttgttgagaattttgaatctcagaaaatgccatggctgcgtgggtgtttgttttagctccacacccttcatcttcagggtggatgcacccttgggtggcgttgcacacagctggcgcgtggagagccgatccctccagggtttgtttctttaataccagacccgctcccacaaaactggtgtatttaggcgtcccctcttctcctgtgtttgttgctggccagcagtgcctgcaagttccagcagatgaggtgaggatggacagtgaggtagaggctagtctgtttgcctgggttcactgaagttgctaggttttgagtttgctccagattagtgaatatatcagctgtgagaataagagtgattaaagcatggtggcgcatgcctgtagtcccagctactggggaggctgaggcaggagaatcacttgaaacctggaggcggaggttacagtgaatcgagaaccctgccactgcactgcagcctgggttacaagagcaaaactccgtttccaaaaaaaaaaagattaaacaaataggacttctccatttgtatttaaacttcaaagagaaagctgaactccaaggcccagctggaggacacgtggatccagccagcatgttagatgtaggcaattggagaaggacagggagacagcagtgaggtgcagggggatgaggcacatagttgtctacatgaaacaggcagatctttgttttcgtatacctagaatagtttccatgtccagcaagaacttccaggtttttgttgttttttgtttatgctttggtggtggtggtggttgctaccacctggagaaaagctgcctttgcagccccacaactgtgcagttgctgtgagtgagcaggctgggaaccacatgctcttgttctgacattcactggaggcacccccctcccctttccttacaaggcatctcagaggattgtcatttgaggcaggccggattcactggtgtgactgtttcaggactggcttgtctcattaaaaaacattttttggatcagaaacaatgaggggtgggaaaggcaacaaaagcctcttgagattcccggattgctcaggatgttataaacagtaagtgctgcttttgatcttggagggt

SEQ ID NO: 119712 - DNA, 2656 bp, Homo sapiens
aagcgattcttgtgccccagtctcctgagtagctgggagcacaagtgtgcgcaactgtgccctgccaatttttttgtgtatgtgtttttagtagagacggggtttcaccatgtttgccaggctggtcttgaactcctgtcctcaagtgatccacctgcttcatggcaggtgagccactgcatccggtctgtccatagtttctggaacacaattagaagtgagatctgtgtttgagggagaagcaggaaaagtttaacctgaggatggccctttaactttatatgatgaaaaactacctaatcaatggttgcagattatgtaaattaaaatagtggtgggtacttcttaaacaaattatgcaaatttgatgcagtcatcaaggcttcttgcttcactgcatcatttaccttttgatttcagagaagttcagccccttgactctttccttattcgaactggagctaagcactgagatatttcagccatacgcttgttagggagtgtatctatgtaaatacaagtaattttaagtagacaaggctatattagtagaacctgattacttttatcttgctggtttcttccattgttttattagtatgtttcaaatatttaccatggtgagccgatcagcttctgatctatgtggatcagtatccaacaaaaactgactagaagagactgtggttgtggatgcttgtgaagagaatggaaaatgtattacagtgttaatgtcctctacaattccagtgacttagtattcagttaagacacaggtaaggtgttggttataagccggtaattcaagttaggttaactctgtttcttttccatcataaccagttgaaaagaggaagactttacatttaattaggtagttcgtagaatgtaagtgtgagaatagaaaaatatatttaagaaactcagtcattgttctttacacaaattagagtggattggtagctttgggggatttaagtgggttgaagtagaaggtgaaatgatgactgttaattatcaaaaaccatacataaatgtgatttgtagtttattttgaaacctactgtagtttaaattcatctggtattcattacaatgcagttcttaaagaagatgaaactgtatagctaatgacccaaatgtttccttcttatctaatcagggatccttctttagtagctagattagatgttattcagaaaggataatataggaaataattactgtatttcatttgtggagttaagcatatggcctctaattcattttcatatgcaatatatgtaaattagagaccaatctatattattttcagccatggccatgcaagaatatgattcattctctctctctctctgtgtgtgtgtgtgtgtgtgtgtgtgtgtgttagttaaacttgcatgtgaagtatgacttgcagtttgtagtaattttgtgatgctggtacattttctcatcttgtttgggagttttatgaaatgttagaattcaaatttggggatgggaggcggtgtatcatatgaatgatttcattattacaagtagtattttgcagtagttagtatgttgtgagcagattgaaaatgccaggaacttaaaagaatttttggaagaaaataactagatctgtgcaagaattcaacagtctgattactcagtgttatcaattacaaaacacctggccctgtgccatgatatatatactatatatcagtataatcagtataatcatacaccttcttgtggggataaagggaatgaagggaatgtcatttttttacatcacaaagaaaaatcatgaaattattaatagttgtgagttgtccactctgtaactaaggctaactatgaactaatgaactcacatgtagtattaattacggcacatatttcattaatgggaacctgcaattcaaattatgtttgagcaggaaatatttaacaattttgtaaacctttttgattgggccttgaaacatggtttgtagctttttattacttctgctctgtttcttaaatgtgggtggcagtgaaatcaagatctctattcagaaccaaagactgactgtcagggggtttatctacttcgtaacttgtcattagaaaacatgatttccttcagcttctcctcgtatttacaagccaattgcttgactcttctttgggtcagtggctaagtaagttaacaagaacaaacaacagaaatgctttctttgaagatatgagacttcaataatagagtgtgagttagaatagcaatctaattttataattggaagaattcttgtttttttttttttttttttttttttttgagatggagtctcactttgtcgcccaggttggagtgcagcggtgtgatctcggctcactgcaaacttcgccttccgggttcaagcaattctcctgccttagcctcccaagtagctgggattacactgcccagcactacgcccagctaattttttgtatttttactagagacggggtttcaccatgttggccaggctggcctcaaactcctgacttcgttgttcgcctgcctcccaaagtgctgtaattacaggcatgagctaccgcgcccggcctggaagaagtattagatttagtgtctagtggttaatgggagaatgggaaatctgcatagctcctgttt

SEQ ID NO: 119713 - DNA, 1394 bp, Homo sapiens
aacacataattgtaatttcaaatatccaaacaggcatgtagaatcatagggtcatttgttgaagcttagttttcaaggagcagtaagagtgaggaaaaggtgcacaggcttctgtgcttctgattctgagacttggttagagggcacttgccaggcatggtgacacactcctgtagtcctagctacgcaagccatattcactattatcactctctggaccaattattgatttgcaagttcctgtgaaatgttttatcacccagtgtgttttgtctgtgtacaggaagcactggatacactggctaggtgtgtgcttttaagtaacattcttctctgattcctttccttcaaagtgggagatactggtagcatctacctaccctgcaaggatttaatgagttttaatgacatgagaaatgcttagatttcagggatttgactaaacccaaatacctgggccatatttttagccaggagccagggaatatttgcactaagccactggctgacccaaaacttctctctttaagtcatttagccaaacagcaaattagggagccagcagctcattttgggggtgatgttttgtatgagaagttggtgaaccctgggggtagcagtaggggagatttcagcatagagaagaggggatagttgatttcctaaaccacttccaaattatgtcttcaaacaaaataaaactttccccttgatttccaaattccagaatattaggcataaccataatataaacataacagcatactcttaaaccagagagaaaaattccaagctgttctgaattatctggttcatttgagattggactgtatgcaatttggtcgtagcagcaggctcattctagcaaatgctaaggtagcaaacaccaggactgtaggttacttttcctcacaacattctggttgtaggtttcctgacacattcattctggctgtttttcttttgcactctgtggtacgaaacctcttagctctgtgtgggtggtgggcttttgcttgccaggcaggcaggcacagcctggtttcccaaatgcatttctccctgattgccttctctatccattaagcatatctgaactgtgtaggattagctgtgtcttgttctttccttttctttcttacaatcacaggaatgagccaggtgtgtgtgtgtgactcaccctagcccagcctgggtgtgctacagcaccgggaaatcctgccctcttggcctagcgtcttcatagatatgtggcttggccttctctctttggtgcttttcccttgacagcaaacttgtcgtcttttgtcttgaactttattgctcagagaccaccctactgctgtccttttacttcagatcttcaaattcagtcacatactgaggtactaggg

SEQ ID NO: 119714 - DNA, 1491 bp, Homo sapiens
aggtcagaaacaggatttaggaacccaaagaaataatctttgttgatgcttaaattgaatgaggcagaaacaaatgtctctttaatatggttttttttttttgggggattattttggtatcaccccaagcctgtaattccctccttagtcatcatcttactatcccttgggactctggcctgggattcttctgctttgtggttgtgattaatcctgcaatgagtgagttggggagggatgggcctggggaagtcagctgctgctagcagcaagcaggggtagggtttatagggagagttgacatcctgctgggatctaacagaaaagtttgaagattattgtgctgaaataaactagctcacaattttgctgtttgactcagggcaagctcactgtaaatctcaaggagtactggactgtatgatggcctcttttgctgtccttatccccactggaggatgcacagattagttaatgtctccctttcatgaatgcagcttttatctttaataagcgggttaaaccgcatgcgctctgtctagtctgtgaaggtcagccagccattcggattttatcttcccatttctagactgctgacagagttcttgtgcaaagttaggaatctttgggttttaaaatgttttcttcctttgcccatccatgacatgcccttattcttgaggggaggaaaaagaaggcctgagtctctgttaggttgcaaatattgtctattttttgggagtgatctttgtagaatctgggcagtgacttttgttgttttgtagtcctgatgatttaaaaaacatatctcatatatttctttacatacagctcagagctcaacattgaaatagatgttcagcagattcttgcccccacttaattttcactgggtttctgggtttttactgtgattaaacttgacattcatttaaggaatgagttgtgatgttctctggtcatgacctaaggaaaaggatatatatgtgctctaggagtgaattctggtgagaacgtttgtattctttcctttcctctttgatttcacaagtcaggctgtaactttaaaagaaactataggggctgttccccaggttattcacaaaacgagtctttgtctgctttttcattcaccatctggtatacaaagctaaattggaatcgtgcttgttttaattattttctacttgtgtggccaggaggttatttggtctggtgaggttacattataagcctgcgcactcattaataccaccgaatccacatcctgcgccagcattggaatggttaagttgatccacttgtgtggccagagtttgatacaacacagtggtcacgaccacattaccggaggaagtatggtgtgtgggttttgccctcttcttttttcattttttcttccaataatgttaattgtttcagtgtattttttcttccagtagaaatatgacttaggttggcaatcttagattagtgcctggtgtttattaa

SEQ ID NO: 119715 - DNA, 1099 bp, Homo sapiens
ccttgtaatcacaggggttcctatggaacagtggcttatgtcaccaataggaacatgagccctagagttactttggcagaagtcagatcttagaatgcttccttataattctgtttctataaaaatgttttttctatattgatacgtattttaatgtgaggatgctttttatataccttgaaggagtaaggttttccattcattccctgccactacttttctgatcaccccctcttcatttcaagctagtctggatttgacataatttttacagcagtttttgcatactccttttaccatgtgcttgctccttttgctgttttccattgcgctttggggtaccagctttctgactgacagatgggccaagtcaggtacaggctgttgttaccaaagggcatcttccatcatgttgtttgtttcttcaatactgtaatatttgagagagtgtacaactctagatacagaaggccttttgaaattctacacaaagtcacaataaaacttggggtactgtgggcctggggagattctagttcctgttcaaaactactactgccatttaaagaactggaatataactgcatatcataccacctagactcatgaatattgctattttcattggtttaattttcaaaaattagtggtattaaaccagtggggtatatttaatttcttcatgatgcagattattaaacactcaccagccttactttctctcttgattttataaatggtaattgaaagtccatagattttaggtttgtggaactggaatgggcccccaggggatattcagtccacacccctctttttttttcttttttcctccttcttctttccagagacagtcttgctccttcacccaggctggagtacagtggcttgatttcggctcactgcaacctccgtctcgtggcttcaagcgattctcatgcctcagcctcccaagtagctgggattacaggcatgtgccactatgcccggctaatttttgtatttttagtagagacagggtttcaccgtgttggccaggctggtcttgaactccaggcctcaagcgatctgcccacttcggccacccaaagggctggga

SEQ ID NO: 119716 - DNA, 1450 bp, Homo sapiens
ggtgtttagtactagtactaagttaggaaattattactgaggtgctttgattgaagacgcctttactgagtccttgggaagtaaaatagtgacggttaggcctggagcagtggctcacgcctgtaatcccaacattttgggaggccaagacattttgtggtatccagtgttttgggcgggttacctgaggtcaggagtttgagaccagcctggccagtgtggtgaaaccccatctctactaaaaatacaaaaattagccgggtgtggtgttcatatctgtaatcgcagctacttgggaggctgaggcaggagaagcacttgaactcgggaggtggaggttgcagtgagccgagatcgtgccattgcactccagcctgggcgacaagaacgaaactccgtcaaaaaaaaaaaaaaaaaaaaaaagggaatagctgctttacttcacagtcctagttaaggatttaaaaaaaaaaaaaagctcatgagcatgctcttcaaattttggttttgtgatttctggggttttcccatttaattccagatggaagagtgtcattaagttctcttcaaatgtaaccaaatttagtgtgtattattattgctggtggaatacaatgatggtgaatatcccattaaaaactcctccctagcccctaatcacattgaagttacattaaagagttggatgtgtattgaaagtatgatagtctcttgctataaaattaggctattgtgcagtcaaagaggcctctgctaagtgtggttccattttggtgtatttggagggagaggaagggcagccggtatcctgtcactgtgtcccccaacattgagcagatgttctctgagttaatgttgctcttcagttatctttgacagaagcagggtctggttaagatcagattgtttagactaatgtacattgatcttggcataatgatcacaagactataagccagctagacaagcaagtgctggtggtgagttgttagattaaaaaaacaaagcagttgttttgagaataacttcggtgccctggacttacattacaagacattggttttgttgtatgctacttttagatttacctgggaggaccttttacttaataaatagctccagactattaagctcggtgctgctgatcctgcggagaggaccccgacctgagagttagtgggagccaccctttcagacagacagggcgttgaatgcaaaattctcttgaattttaaggaagtacatgataatctgttttacttgggagtatgtagtgattttttttttttttttttttttttttgtaaatttccaagggtggctgtgaaacttactttcgtggtagtggtggacccttgaagcgtttttggaaagtagatgaaagagggagatgtttactaattctgttatttttattcagtgggtggtgcttgagtgggtataatttcct

SEQ ID NO: 119717 - DNA, 1803 bp, Homo sapiens
taccatatacagttcacccatttaaagtgtacaattctttttttttttttaactgttaggttgtgcaagcatcacaatttaagtccaaaacattcccattcctcagtctctgattgtagaaacaaatgatctatgactatttcttaccatgagtatgcagattatttgatgcacagctttttattttaccttctttatagatttccacccaggaaaaaattttaatcccaggttgtctcttacttgtatgaagttttctgtaataatttcttaattattgtaattctatgaacatcaactgaaatgtaattttattaatagcttattctgtaaaaatgctattaataataataaaaatatcaaaaaacgttttgaaggcattgcattacctgccgttttggattatgatcattcttttgtgtggatagttgaagattttaattttttgacaagctcaattgaattagggaagtaagtttgctgctattgcaaaatcatataatgcatgttaaatatcagttatcagtgtaatttgtttttttaatgcagcagctggtttctaggcttaggaatgatagttggcagattttcctactgctttcctgtgatgtttgttagaagcttctagtatagtttcttcatttctaagcttttgagactgattgtatgctgcttatctatatatgtagataagtttcttgtctttcaaggtcttttcaagaggtgctggagcagatttaggaacgcagcatagtttaatattgttaagcagggatgtgtacctgaatctcttttggaagtacaaaaattcaccaagttggtacctccggctacccaactctgatatggaaacctggggtgatctgctgtcaattacgagttgcacctcagctagagaaccgttgttaatttatttgtcctctaattgaaaatctggagctcgagcttactcattgatcttggtctagttactgtattcccatcctttcctgtgtaattgagaaagagcttttgataggaagtagtatatggaaaagtaattcaacctcttggaattttcaactaaaattcagttcataattaaacatattaatttatttaatattattcgttcccattgctgggaccgaaataagaccataagtgcattttatacattttctagcttttataagtttgcttcctttaaaataccgattttgactttattcctcttagatggaaattttctgagaaagaattccattttcttacgttttcttagagttacatgggcaacattgtagttcagcacagcccttgggttgctgggagtctgttactgggtcattgagccttgggtggaccagaaggctcacactgatgaagccttgggaagggaactgcctgggattgaatctctgctctgctgcttatccaggtttgcaacttgggataagttagcttttctttcatggagtggtgatatatgaaacatacattccgtaagtgttcgtggttttgttgtcgttcagctgtctgtattagaaataatgaattattattcagtgatttttcctgtctgataaaagtctgttgtcagatgtagattggacgcttagaggttcagggtctttcatctagttaaatgcgcattaaagcatctatttggtgaacattacttttgtggcataaaatagtttaaatgtgcttcccaaagatcctggcttccattaagatattcatttattcattaggagagtaattcattttttattacacagtagcttatagcaggtgttagaaactccagttaacactaat

SEQ ID NO: 119718 - DNA, 1161 bp, Homo sapiens
taagaccatgaaagaactccatggacaatgttgaaaagggttttcacattaactgtgtgtgtattaggaagggaaaaatgttttcactgagattcctgaaaccatattgcaacatgagtttccctcttgaccttgcagcttatgttggtctgcttttcaatattaaaagaaaaatgtggatcccatctatgaagtcatagctcatttaggggtgatgtggtagataggtcctggttagttttgaaggacctaattgctatattaggttttattttctaatccaagatggtgactttttgttggaggtgggagatactaaagaaaaatgttccatctggatggaattttgtgggcaggtaagtttttagtgtctccatccacaaccacaacaacattgtgtgccctaattagttacgtgtgtgaagtgggcctaactggagtagccagtgagaatgacttggacgttttcagaagaattatttgcaggttggaaaattctcacttctatttccaggattgttcagtctggaggaacagtacaaattaaagtgcactgttttagaagtgggactggattttggcattggcagctccataattgtagttttggccaaagatcactgatggcttttgactcatcacgcgtgaggagctcctgcaggaatgctgaagaaaaaaggaagggattccatgaagggaagtaaaaaccagagcagaaacaccgagcttcccagttcctctcccccaccaccccttacgctagtgctgcattctatcaaaagacagaaggaaagatgaaggctggggatgctacctccttcccgcaagcaatgccttattctggccttcagcttaatacatcatctcttctagcttgaatccttgcaggtactcttttttggagatgagacggacaccgttgaaatgtatatacaatgacagagtttattctcaggctatgattctgcgtcttttgctaaggatgtcaaatctggatattctcggttcttgtggtcccgtattattggttagatgaggaaagttaacagagatgggttgagtggaagtagctgggcccaccatgtcctggatcttaatgttggataagtctgctgtattgtttgttgaactctgcaagcccagcatctgttttaacacgcg

SEQ ID NO: 119719 - DNA, 1042 bp, Homo sapiens
gaagcccatctcctttttctatttacggtaattactagagagcattttattttggcctctggggcgtgtctgctgtgtttctttgtgtgggcatgtatgttaaaattggaaagtgttttctttgaggtcagggcttttgtaaggtgttctaagaagtttgtcaaaccccaactagctttaaaaaattttttgtttgtgtaatataacctgtttactatttctgcttataagcgtttctatcatcaactttaatgttagtaggaagaaaaactttctcatcttcatatattgactttaattagtgattagtttctggtgatgagatatattgaatcaaagatggtctggtttttccaatatctcctttctgctattattaaataaatgaagaatcacaacagagtttcccgatactggtactaacacactgtttttgtgttgttggtggattaggactgaattacctctgactcagagattcagggttaatgagattttcatcattgagttggggcaaccgaagctttgaatggatgatagcagattgattctgtttcttgaagccagtaggtgctcgttttatgtttcagtgaatgaaaacttgtgtccactgtaacctttttgctttttctgagaatagtgaattctcattttcagagaattactgtcaagaaaaacatgtatcaagccattccgtgtgctctgtttaaacagttacctggtttccttagttacaaaggtttcccttctttctctctacagttagttactaagcttttaacgcgtaccagtcttgatgttaaggagttgtcagaatatagattttttcatgccaggaggctgatttgggagatggcgggactgaattctagagcagccattctgagtttataagatctctggcacaggccataccccaaccagttaagtcaatgtgagggtgaggaagtcattaagtggtttccagggcggccatgcctgaccactagtattctaggagagtgctcccagtgagtgctgcagaagcttgaacacaaaccac

SEQ ID NO: 119720 - DNA, 1042 bp, Homo sapiens
cctctatattaagctgaccagtaaaccagaatgcatggggtgcttggttttgtgggccattccagagtgggccaagaagaggtctgcactgtcaaaccctgactgattctaccaaggggcctgaagtggtttacagaggacaaaggggataatttggattttcagacagtgaggtgctaatgggctattagttgacttgaacatatgattgagaatgaattattggatctagagggtcgggcaggagcatcatgagagattgctggaaatacaggagaaagagtctgaacagatgtaagtggggtaggggaagagtagctggaatcattggtcaacatttagcaaatgggagtgtgacagagttgttacatgtgtaagaccatgtggacatctggactggcactttttcttacagagaacactgcaaagtggctgaggaacgagtggtagcagccactgtggaggaaggatgtctcccctaggacaccagcctctgctgagaatcagaggtgtggctgagccccttgggattagtctctgtggggagtgttttatgaggatagcagtgtgacttctggcactggatgttagacactggcagggcgagtaggggtaaataaatgtcagtgggaacagtgagactgagcttcgttgagtttgtaattgattccagaagtatttattcagctcttgctatatcaggcatgttttaggagctgggatacagtggtgaacaagagtagtgatttccttgccccgtggttaaatgcctaattaaataagacagctattgagaaaatggaaaggaaggtctgtattgggtgtatgtattttgagtttgcttgacctctaatgatagagttgtatctgggctgttttttttttttttttttttttaaagacttgctctgtcacccaggctgtagtgtgcagtggcacgatctctgcacacgatcactgcaagctctgcctcccaggttcatgccattctcctgcctcagcctccagagtagctggtactacaggcgcccgccaccacgcc

SEQ ID NO: 119721 - DNA, 1064 bp, Homo sapiens
ttgtgaacagcactgagtcaactcatctactagatttgtgtcttgcatcagcattgagggagcaggtgacaagtctcaaccagcactgtagattacaaaacacttgtgtgttgtgtgtgttttaagtttgaattttaatgtgtagcatttgaaaccccataatctgggtcatggatttgcttctcctgtatttaaagtacttcataggtgtaatgaagctgcttgtgtcagtaactgaaccttaaatgcgcttcctttcttgtagttttcatctcacatggtttatgttttaattagacattagttgtaggggaataattctctcaactggagcctgaagtcaggatgaaggcaccagcctgcacaggatgcaataaatcgtcatgggaattttacattgaaagctattttggggccttataatttataaactgtgtacatgtaggaaataatagtttataatctcacgtcattgtttgttgtggagattcgaacagtgagaataggaacctggtggtgatgaagagaattctgtctgacagcctttatgaatagactgaggctgctgaagaggtggatttcagcctaataagcattaactcctcctgcagttaacactatcattcagttgcagctagtatattaggagagctttcttgcaaacccaggggagttgctgtaaagattaattcagctatatcatgcttttcatgtgttgtggtgtcaagtcagttgcattttactcaggttggtatttgggttcctccatttttctggtttttaatcatttgattgggaaggtctccagtgacctacacgcagtagcaggttagaaattgtgtttctcttgttaggttggggcaaggtttgctggcttctcttagccttcatgtccgaaccctgaccccgtaccgtggtctgtggatgttttggctgtcttgggagagcggacaggaagactggatgtacctccttcttctagaggcactgcccagcagtcggaaatctcagcctggcaggcttctgtgagtgaaggatgtgaaggagaaggtggaaatcctagt

SEQ ID NO: 119722 - DNA, 1388 bp, Homo sapiens
gaggcagcaacatttttaagagctccgtacatatttctgttgcagtgtacattctggcattgctcactttataaaactcaagtaaaatgatccattatccttctggttgtgggtataacaacacctttttctgaactttgtcaggaatataaaactattactagttgatgaacgtatttgattttggggcgtataaagaagtgagatggttgtgtgttgctttcattctttttaacagcctgtggattcacttttctttgaggcctgttcagaaaggtcattgcccctttaccttatgggtgtaattctgacattgagaactgggtcgtggtcacacagtacgtgttcggaaattcctttaaaataaagtttattttgactctgaatattgccttgctttctattcagtaactcctctcttttcttatgtttcttcaggatgacagtgatgggattccgtggtcagaagaacgggtggtacgtaaagtcctttatttgtctctgaaggagttcaagaattcccagaagaggcagcatgcggaaggcattgctgggagcctgaaaactgtgaatggtgagttgactcttggaatatctcattggaatgtacaatatctctgggcgtggacttgttcctgaattggatgtattctggcagcttgtgcttcctggtctaggcacctaaaggcagtctgtaggctaggtgaatctgcactgcagacatcctgttgggtttatagggttgtttttgtgttcctttatgtaccgcgttatatagtggacaaaatacattagtctgttctgtaggtcctgtcttgctggtttttctatatgtatgtctttccacactggtatgtgagcagaactctttgatgatcttgctgaaatgtggagtctttagttcttgtccccgggttgtataggaaatagcctaaatctttctgtctactgcttttcctgctctctggctcagcggctttctcatctctccttccttccttgctgggcaggttcctgcagtgggacagctttgcatacctctagaagtgtgcttcttcctggatgattatcacttggctccttgatgcctggaaagaaacttgttcctatatgagtttgttctcatgtctgttttgaacagggttcatatggtgcagatgaagtcatccaacagaaagtatctgaggacaaacatttgcttgtagtttactattttatttcaggggaatgcagtgacattctataatcccctgtgtacttatcaggattacagttaaagtgaatgaattgaccatgtttttgtttatgcttccttggggcaaggagatgagaaagagcaggttctgttcttttttgagagctatggctctggtcttaggagagtcacc

SEQ ID NO: 119723 - DNA, 1037 bp, Homo sapiens
tggttattgctgggcttaagcgtgaagtggtaagatttgctgattgtgagccttctgtctactttttgttgtagataatgccacttttcatggatgtaataaattgacaaaagctttggaaaggactggcagaggctgagaccttggccactctttgagggcccttggcctgctgaggctaaaattagggacatttaaataataacatgctacacaaataatgagtacacagaattacacagtcagagagggaagctattaactgtatttgaatttcatttgcttcctataaatgtcatcttagatcaagtcctttggccagcaaaacactcttgatgagatttaagggaccctggattcatttccttaaacttaccccgggcagtagttgtgatggctagcctaccttgagttctcactatttgccagttattgttctagtactttagctgtatttaactcatttaatcttcagaacaagcaattttataggtgaggaaactatatactaagagtggattagcaatttgcctacccagctattaagtggaagcatgaggatataagaccaggccttttggatcagacctcccatgctttctggattagagctcccaagcttgtagccaccacttagataaggagaggtaattttggagcctttcataaagatagcattccaaaaataagaatttgtaggaagactttactttttttaagtaggtatttatttggaaggaggtaagtggattttttttttttttggtcgggggccgggggtgaggggatggagtcttgcttgctctgttgcccaggctggagtgtaatggcgcaatctctgcccactgcaacctcagcctcctgggttcaagtgattctcccacctcagtctcccgagtagctgggattacaggcatgtgccaccatgcctggctaacttttatattttagtagagagagggtttcaccatgttggccaggctggtctcaaactcctgacctgaggtgatctgcccacgtcggcttccccaagtgct

SEQ ID NO: 119724 - DNA, 1081 bp, Homo sapiens
gcactttgggaggccgaggcgggcggatcatgagcctggccaacatagtgaaaccccgtctccactaaaaatacaaaaattagccagtcatggtggcgcacgcctgtactcccagctactcaggaggttgaagcaggagaattgctggaacccaggaggcagaggttgtggtgagccaagatcgcaccactgcactccagcctaggcaacagagtgagactttctcaaaaaacagaaccaaaaaccccaaacgagtgtatgggtgagtgcaggaggctagcagggaggcagatgatgtcagagacccagtcctaagatacaggaaacgttgtatatccatgagccttgcaaaggggtcttgaaagatgcgagagatttctgagcaagaccttggggtggcaggggtcagcaaatatttgactggtctgttggtgtcataatctagtgggacaaatggctgcaatggccggtttccgtggccaagtcacttgtactggtctgatgccaaaggagtggtgtgcaaaattaaggactgctagagcaggaagagtctttttagaggtatataggtcaaactcatcattttacagatgaggaattttgagccttgatgagaaacttaactggaaggaatggatcatgctgaagcctgattggaaccagaaatccaatttaagtgacagtgaggcgccacgcttcctagtaggcatggctgcttgcacgcatttcctggagcgttaagaatggaggtgcctgaggaggttaatgtgctcctctttcgggtcactttgtgcttgacacccactgcccctctctttctctctgcccgcctcctttgtcagttctgtgagctgggctctgtttccctgattacatcatcattcccatccaatcctggacgactttaggagggacacagcactcaggtagtgtcacctgggtagtggagtctgtatgtgtagggctatagggcggaggaggtggtctgtgtagggagacagaagggagggagagcagtctgagctctagttgggcctgtttgctacagcctatttgcttttgccagtttttataggagttc

SEQ ID NO: 119725 - DNA, 1512 bp, Homo sapiens
gggcggtgcttgagtgctttattcaacaggtgtcccaccttctaaggaaagtccacttttttcaccccctgcctcctgcccttccctgtttcagagaacaagtttccacagtaaggaggaggaacttgcctttgatttattctcatatttgttgtcatctgtccacttgcatttcagtctgatgagaaacccaatgtgagtgcgccatggagctcgagaggtttccatgctcctgagctgtctgactgcagagcctatagccacttctgcctagtccccagagaagcctagatatggagaagaacccaacagtgcttgttggtgtggggttctctatccgttcatcgccgcactgccgcacactcaggtcaagcagggacgtccttcttagctctgtccacgttgtgcagcccatgcttggtgcttctagccttctggggtctccctttatggacgaattccaagggaataggttaagattgccatcaagtggctgttcttggtagtggatgttgacatccctgctggccgatttcttagcccctctgtgagaaactctgtgcaagggattgcctgtccttttgtgggggtaggcagttgttgacagagctcaggtcatctctgggaacgcaagctgggccttctcatgtgtgctctgtaaaactgaaggaagactgggttgtccttggatccatgaatacagaccatcagagatttcctggagagaatggctgggcatctaccctcctgccagctcaggtccagtaggccgcagtcctccagctctgctagtggaaattgttgaaggatcacactgtcatccctgtaagtatgtcccagggtcccaccaagggttcagaaaaccgacaaacttgataccaccatctgtttggtttgttgttttccgtctcagaaaatgggatactaattttttttcctcagaggtggtattcttacgatgaatgcagttgatttatttcaggttcttagtgcctggaagaatgtaaacatttaaaagggcgatcattattgaggttgtagatatacagtaccccgtgacttcctatttgtgctgtagctttgtcatgaagcaggacacctaagggacggttttcaagttggtttgcccccttctaggttctgaatgccaatgtcttgtaatcaggcctcaccctagggcttggcgagctgagactgctgcggccctgacaagcatggaaggaaggattgcctctctagttttccccagcaaggcatcctcagtggtgttggtgaaagctgccctgtaggcgtagtcggtgttaggtttgtataggaggggtaccccacagactattgggttctgaagtctctgaggagccctagcagagagtttcagagccagcatgtggcatgtaatggaggctagatctgtgccagctgggtcagtggggaggcctgagacagacagaggggagaaagtgactgtgggagagcatccgatgggaacaagctctaagttagggtcaacaa

SEQ ID NO: 119726 - DNA, 1047 bp, Homo sapiens
tatgaagtgggggaattgtagtagagtatctctgaggccctatgtataattatgattttaaagtggtggatatcaactagacactaaggaggaccatcatctaccttcgtgatgtctgtgtgtgtgtgtgtgtttatgtacatgtatatatatatttatgtttatatatttttgatgtaagaagttgtggcatgttcatgagctttaattatttaggaaacaagagttggccattgtggagagaatacccgctagcctgggtgacttcactcctgagcaaagttgacatctaccttcagggtttttgtgaggtataaataagttactgtgtgtgaagtattagaacccagaaggtcctcgttagatggttccacaactaggaaagaagaaactgaaagtattagtaaggcatgtttccatttcctctggatgcatctgaggaaaacttccagtgccatgtggacttggccaccatcttcctcccattggaagggcatgaagagaagcatgtggtagtgttgagagcatgtgttttggacattatcattgctggttgaagttcaaagaaaggcttcaagaaaattgactttaaaaatcaaaaagctataacatatgaaaggagatgtgtactccagttgtctgaggccagggagctggccagccctcagttggactcctgcctttttcacccctcccagcagctgccagaccacagagccagttctgtgaaagatcctcaagaaacaatgagagaaaacagcttctgtttgattagattagatcaatttatgtgcctcggggaggggcctgcgcagggcagggggaggggtgcccctctgttgttggtgggggcagcggtggcccatgcggtcacttcataagtaatgaggctccgtggaagctggaatcagagtaagggggagggcgggctggaggaggagcatgtggaaagagatttctgcagtctgtctggagagctgcccaggtttcccagccaaaaaaacaaataaaaataaataaaaggcaagtgctgaatgacacagatta

SEQ ID NO: 119727 - DNA, 2411 bp, Homo sapiens
tatggcttttgttggagaaataggcctttgtgggtttccctgctggggtcctgattaaatccattgtggatggcaaggtgctatatatatatatatatatgagagactatgtaaaaagtgttgcaatttgcttaatattaatattcttttagctttgatatcctccctaggggcaatggtggctcctgcaaaggcactgtggaaatttacaagagagaattaatgtcgctcttaaagcattaagctctgttgaccattttggccaaagctgcagtttcaatcaggcttgtatgactttagacatttctctggagactgaatgccatccagctatagctggtcccttttattttattaccaatttatctgatcatttcccagcatttaaaaataaatgtttgattaaagttaattagttcatcctcaccatagctctggtttccttcataaacagcatgtttgctttcatttccattaatcctttctttttcttcctccatcatctttccttgaaagatggaggaaactgaggcatgcaaatagatcctgagacctgaagtggttctggattgagacctttaaacttcgagtgctcttgattcttctcccgaatttcgtgcattaattcatgtctgtattactgtctgtaaacacagatgaatttcaggaaccttcaatgtttggtgcctcaaatcttagcagattccatggccacattcctatagtgctgctttctgtactgcttccattcattatatttcagtagtggaaagaatgctgctctgggaggcagtaggcctttctgaagttatttgttgtcagcagttttttttttttttttttttttactttgaatggactacttaatcctctctgaatatattcatttgaaaagtaggagggcagttgatttcttgatatgtgagtgaggtaataaggaaacaggggaactactgtccctcctagtcatgctacaaagaaaacagaacttagaacttccaagagattccttttatcctagggaatgaaggcagcccagagaggtttcagggcaaagggtgtggctgtttatttatctacaaattatggtgtcagtcaggacacaaagtttgtggagctttgcccatttatcattacagattagtacacaaaccgataactttatggcacttgtcgatcgagttaaagcagcagctttgcttatctttggagagcctggctcaaattggatacctggtttcttttggtaccttacatttgtggggtaaagatgataggaagctttagagacctaagtacatacacacttgtaattacttgaaggtagaagaatatcattagctatctgtgaacatgctgtgttcatggacatctccctttgagaagtgcaaattctgtgagatgagaaatcaaatttgggcctgttagtttatctgaacacaagactttccacatgttgggcccatttatctgtcttagaaaaaatctcaaaaaaaaatgcccttgtgtttccgtctccttcatgtgactgagttcccttgctctgcagtgatgccattgttctgccgctcatggttacacatcagcctaagcccactgtcgccttgagtcagttttcttctgtaggcggcttttgaccttggaggtggtcagttctgggccctctgtggtgtggaattcttttcatgagctgatagaagctcgagttgcatatcctaggggattccagggatttatattttggtgcgtatttataactgggttgtctggtgggtgtgtgtttgactgggttgtcagtgtaaaattaaaagggtgttgaaatgaagtgtggacccagagcagttacggcctgggatagagtagtcatgggattggacacaaaactagaactgccgattgtagagcatcgtgggtgtttataattcagtcattattattattctaggtactgtacttgttctgattgttataaaggtcatattaaggatgaagaaggagtgaagaggggaagagagtggggaggatgagcccttgccccaaagaagtaacagggagttgtgccaaaatgagcagtacatttatgttcacagtggtgatcatcagagtttaaatagcttctggtctgtttgggaaatctttcatgaagatcacggctctttgtttttgtgagaggttttgtgttgaataaagttaaactgtcagccttgttgtctatttttatttatttttgttggagcctttcagtgagcagtgttttctgtccccctgggattgttggttaggatgtacgaaggggagatcttttgtcttttggtggttcttactcatttggggtctagagagccagaatggggcccattctagtagtagcagtgttctgcttacctcttcctctgaggaaataggagata

SEQ ID NO: 119728 - DNA, 1319 bp, Homo sapiens
tatgctaatgactttggtgtgctccagatgttttagaagccctggaacagcctcaaagccctccttgtttttcctttctttttaacccttgttttggggcactgcttttgtggaatagagccattggcttttcctttagttttctattgtcatgtatgtgtagctaatgagagaggactggtaaaacttctttgtgtctaaaacatcataaaatgatacagactacatgctctagtccctttttttttccagatattagaaaagagttgtcttctgtccatacatttgtgttctgaaatctgtcgttctcattggttgctttagaagttccttcagctaaaggaatctttggcctaatttgtgtttcaattttcccaacgcccatcatataaggcaagagggagatagccatacactagtgtctccagttaccaagaacaacaggaattcctattccattttgatgctgctgttccagactcagaagcctgttttgttgtattgttttgtgcggtcttttcatttcttgctaatttgggagatgcggtgaaaagctcctgaatgtgcagagctgctgatggcagggttctgttgtgttcaatttctttagagttctcggctgcacaaatggacactgccttgtggctaaatggtcttggatcccagacgcacttctcccgtcagctgatggtgactagctgaggttgcaggcacagtaaccaagctgcctttactgcaatgatttacaattttcagctcatatttattgcttttgtgaaagacaatagacatggtttaatttaagttcaacctactgaatattaatagaggagaacaaatgctaatgggatagactgactctttgggccattcattcaatttcctctgtttaacctcctctccccaacaaaggtttgtgttggtcggggtgggggagggggttggaaaaataaaaacggtttgagtgtgtgaaggaggggatgccatttcattatttctcgttgactaaaaataataattttaacaattggtggcagggctttgttaggggagagaaaaggcagtacattagcttggctaatgttataataatggctctgttgccctgtggcgtcatattccatcttgctgacctggccctcctggattgggcaggctgtatgattgggcttaaaacattcaaaatgaaatgtggtagccagtacagtggagattggtcgccagcgggggggttagataaagaaaaagcccaggtttatttaaccatgtaggctgtctgactattaataaatgtaaatgttttctgggctgatatatac

SEQ ID NO: 119729 - DNA, 2589 bp, Homo sapiens
taaaagcacatccatgagcaccaagactcccctgcttatcatctgctatcatagagaatccttatcctttgagatgatcaaaggcaaatccggttacaatctaatcttgtagatggctatgaagaaaaacaagtggagtaggatttctagttaatatctaagatgtagctgcaaagataaggatgccttttcttgtgtggcaggtactggttcctgcaggcaattccagaaaggatttcagtatctgtagagtcaatatttacctcttcaagagtgactagtttgataacagatactcctttcttcctttcaaccctttagctgcaaaagatgtttatgtactctttaaaaacgaatcctgaagtatagtgttacagttccaaatttctgctcaaatttcttactgttgaaattgtttccctcttaggcatttcactctctttaaaggtctcatagaatgaggttttgcttttctccacccattcaaaagggatgtgtgcttttaaattctcttctatccacattcttgtctgtcttcatcagcgttgtgtagggttaactgtggtaaagtgctgcctcctgatgtgatgtatttaagtgtttgtccccttttctcacctgtagggctccttggtaatgaccagtctaagggattaggaccagcatcagaacagtcagagaatgaaaaggacgatgcatcccaagtgtcctccactagcaacgatgttagttcttcagattttgaagaagggccgtcgaggaaaaggttagtacccaaggctgaaaatattggtaccttcaaccagggactgcaaactcaggtgccagttttcaccacatgataacgtgagcccattcacccaatctcttgattttcatagaggagccagaatcatgaggtttcgtatcaaatgccctgctttctaagtattgtctaataattataattaaaaacgggaaaaaaaagtgctctggactgacagcacatgttcctgctggaacagttagccaaagagttgccagcttgtaatgcctgtcttaactgttcatttaaattgattctcagcagcagccatcttgaggaatatatatattaggtgatgttttgccatttctgaaaagagatctttctaaaaatttgaagaagtaaatgtggtgtttctgagacgttttttccttgtcaggaaagctgaaattacactgtgtatttttaatcccttgctgttttaccaagttccaagttagtagctgtggaattggtgcttaaaacttagaacagcagttatttttatgtggctttcctaaataagcttcagatagtttggtaaggaagttggctttagtagtttgataacagtttgtggtttcatggtcaaacagtggcagtgacattttataataatgattttacttgggtgtttttgaaaccctttgcctagtatctaccctacttcatacctgatatgttacttcctttttttccctgttagaatttatatttccctttgttctctttatgtttacctggaggaccagcttcctgactttttcttagaatttgttcgtttccgggattgaaggaaaagaaaaaaaaaatcccccttgtcagttcatctctgtttactcattctggagaatttactttttagaagcaatctacatgtatctatctaaagaagaacagaatagagtgaaaaattaagagaaaaggacaagattagccatgtgtagatatttaagattcctgttttcaggactgaaagttgagatgcatagctcaaagtctttattttctccatcatgagggtgtcgtcttttaaatagccttttaaatacattgaatctgtattcttctctcattttctcttcatcctcagcactttgtcttagaagatgtcataagattcgttattagtatagttaggatcttcccgtgtactgagctttgtatgtcactcctttaaaaagagtgtctcagtgatgaacctgttatattacagatattccataacaaacattcccctgttccagtttaaagcatgaattatcacaagagagtgattttaaggatgtgtaaaaaattgtgtcagtaaatatattggaatgtgtgataatattatccatgcctccaacatgggcatctggcatgcatctggcatcaactttcatctccatttggggagcagaattctctgagtctgggcacccactcctttagctatgtggctggccatcaccctcacttctggctgagagctggtcagcatccgggtgcagtgatgtgtgttgtaggcttcattcttaaggaggagggactctttgtccctaactcactgtgattctctcagaagatagtgttgctagctttctctttgtatgggaccacagtgtcatgtggcacctgagtgcaaagcagtcatttaactggaattctttaaggtagtagaaaagaggaactctttttcagagttagctgaaggaaaacttagccttggcaaatcgtttttaattattaatgtgtcaagtatcttactgaattaaggattcattacagcctactaacttggttctggtctcatcaaggtttta

SEQ ID NO: 119730 - DNA, 1835 bp, Homo sapiens
catagcttttcatttagttttgttagtctttaaaaaaaaaaaaaggtgaacagcgtaagtaagccctgactccaagaaaaaaaattcaaaattaataaacataagcattcggcctataataaaaatagtaaactccattccataataaagcctgtgactattagaagtccttctttgaagctatgtaatctgtctcttccgttaggaagaactgaccttagcctagataatattgtgctaaaaatttttaccttaattcttttgaaatacctgtttttaaggttttaccaccctcacttggcagctgagttaataggatttggatctaagctttcacatctataatgcctggactttgccactgtaccatgtcaccttccataagttgtagcaaatgtaggtctgaattttcaggtgtgtgcatctggacagcagttggcttggtgagctgtactgggggtgggggtgcagtttgaactggggtctggcctggtccacaactgtgctgaggggcacctcttgctgtcatgcctagtgttactcttcagctgacctcttctagtaaataatctcttctgccaagggatgtattccttcttttctgaagtacatgaaatgccttgcttcattataaactgagcgatggatagaaaggggaaaagttttagcttatcttgagcagaacctacagctcccgaaatcctctcttgggtcctccaatgttagaggtccttttgtttaaggaccctggagagaagcgcgtccaggagagggcccagctcagctgactgttgtttcaggtagctgctgcaagtagatctgtgattacttgttgattttagtgggtggttctctgtccttctggacgaatactctttttctttacttttcctgcagtgagctggagttggtaggtttggggtggctcacatcacagtgcttgcttgtgcatattcacctttcccatggaaatcttccaagtgtgggagggaagtttgtatttcacgcactgtgccttcaccttgatcagcaaggtgaacctgagttcctgggtttcagtgtctgaggttggatagcacagagctaaggaagcgttttctgagtgtgccagcaattctcgctgggctgtgcatgctctgtttcctggaggctgcacatgctgctcatcgacattcgtggtcaggttctttccctgcagcaaaaacccttggttcagacctcatttaactcacaatttctcacctctgctctaggggtacccaagatggtggctgtgtctccccacttctgcttccccatcaggaaatagagccccaccatgggtgtctacacaatagatgaagctggtcaaataaacacgaaatctgactggttttgtgtgggcttccccgctccccctccctctctcagaattttaagtgcttggcagaatactgcttatgtgactctgttttgggattataaaacaatcttttgtattgctccagtttacaggaagcagctccttttttctcattaatgacgcctgttgttgagtccatcttgtcttctcatgggttaggcctacttgactatgctatcaaggcttacaggtgtagcctagtcttttttttttttttttttttaaacatttatttgagacagggcctggctctgttgcccaggctggagtgcagtgttacgatatcggcacactgtaacctccgcgtcctgggtgcaagtgatcctcctgtctcagcctccaagtaggtgggactacaggtatgtgccaccacgtccagctaattattttcattttttgtagaagtaggttttcaccatgttgctcaggctgg

SEQ ID NO: 119731 - DNA, 1074 bp, Homo sapiens
gtgagttgtagtgtgatggaaggaatcgcaaagcctggacctgccgcagaatatttgcatcctctgcaggtttagatgttggcgaacacttgttgggacttcatattcacccccattatttgcttcaggctcctggcaaacatactagcttcttccgcatttgtttattttctagaaaacaaaaaaggctggaacttcatttttattactgcagtggccatttcctttttctgttacctcggagatcagattgcagggatatcacttccaccccccatgtaaattatggtctagtatgctttgtggttgccatggaaactgctggatacaagtttctttccttcctcctctaagctcttgctaggcttttaaacagtaacatttttgtctcatccctttgccctccttgccttttcacacccccaaaggacaagtctaaacaccaccctgatctttttcagcagtttctgaccctcctgggaacatttgatcagttcctgaatcttccttagtgtgaatgtgtagacactggttcctggcatcttacgtgaaaggcactagatgctggaattgtgagggcttggagtcacctggtttgtgaaggaggtgacagccattaatgtcacttgtggttcacatgtgagtgcttatatggggttgttagacataccttttttttttttaatgcagagtgctgcttgatgttaatacctcacttgactgcctagtgcaattgcaagtagtgcacagtgctttaactaagatgagaattgaatgtttcttcttactactgtcgccgtatacttcctgttccctcactgcctccctcctattttattgtaagatgggagtctggcgggtgatgaaaggcagcaaccaaagtgacttgttttagaagaaaattgggttcatttctgcttttggaaattttaaggaggggtttttatggtaagtgggtttttttctacacaataaggtaaatatcatgcaagaatattttttcctttaggctcaatggctttaatttgcaatgatagaatcttctttttttgttagatatatatttttgttata

SEQ ID NO: 119732 - DNA, 1033 bp, Homo sapiens
ttcataagatgattcccagcttcctgtgggttgcaatacatggtgcttcccttggccaggtcgatgcacccactactgcccacccacatcaattgcatcatacaggactggggatgtttttctccattcttttggggatatggggggaaaatttgacagtgctttctccctgatagttcttttctcttataattagcattaatggatgatactgtggctgacaataatgcaatatccatcatacccctgttttttaaattcttttaggccctaagagtttttccagtagccctcactctccagggtgtgtgtgtgtgtgtgtgtgtgtgtgtgtgtgtgtgtgtgtgtgtgtgtcaggagtagaatagggttgagaatatgtatgtgccagtgtactttactttccctggtttcacatgtttcagcttggcatgagacagtttatacccagtgggggaatctgcccgtaaaacacaggtacctccgtaagtctgtctccacccttcactgtgttcctaacagtttttttttttatttttattttttaaacgaagttttgttgtagatcagagaatgagagatgacattaaataatactgtagctgtcccttgatgcacagaattcatgcttctgtgatggacaattccatatactcctcaatcagtgacttatcttttaaaatggaatttgttgtatttttagcctgtggggttgtttagggtggtggtatctttcagagagtgttgcacatagatagattacgaggagccagttccctagaggagctgatggggagagagattttcagaaaattcttagaagggcaaatagggtcagctgtcatctttgtttattttaaccactgtgaaatgtggaagagaatgcattggtttttcattgtcatgacaacagaggctcttcacacccctgggcacaacaggaaatgaacccattcatttatccaagtgtgagtctcagaatcccattatgtgaattccatggagtgttaattcaagtattttgatagaatgt

SEQ ID NO: 119733 - DNA, 1799 bp, Homo sapiens
aattagttttcctaaagttcattagctattagcagattttttaaattatgattgtgtttccttatcttaggcatttttaacaaatgttgtcagagacaatgtgtcagttatagtgaatccttttcttacagagcagacttcactccgcatttttgttggtgatagtttaagtaatgccccatactttgaaaatcacaaatgattaaggtccaggcaactaaataaatttctgtcagagccccaaaatgtgggttttctgatacttatcaaaaaaggctagatgttgtgggttttctgatactcagaaaatgtgataatcagaaaatgtaggttttctgatactcaccaaaaaaggctagatgctgtgtgttttatctctagccatgtttcttgggatctaaaatagctggattgtatattcctagatgttttccatacaagaactttggggtgtaatgagttggaggggtgagatggtattactaatagcgttgatagacctactttctgtaaatagtggctgggttcttaactggcaccagattttagtgcaggtcctaaaaattggctaatactagtgcttgtcataatttagcattcctttttttccccttaggggtgatcccacagctggagtgtaaagactcgctattgccatctattggtgcatgctggctacttcataagatttgcagtgggtggggaaattgcctgggatcccttttctatttgttaccctttaaatgaagaaaatttctgttagtgaacttactgcatgagagggaggacatgtaagatgccagagcccactctggtccttctgggacttagaggacactctgagtgccgcctttgtgctttggtctgtcgtgtgctgaatggatggttaggacctcacctaccgcacaactccatctggtatgatatttctggtgggaagtttctgcagctatcttagaagcattccactggattttctttatttatttatttttattttattttattttatttttgagatggagttttgctcttgttgcccagcctggagtgcaatggcacggtctcggctcactgcaacctccacctcctgggttcaagtgattctcctgcctcagcctcctgagtatctgggattacaggcgcctgctaccacgcccagctaatttttatatttttagtagagaccatgttagtcaggctggtctcaaactcctgacctcaggtgatcccccacgcctggcctggatttttattttttaataagctgtatagcattgtagaatacaatttcttcttatatttctcttgcattttgaaaaaaaaaaaaggaagtaaaacaggattctcgcctcacagggtcattccctttgcctttccaaacatgcccattgccaggagagttctggcaatttgcagttgggtgttgagtaatctaaaattgagagactgctagggtttttgttgaaatgatattttaaaaactaaatagggaatcccatcgagagatagtagaaaggcaaattaacattttaactcgctcttctaggcttttaaaactgaatgtacttagataatttgttcactccttgtaactacaacagcctattagaaattattttggccagatcctggctggattctgtagctacttgcatgtgttactctgactcttactgtctttatgtagtcccttctgccttaagatctatctgctttttgcttgagactgtcctgagaccagcagtctttgacgagaagagtatttgtggctcttccctcctgggcttggagttgta

SEQ ID NO: 119734 - DNA, 1021 bp, Homo sapiens
gaagagtagattagggctattttctgttttaatgtctaccaaatagttgcaatttgaccttgttggcagagggtaacccagaatttgggattggagggggcgtagatagactagagacatacctttttttctgtagtacaaacttgaattgttgtagtgaacttttcgtggccgaatttagaagtggcgacagggacactgatggctaaataggcaaaggtgacctggatgtaatgacacagaagagatgtgggtatggatttgtgaccccgttagatggacgtataggatgtatataaatacagcaggataatgtagtgttttcttctttactgtcagtggaaataaatgaacaccattaagctgatgatgtcagataccgtgtgtagtttttaaatactcaggcaaacatagtgtgtacataggcatgtatttctacacacatgtatacacatgtccatgacacacattttatatccatgtacaaaacatagtcctttaaccaaatttattgcgcttgaaagtaggcctgtggtttatgagagtgtgagagatatagaaccttaattaggaagagtttgcttgaaataggatcttttttccccttatgtgtcatgattttattgccgcacgtaggcctatatcctccagtctctgcttaatttatttttaattttcttttgcttttgcaggcccaggctgcaagcacaaaggaagtttgctcagtctcagccgaatagtcccagcacaactccagtaaagatagtggagccattgctaccccctccagctactcagatatcagacctctctaaaaggaagcctaagacagaagattttcttacctttctctgccttcgaggtaagactttgcaaccatcggcggaggtctacgtggaatctacatgtaagcctgaggtctacgtggagtaaccttagctttactctctgccatgttcatttttctgtccccaacctgggttgagggggaattgaaagtgagaaatcccaccgagagagt

SEQ ID NO: 119735 - DNA, 1181 bp, Homo sapiens
atagtgcagccggcccgaggtatttgcccgcagtgtatttatctttaaatagctgctttgaaggggtccacatgtctcttgccagaggcataattagtatctttcactggcacacgcggggaagagggttttgcgcttgctgcatgcagtgattcgtaccatcgccgtattccctgtcaccactctggttattcttaatgagttctgtcgtctcctctttgttctgactatgattattaacagattaaaaagagcttaatgtagcagagcactggcaggttaaatgattctcttatttacattttcctctttacggggcactgcaaacaaggggattcccaaaggggactcctgaagcatgcaaacctacatacacagttcattcctatgaccgtgggcatcacagttcagcgtcacggctcggcacagtgaagagagtgttattatggggagttcctcgtaaatatccttactgtcagccgttgtgaagcaatgctgtcttgttttggaactgcctgccttttgtttcttctgtcttacagaatctttagtgatcagctgtcattcagttgctaattaattcagcaaacctttattaaactctttttgtatgctagacacctagaaaacagattagacacaggaaagcagtattggtggtgggtgaaattgaggatataacaataaatgcgtgaaaatgctgggatagaagtgtgtacccattaaagcaggaagggagaggccctgggatggctgcaaaggaatgctgacatttgctgcgggtctccgcgttacagtgcattaggaatctttgcagaaagaggatagtgctgggaaggggttctgcagaagcaactgccaaggcatggattgatgttggaggtcctggagttaaagcaagaaagttaggataagcctcagattctgcatgccctgggctagttactggagtatcccttggcgttcttcaagtcaggggtgacatcataatacacctatgaggttaggaagatgttactggcagctctgcagaaaatcgattgaggctgcagggagttctttctaggggcattggcagaaggctggcatgtcttgggcagatgatttaaatatttctcagcctgagcttcctcatctgcgaaatggatattctagagtctatagcacatagttgttgcaga

SEQ ID NO: 119736 - DNA, 1367 bp, Homo sapiens
cctaatacaatgtaaatgctgtgtaaatttgttagataatattgtttagagaataattacaaggaaaaaaagagtctgtatgtgttcagtagagatgcaaccgtccctttttttacctgaatgtttttgatcgacagttggttgattccatgggtgcagaagtgtctgatacagaggtccaactgtacatttatttaccattttttccagtgaattgaggcagaggtagtggagaggaagattattagattttggatttaggtggaactgtctaaaagaccagctgaatcggccacaggtaatagaagagacagccaacctgtggtgttttttctaaagagcgttgctggcctcattggcaaggaacacatattttgatgtggtcctagccttgagtattgaggactaggatttctaagtagggcaaatgcaaaagcctggggtgatttagaggtcacagaatgaaaggggattaacctgccagaaagcaattaagtaatcccccaattgcaaggaacactatggtgctaataatgagcttccttgagcaaaatgggaatactttacattatgtaaactctttggggaggaaatcacactgtctccagtggtacacaactttttttgagggtctctgggagttgttgcatcttagtttttgagagcagcagtagtgaaagtgtatgtttgagaacggtgtcatcactgcctaggggctttcagtggccttaacgttctgcatatgcttggttttctcctagagtcagttacctgtttcatttgttgggatagtttatcagttaataatgaagaaatctgaaaccctgaaatttttgaggtctgaggaggggaaggatggatcacttttattggccctgtgacgttgatcagatgttattaataagactgtaggtcattttgctgtgaggattctccctgctacaggccagctggcctctgaccatgttgtgccctccctgaagataaggcaggcttcctttttgctgccagtgagtactggcacagattcagtagtacttctcagagtcatctctggccttctccttactttctagagagtccttgagtctttctgaaatccacttagagaacatggaaataagactttaagtatggcagtgctgttttgttggccaagcaccttgctgactgaaggggtttcatttatagcactaaagtccctggtgtctgtgtcccgcagggaagttgagtattcagcttctccattgggaactgaggaaggcctcacatgattcgcacaaagactgttgtctgtagtggctgttagaatgctcattttgttgttgttgttgttgttgttgttgttttgttttttgagacgaagt

SEQ ID NO: 119737 - DNA, 1001 bp, Homo sapiens
atcgctgtgaccatttttactttggcatgaaataagagatgatcttactgcatttgtctcgaggagaaaaaaagaacctactttggcttcatttttaccaattctgtggcttctctgggtctggaatgccagtttgacccctctgtgattttacaagtggacattccagcagaattcttagagggatttacagcaaccacgtggtgacagagcaatggcatgtgcagcgttagactctgttggctttattcttttgtacctacttctgtttgtctatgacgttgatgagatggacaggtatgagggtgcccgaccaaattctggaggtctgttccttctaggggagatgccagttgttcatgagtgctccccctggtggatgggtgatggattggccgtggcccttggaggatgatgccaaggaggacagtcaggccatatccaggcttggggagacagtgttgtccttgtggggtaccccccagtgagaagaaggggtacaagcttaacctctgaactaagggtactctggtggtggttaactgacctcctcccctggagttcatttttattctgcttcaatccctttcctacactttcccttttcccagtcttccttccattcaacatattacctcctgattccccatctgatttacgaatccttcattacccatttttctttgttgattctttacctttagatccagaccaacatgccaattacctgaatagaagcagaatcatcttctaggttgaaaacaatccttttttcctgtgtccccatatgtagaagaaattgtgttctttcttacctctgacttcagggccagttccatcagagggacttactactattataaggttttactttgagagcaagttcctcagaattgcccttattcctcactggtcttctatttctaatctttcttccattttagcccctcactttctttcccagcacccagcaggtcacatcacatattcgtatttgccga

SEQ ID NO: 119738 - DNA, 1366 bp, Homo sapiens
ctttctagaaaaataatgatattgagcttatttttttgttactttaaaatccggaatgagaacctttgaggatgagaggttaagatgtaaaagggtaaaggtgaggagatcggttcccccgttgggaggtttatttctttattttttatttcaaattcagcacttttacttagtgcagcgtgggaatttatttgggtgatttttgcatccagttaacctaatcaggacatcaaagtaacttccaaaactattggaatttggggaattcatatccaccataaggaatgaatattccttatgaatacaacacagtgattttatataatgaaatgttatattctgtttttacttctgtcttctctgtctttttttttttttttttaagtctattaatttagagtaatctctcttcctcagcagtgggtaggtgtttttattttattatttttttgttccatccttggaggtgtttgttttttttctcaagagatattcagatgagattttaaaaatccttatttgttctattttgcatcttcttcctgctgggggattttgcttgaaatacgttcaaaaggcacagatgatcttgggagcatttgaaaaataaatttaaaatggcagtagagatcagttgctttgttttttctcctcggttttgtttcattgtggtgttccttctggaaagggtgagggtcaaggcctgtgtttatgagctgtttttcttattccaccaggttctcctgcgctgcccaacagcatggtgtattttggaagctctcaggatgaggaggaagtcgaggaggaagatgatgagacagaagacgtcaaaacagccaccaacaatgcttcatcttcatgccagtcgacccccaggaaaggaaaaacccacaaacatgttcacaacgggcatggtaggtccaccgttgaacttggataagaaaaaatctaaagctttgggtgagagctggaagagagcctctgctgagaagagatgagatgaaggcaaagctcgttctgggtacttctccagggccagacacttcatgggcaaagggattattagtgtagcttagtgtagtccagggtgttctaggtgagtgcagatactctgatgatgtggagatgatggtaaattctataagagctgtagataaacaggcatcagaacaggaaaagaccagatctacatggggatggtcaagaagatttggtgaaacaacatctgtgcccccctttaattactaatgtgattttagcaggtggatatggtataggaagaaaattatcattcctcctatggaattgcacatacattctgaagtggactgattttccccttgcgtgtatagtgtggaggaggagg

SEQ ID NO: 119739 - DNA, 7872 bp, Homo sapiens
ttaataattgttcatctggcttgcctcttgcttttgattgtgtttaggtgacacatctgcatagtagagggtgcaatctctttttaggttcttgtggtttaattggggagatggggtaaatacaaaatgtaactacattttaacctttcgggaaaaggttgttacctgcagctgtggtcatcagggcatctgggtggttggaagagagctgcatatgtgaattggaatgcaggtattagtgtacggatgtaatttctaaggaggaagaacatcgcaaacagagcgatgcggaataatgcctgtttttgggactgttgcctgttgttccaccagtgtggaggtctactgtttggtgacctggaaagacctgggcacgagaaagaattctaataacagaataggaacctgttgatgattttagatgtgggagtaagaggaaatgcgtcaagttctgaacgattcctttggtagcagactagtctgaaataaaggaaaaaattattgtattcagagagttccatccaggcaacagctgatgtgaacctgaacttgagaagctacagtggcatagcttttcccaggggcctgcagaggcgggggtgaaggtaattgaataggaattaggaatgggttgatttgtggaaaggtaataactttataatcttttgagtttgtgttgatggtgagagacaaccgaattattgagaatacaccaggaatttatcattttggagctgctgcttgaagcctcctgaataagtaaagtttttgaaatataatatggatagaaaggaaacctctggagaactttttcttgtgaaggaatttaattttctaggtttctttttggtttaatagagattgaagagtgaagaaatatgaacaaaacatggaattaccctcatctgttgtcttctgcatggctgtatgatagaaatctgtttcatcagtgtagtatcggattgggtccttttcataagttgtttttcacccttttatgctgattgggcaggtgaatttatctgacgtcttgatcagttgagttaatcccatgtatactagtgcagttgtactggggttgctaactcctttgttttccagagtgtttgagcttgatttagagacattggattcacatgctgatttttctcatggattcagtttttaatgttaagaatcatcatctgcatggatcttaggtatgtgcaggggcagtgactatctggcagcatgttacatggagcatatgaaagaaggggatggaatgagggtgaagggataggctgagctctcacctaaaggagggcataatgattctacattgaccactgtcattgccactaggagtcaaggaaagtgtaactatctatagatacatatctctgtgcatttacacagatgaacttctgagtttcaaaaatcttaggagattctactttttcattttttattgtttaaaatttaaaattttatttaaaaatttttttaattttaaaattaaaaatttaatgcctgttaattcagatatttccaggaacagtgttgggatttttttgtcccctcatgaattttgatgtctctcggtgaggggctggtaggatagtgtgaatcctggctccaggctgggaagactaggtggaatgagtggtcttgggtaagcaccgacacacccacctcctactgctgtttctgagttgtgcccttgccctccttgctgtccctcttccgccctgtctcttctgtcatcctttcttttacaatagagtcacagcatcagatagaggagctgcaggaagcatacccaaaccagctgagcttagtaaggggactaacttcactgaaatgtacaaacctttctgtgcttccttttctgagacttgtagataaccaaactgaaaggcctttctcacatccctgagcagctggcttataattttaattagattgatgtcatctgtgattaggcctgcccccaacctccaagtgtctaccattttgattatgtcgtatttgaattgtgaatgggttttctttgatttcaacccagcagagtcccagaactaccatcttgggagaagccatggggctgtgcagtctgtttgcctgcacctgaacttcaggggaagtttggtggggggattgttgcaggcccaagagacctgtatttagatctgtccagactgcagtccttcttgctgtcccattctgttgtccagagtcaccagccatttccctgttcagtctgtgttaggcctgcccgttcctgagcaggcactcacttcctgggcatgtccctctgcaatttaattcattgctcttcagcagcgtcatagggaagtttgaatcttatttagtctgaggttttctttctattgctatgcctgggcattttttagatcttaacctggtcagaaaaattccatttcctgtgcaagtcaaagagacaagcacgaaaccaactccactagaatttttcctacagaatttgtgagtttttagcaaatgtgaatacccgtgttaggaaagatttcatatttacatgttcccgaaattgctgtatttgtggaggatttggagagagctcaaactcattttattgtgataagtgctgaaacataatcatagaatctttgccatgttaacagtggtgaatgatattaaccatttatggagttaccttttctctcctaaatcaaataagattaacttctgtataaatgagaaaaatgtaagcccctgtgctgacgtaagcgctctgaaagatagcacagatgaacacggcaataggatctacccacaaggagctaatgggagatgatgtctcctggcacatctgtcagaaacgtcagaagacattcaggtctttacgtgtgtttctcctgatgaaacaggtttcagtgtctcattcatctttgtcattccctgtcacttggtgatgctacctgggtgacttgtctcccttgtcttctgatgtgcgtgccccccccccccccccgctttgtgtcctgccacccacctcacacccatataccaaggtccttaagaggggggtggtgtgatcgttggggctccattaagacattttgtagtttttgtgtatatttatgggttttatgtatttgttgtccctttgtaggcatccgagtaccaagtcttttgtgaagtcatatgaaaagaaaaaatccccacaagccactacctgggatataggtctctgcagagtccttcctgctgttgccacatggcttgaatggccttggaagccaaagagtaacaatccacaggatgtcagtgcttccttatgacgccagtggagggaatggaataaagccagcttagtaatatacaggccacttggaatgctcctccgatttcaaatgacccgggggaacatggtggtttcgtgaaaccaaagtcagctttgaagaaagctaatgtcagcctcaggttcaggcagtactgtagaagaacactgagctctcagtagctggctagctgtgctgccttccccagtctatttcacatccgcttttatatcaaggcagatgacaaggaaacaaactgacgtcagtttattaaaggaaacacttgtgatattgggagtaatccctcaggcaagaggtgctaattgaacctaagagtatttctgaagttactattttcaacagtagagaaggaaattattgatcatctcatccaaaattgataaaaacctaagtgtagcagtctttcaaaattaaatattctcagctgtggaatattctcatgcccaacattgctacttcctcaaccatttctagatgattaaaattacactgtaatgccatgttgctcaatatgcatatttgttgtcatttttgtctgttcatttcttaggaatgtctttgccaccatcgaacagtcatcaggaacttagttgcatgcctttttttttttttttttagctactcgttagcttgtgtgttcttgggcaaggtatttacttagcttctctgattcttaatttctacttctgtgaaatcagcatgatagagtagattagcattaatttgtccagtcattgattcatttatatcccagcataaggaaacaatgaggctgtatcatgggcagcagtagagccattcagatctctaatggtggatgccagccattgttatatgttcaaggaaaatgacatttccaagatcactattcagctgggtgaaggttcccaactaaaattttgtccctgtaatccattcttctttccctgagataatagtgacttgtccagattaaaacttttatatcccaccgtgtcttcaaccccatttacattgctatctatactttgttttcttcattcttttataacccttaggaaaactggtgtactgttgcatcctccaagcaaaggctgagttgctgaaagtcagtaataatcccggttgacaccagtcgtttacacaagaatcctccaagtggtcagactgctgggatcacctagagctttgttttcatgtgtaataaatacagatcaaatgttggcaacagttcccatggcagctaaaagttctttcctgcaaaatttcactgaggtccatttctctgtaagtttagagcggaattcctagaaatttcttataatgggatttcattatgagtatccatcagtcatcaaagggagtatttatttaaatgtgacataatataaaatgaaacagatcttcctatagagggttccttgcaataaaaaggcaatcaggcaccagtgccttgcaaatctaatgaagcttggagctctgcaggtgcaggtgctgtcagaaaagaggttagcaattttctgaacctgaagaaggcctcttctgaactgcagacagaggaaagagtcctggagagcaccacatctcaggccacatcaggtgctgtggaactgccagggaggcccaggtcctcgcttcgccgtgcaactagcattttctcttgcataatcgcctaccacctgttcttcaacataaacccactagccccacattgtgccatgagacaaggcacctgagccaggccgtgctgcacctgcgacctcaggaagctgtgatgctctgcccttacccctgttccctgattttggagtgccttggtgaatagaagcaaaacacgagctgtgcttttagatgaaaataagttctctggctgcatggaaagaacggtttggatatagttagttaagaaggtgagagctcagtcttccctcctcacacctcagttttactccctcattttttgaaaacattcaaatatagaggcagatgatcttcgtgtccttttggtttctgacttgggtgaagaaggcacaggtcttaaaataggttttcttgcagggagaacctgggtgagggcatcacgattgtgtattcaagcaactgctcagaattgttaatctttcacaagcgaaaggggagagcaagctggttgttttgtgacttttccattacagggtatttctcttatcagatttgtgcttttccctattttgtatgctcgagctgttgaggcgtgtcaggaaatctagcaacatctgtatcctccccagagggatcacccctgctgaaatgtggggagataaacacacagaaaacaaaagtatggaaaactgatgctttaccactggggtgggtttggccaatattttaattaggccacatttcaaggagaacagctttatttcagcagctagctgaagaacctagaacccagactgccaggggtgtcctgtttcatcttgtttctccacaaaagagcagagtggctctggtcatggagccgggacctctggcctcatggcagaggtggcaggagaggacacacacaccatccacagtgtcctgccatcagcttccacatgggcctgagactgtacccttcttcctccgagcaggagtcctgatgccagtagtttcctgcaagagcctgctgtccccaggcagatgttttgttttgcaaacattacacaggactctaatgtgctcatttgtaatccactgaacatcctaatggaaatggatttattaaaatatataatctgaaatgatttggacagcatcacatgagcttttaaccttgggttagcactcaagggttacaataacaatgcttccagcaacttctatttcaatagcacatcagagtttccaaaatactcttccatatacagaatctcaaatgattctaaaaatggagcccttaggtaatgactatttggaaaccaaataacacaatcagaacactgcttcatgggtatttatattacaagttgatatttgagatgcctagatttttcttaagctctcataattggttattttttccagggggtaagtgaggtagactagaggaattaataaatgcctttggaatgagtttaccttggctttttgagtgctttgaggaggagaccttggtgaaggcttgttgctaggtcagctgcatgtgtatcttttaaatgctttttataacttaaaaacggaaggaagaagagtggctgttgtttcttttgtgcatatcgttttctgaagagggatgtttctcagaagactttttaaacagcatgtcattggactcccagctggaatgacttaattgcttttagattcataccgggggcatgttgtgtaagggccaaaaagcaatcatttggacgagtttatcacatttctgctctgtggttgcctttgaggggcattgagccctctctttgtctgggcggtggggtgttggggtgtcggtcatgcatcagggtcaggagcttgccatagccctgctatgttcagtggggacagacactctgtaacagacaaatgccgcctccccgcccccgagagaacatgtgatattctctttacctctttttaacctctggtagctccatttttcctgttgagacaagtgactattccaaaaagttggaatatgggatgggagtgttggtttttttttttttttttttttaagagctgtaatacatgtagagagaccagttatacaatgtatgtttctaaccaccccctttacgcatttggggcggtgttccttagaggccgttgggtaggatggttcagagcatcatgattacagcactgacacacttatggctgcaaccttaggatttttctgttttagttttcttatctctgaagaagagatcataggttttggcaataactaaatgaattgatacatgttacaacagttaatgttagaaactgctgtgttgcatattatcattaacataatgtgattgaaaagatctggtgcctggaacaaccttataattgctaggaaaactcgagaaagtttatgtatctcaaatgcctggggcacgatgaggactgtcaaagagtcagccattacccttgagtgttgtgacatcatcagcctcgccagaactatgttgtgggctgtttcagtgtggtagaaggtcttggtaattcctgtgtcaggattatcatcctttccctgtttcttcttgctttgctaaagtatttatttgttccactggcctcgtagggccttagtgggggatataggcacacacttcgggatagttggcccatgccccatgagtttggtgttgttaccttcgtaactctttctgtgacaggcagctagaagatggtgtatctggtggtggaagagaagctcctggctctgatccctctttttagcctggtgtcagggctaaaaagattatttagcctctttaagctttagttttcctcctttgtaaaattatattactaatacctgactcgcaatgctgcttggggttgtgggggaggatatgtgagggtggggtcactactctcaggtatggatgcagaacccacagat

SEQ ID NO: 119740 - DNA, 3046 bp, Homo sapiens
tctgttattttatcattgcacataatgcattcacacttggagatcatgatgagagtggcaaccaagtggtaattggtgggaaaaatattacagaatttaagttcttctatagaaaaggaagaagatgtgattggctttaaacattctatttccagatatctgttataattgtgatcaaagtgaaagagatttcattgtgtgaaagttccagaagcgttttacaaagcctgtaaaccagtagaatttgcttatgatactggagtttcggagtacagaggcagcatcccaggttgacgtttgttccctgtgcgagtgagctgctggctggatgcaaggtgataatgggggttttgctcacctaagctgtgttcttgcagctttccctagttttacacgtggatggtggagctgttttggcccagggcaaaccgggttacagcactcacacatgctacattaaaatccatttgaactgttggcacaggttggcagacattccattgttttcagacaatagtgactcaaagttgaactggctccagggagcaagtgtggcttttgtacagtaacagggatttaatgccagccaattgacggagtctgtgtcttgcccaaggaagggatgccttgtaatgacatgaagcgtacatttaaatatctggcttgagatcagaaacttgcggtggatctcttttcccttgcttaacacatttcttctttatttacagtgattcttttttttgcccctttcgtttgttttggggtgtggacaggaagaaggtattttaatttgggggttagttcggtcccatcttcagggtcttcttttcctttgttgccttgctagcagatgtttcggctgactttctgtaatggtccttgtctggatttttctctttcaaggaggttaggccttctgaactgtattatttcaggtcatacactgcataattccaggatatcttataacttttgctggatgccaagtaaggactcctgtttcatacacatctaataatctaataatacacatcaggattccctcttgtgtttggatgaggtgcctttattagcatgggtaattggcaagataggggcgtctggttctgggaggcgcttggagacaggtaaaagtagaaggccagctttgtcagctttctctaaaaattatatttttcacatgtggatctttgccattgcagcaagagctttcgaaaagatcattcttcttatatttgcgcaactcctttctctgaagaacgcaaagcacttatatactttattcaaaatacttcagcaagtcctggagggcggataagaggaagcagccagctggtctgtagttcagggaattgaggcccaaacggggttggtgagcagaactagacatcaaaatcaagagtctgtgcatggagtgagggtattaaaaaccttgcgatcagtttctcatagggctgccttccttgagggtctcttccaggaaacttgtgtcagcatctaaatatgcgaacaaagcttttggggaacattgtttaggacaagctccctggaggtatagttgtgaattcccctaggaaagtgtatctctctgcctttcaaattgttacaggattgctattaaatatgtttctaaagtaacttcttttgcccatatctttttcatccctcattgggagcaaatcttaccttctcagggatgaggtgaccctaaatcaaaataatagcctttggatttaaagattttgcctgccgtggtgtgaaaacacttttctataggccgtttaactttcagagtatgtgtatacaaatcaatatatttgtctctgttcgttaatgtaaagctatttgtatctgagtacaatacaatttcctaatatggttcacagtgatgaatgctttttttctctccttaaagaaactagtccaattatttcttttaattggggacagtgtgtggaggacttctatacattgaactttctgtctttctctctcttatgttcacagggtttaatctttccctgtgagagtgaatattttttttcctttcctcttctctccctttctcaaatcttacaaattaagacaaaagataattacttggaggagtaaaactggcaggttcccacgacacttaaaattaatgagctgttgagtacaaaatataccttgtctttggctctgtcggtgttgcccagtcctccccctgccccctttacttcccgtttaacacatgatttgactttctggctatgtttgccatttgggtatatcgctgctctaaaacagcatgatggttacaaaaagtgggtttggttggaaaccttctctttgtttgcaaatgaaagttaatttgattcagtttttaatttccgtatgtttgaaaactcttccatttccagatatctcatcaaaatattctttagtagagtaccttgctgaagtcttcagggcagccagtttatggttcactatgttaatttcacctgcctccctctcgtctccgtttcccctttcctataatcctggtactcaccgctttgctgtccatagtattttcctgagcagtaggttttgtgacctcaaaatacaatcaaagagttgtgcatctggtttcaggtacggatactgcaatgaaggatctgtttttttcagataagaaagatactgctgactaaccacagtcacactcttcaagtgtctgtgaaagtcccagcttagcaactggccttgccctgccaagtgatttatcaccgaacaggtgactcctgtcagtttttatgtgacacatcaagcttcttgaaatcatcatgtaaggagtaatggaacagatgatctggccccagggtttcaggcattttgaattccagacccctttctacttttagaagttattgagggaccccaaaaggcttttattaatgtggattatatttattaatatcagctttaattctcatatctaccatattagaattaaaagttaagacactttaagatatttattcatttaaaaaatgacacaaaccagttacgtgttaaacac

SEQ ID NO: 119741 - DNA, 1001 bp, Homo sapiens
agctgtgttcactgctttagaaaattggtgaacagtcaagaattgcctagattcatgttcccttggcttgatttttaatcacattgaagtatgacttcttacggatgttgcttttaatttgtcttgaaagctagcacagatactgccagcttgggcatgattgatggtttctgacaatgggtagttacttagaataaatgccagccatttgaaactctccattttctgtgttaactgagagtatccagtagaatcttgtgcaacgtcggattgtatcccatattttgacgtggcctggtctttccttcagtattttaaaatctattaatcactggtgttggaaggaactttgagataaaggctcacaaccgataatccagatggggataatggagatctccatcttataccatgacaattggactaaagaattaaatccaagcagtttaattagaaaacaattagaaggaaacttagaagattattttaccgtttgaaagcatgggtggtggaatggagaaatgttgatgaaagggtgcatgcaaagttggtttgaagggagagagaaaatctggagatctactggacagccttgtgactagtcactaataatgtagtgtatactcaagttgcttatcttacatattcttagcacaaaagtatataaggggattgggtgtggtaattagcttgattaatcactttatacatgtattaaaacatgtcatactgtaaacgtaccattttaattgttatactttcataaaactgggagaagatatacggaagggtaggttaagcacgaaagcaagaaacaaagaaatttgttagcagatttggcaccacagcaaatgaaaaagtaaacggcaaaagaggacagtatttgcaatttataagacattaatataatttaaaggactcttaaaattccatgtgagattgaatgttggggaaaagggagttttcagaaaggacagacaggtaagatgtttagaggagga

SEQ ID NO: 119742 - DNA, 1674 bp, Homo sapiens
ttcttggaacagggatatgtgtgtgtgtctgtctccacttcccccaaggaagcaggatcttgctgtcatcaactctgagaagctcaggacaggtgattgcatggcacgtggggaggtcttcattgtgaaacaccaaatttcctggaagagcaatgggaacgtgaaaatgcacccaggaaaccccgctaggaagcgcctggggcagtttgcatacttctgtgacgaaggataggtatatagtggattctgaaagtggacatcgctgcttaattcttggatgtgtattttgcttctctttgctggtatttccacatctcttcttatcacactacaggctgctggctctgttcatccccagcatccagggtcctttctcacgggtgggccggtcattttagtggcaggtactaattctgcgtttttttccacctctgcttctgctgctccacaggtttctaaggtaaacggagtcactcgaatgtcatctctgggtgcaggtgtaaccagtgccaaaaagatgcgcgaggtcagaccttcaccatccaaaactgtgaagtacactgccacggtgacgaagggggctgtcacatacaccaaagccaagagagaactggtcaaggacaccaaacccaatcaccacaagcccagttccgctgtcaaccacacaatctcagggaaaactgaaagtagcaatgcaaaaacccgcaaacaggtgctatccctcgggggggcgtccaagtccactgggcccgccgtcaatggcctcaaggtcagtggcaggttgaacccaaagtcatgcactaaggaggtgggggggcggcagctgcgggagggcctgcagctgcgggaggggctgcggaactccaagaggagactggaagaggcacaccaggcggagaagccgcagtcgccccccaagaagatgaaaggggcggctggccccgccgaaggccctggcaagaaggccccggccgagagaggtctgctgaacggacacgtgaagaaggaagtgccggagcgcagtctggagaggaatcggccgaagcgggccacggccgggaagagcacgccaggcagacaagcacatggcaaggcggacagcgcctcctgtgaaaatcgttctacctcgcaaccggagtccgtgcacaagccgcaggactcgggcaaggccgagaagggcggcggcaaggccgggtgggcggccatggacgagatccccgtcctcaggccctccgccaaggagttccacgatccgctcatctacatcgagtcggtccgcgctcaggtggagaagttcgggatgtgcagggtgatcccccctccggactggcggcccgagtgcaagctcaacgatgagatgcggtttgtcacgcagattcagcacatccacaagctgggccggcgctggggccccaacgtgcagcggctggcctgcatcaagaagcacctcaaatctcagggcatcaccatggacgagctcccgctcataggtaggtctgggcggggggtcagggggtggtgcctgccctcctgcccccagatccctgcagttccctcacagtcttcacgttctcttcccttgcgaaagctccagttccgcttccctgtctcgggagtagtgggcttctcagctcattccccctgcagcccttcttcccaggtcctgggcgttgg

SEQ ID NO: 119743 - DNA, 1005 bp, Homo sapiens
ccggcccagcttgtggatgtgctgaatctgcgtgacaaaccgcatctcatcgttgagcttgcactcgggccgccagtccggaggggggatcaccctgcacatcccgaacttctccacctgagcgcggaccgactcgatgtagatgagcggatcgtggaactccttggcggagggcctgaggacggggatctcgtccatggccgcccacccggccttgccgccgcccttctcggccttgcccgagtcctgcggcttgtgcacggactccggttgcgaggtagaacgattttcacaggaggcgctgtccgccttgccatgtgcttgtctgcctggcgtgctcttcccggccgtggcccgcttcggccgattcctctccagactgcgctccggcacttccttcttcacgtgtccgttcagcagacctctctcggccggggccttcttgccagggccttcggcggggccagccgcccctttcatcttcttggggggcgactgcggcttctccgcctggtgtgcctcttccagtctcctcttggagttccgcagcccctcccgcagctgcaggccctcccgcagctgccgcccccccacctccttagtgcatgactttgggttcaacctgccactgaccttgaggccattgacggcgggcccagtggacttggacgcccccccgagggatagcacctgtttgcgggtttttgcattgctactttcagttttccctgagattgtgtggttgacagcggaactgggcttgtggtgattgggtttggtgtccttgaccagttctctcttggctttggtgtatgtgacagcccccttcgtcaccgtggcagtgtacttcacagttttggatggtgaaggtctgacctcgcgcatctttttggcactggttacacctgcacccagagatgacattcgagtgactccgtttaccttagaaacctgtggagcagcagaagcagaggtggaaaaaaacgcagaattagtacctgccac

SEQ ID NO: 119744 - DNA, 1496 bp, Homo sapiens
gctattctaggtgacgctgggccgtgggtgcagccaggacccctacccactcctcaccagggagctagtcttctcatgacacccgcctccatgtgacaacacatgtaccagtacatggtacactgggatgttcctccctgtatgtctgtctggccagctcgcatccttttccagccaagccccagcttaaatgctgcctcctcagacgctccccacctaaaatggtagtccctcgttccacctgctcttcgtagcaagtggtcatgacccatcattttgtaacgcccttctctctgtggaccgggagtctgctgttcaccactctcaccccagagcctgtcagagtcctggctcatagtaggagttcaagaagtacaggttgaatgaggaacatcttgttcgtgtctctttcactaactgtcccgtttttttccccttcgctgtcccagggggctgtgagctcgacctggcctgctttttccggctgattaatgagatgggcggcatgcagcaagtgactgacctcaaaaaatggaacaaactagcagacatgctgcgcatccccagaactgcccaggaccggctggccaagctgcaggaggcctactgccagtacctactctcctacgactccctgtccccagaggagcaccggcggctggagaaggaggtgctgatggagaaggagatcctggagaagcgcaaggggccgctggaaggccacacagagaacgaccaccacaagttccaccctctgccccgcttcgagcccaagaatgggctcatccacggcgtggcccccaggaacggcttccgcagcaagctcaaggaggtgggccaggcccagttgaagactggccggcggcgactcttcgctcaggaaaaagaagtggtcaaggaagaggaggaggacaaaggcgtcctcaatgacttccacaagtgcatctataaggtaggggcctccgcagagcagccactcccagctgcaggagtgcgggaggaatgagagaggaagtggagcgtgctatgcactggacggtgtgttctctgattccctggggtgatgagggggcgggccactgtgctgggtgatagcgctgtattagtcctctcgtgttgctgaaatactacagactggggaattcataataaacagaaatgtactggctcctggttgtggagcctgggaagtccaatatcgaggaacctagtgagggccttgtgggtgcgttgatggggcagcaggagacccagtgagggaggggaagtccactccacgaagataccacgagtccattccgcctgcctagggcctcgggtttccttttcattaactggcttgcgtgtgcgtgttgcatgcacgtgcacacatctccatatgccagggataagtaactgggctgcatgcttcgtttcccctgcttctccagttccgtttcatcctggtgctcgacagctgcccagatccagctgaacttctcactggctggaccgtc

SEQ ID NO: 119745 - DNA, 1083 bp, Homo sapiens
caggtgttaatatggcaaggactctcagggtgtagatgtcgcaccagtttctgtctctccagcttctctcctgtgggatccctggtcacgagttccatcaggtcatagctgctgatagcttctccgctggcccgcagcagcctttgtcagctgagggattctgcctccagcacaagctgctttttcagcagagccttggaggggccttccgcgcttctgctgtgcgtccgctcagggcctctgggcggcagcctctgttcctggcagaacaatttggccctcatggggttgatccttggtggagtcttcccactcctcttggcactgcgggttcttagagaatatatttcttccttctctgcctgtcattaactcagaatacaaggtggcccacagccgcagggacgccaaggggcagcggcccatgacaggtgtctggcctcatttgcagtagggttcagctttgcttctgaagctttactgttttttgttttgtttcagggaaggtctgtttctctaacaactttttatcgaacagcgaggaatatcatgagcatgtgtttcagcaaggagcctgccccagccgaaatcgaggtgagagaaggggcccctcacgctgcctctcatggtgtgggaacccctcggcgagctggaggacatcctgtcctgccctgacccctgcagctcggtgaacggaaaggactcagatggggctgagttcgtcctctgtgttgagcgtgcaccagggcagccaaatgttttaacttaggttgatctaaacttgttcacaagccaaaaacactataatgaaggtggggagctgccgagtgcaggggacgggttctgggcacgtcccctgctccccgtcactgtctcctcctgcttgctcacccggctgtttctcaccccatcctctgtgtgtctgttatgcaagagaatgtttggaatcccttgaaaccacagttgtgctttttcttctcttctattttttatttaatgggattggcagattgccatttttgtgcttctgccaactctcttctttgagttagtatgaggttggaaagacagtgagcacttctg

SEQ ID NO: 119746 - DNA, 1788 bp, Homo sapiens
gcatgttctgacccattctttgcccccatatttgtttagatgggacatattaaaagtcacttcggaagctttatataattggcggttaccgtgcttagcataatgtcctccaggttcatctatgttgtagcatgtgtcagaactgacatccttttacaagttgagtaataggccatggtatggacggagtagattttgttcatccatctgtggatgggatactttggtggcttcaccttttggctgttgggaataacactgcataacatgggtgagaccctgctttctggcattctgaggatatgcctggaggtgacctgtcattgctttctgcattagcgtcctgctggagacactctgcaaagagagcgtctgttctgaggggtgtgtgcaccaggcattcgtgtcccagttttgttgggttgaactgtgctctgtggctgcagcaccttaggggtgctgaccagccctttcctgttccctgcagcaagagtactggaggctagtggaagagaaggactgccacgtggcagtgcactgcggcaaggtggacaccaacactcacggcagtggattcccagtaggaaaatcagaacccttttcgaggtaacctgggattctctcgtccaggttcttggggatgtgactgcatcctttccccgccagtttgtaacgtccctcgtcttcccctttgcaggcatggatggaacctcaccgtcctccccaataacacagggtccatcctgcgtcacctcggtgctgtgcctggtaagcctgactgtggccgcctgcctgtggcagctgtgtccatgagtcctacttgctgagaaccagggctgggaaatcccttctaagcactgccggggagggatggcgtcttcaggcttacaggacatacagtgaaaattgatttttagaaaagaaaggagtaacataatgattggtgaagtcagtagaaaaggtggaaaggtgaaccgcatggcagagtctggagctgggagaagcttaggggccaactttgaaccttgaaattgctgctttcaaagctgaagtcacaattccttaaggctactgcaggcttgaaatcatgaattctcaggatggtcagtaggctcgtaagggacggatggatgctttgcaaacttcagggaaagccaaggggtcatggaggttgtggtcaccatgaatgtgaaggcccaggccttggcgaaagtggctaggaacctgtccgggtcctggaacctgactcatttctgagctgagccaaggagccctgtgccctactcaccctgctcagaggccttaccaacaaaggggctttcttgctttctgcctctggccctgatgggggtttttgggtttggcgcctctggtcctcagccttgaggcttgggggcttcggcccgtgggcggccggttcctcggcattcctcaccaggtcaggttcctgcggccacctccctcatgaggccgacgtgctcctgatgttttgaagcggtgttcatattctcccacttctgtagagcaagcaggaaagagtaggtaccttctgctcactgtcttttgtctggctttgagtcccatttcttttccttcttgttttagcggaagaaagagatttttacttactgttcctttgagaccttgttgcctagcttttaaaaatgcccttttcactctttctgttttaggagtgactattccctggctaaatattggcatggtcttttctacctcatgctggtctcgagaccaaaatcaccttccatacattgactacttacacac

SEQ ID NO: 119747 - DNA, 1116 bp, Homo sapiens
tcgtttaccggcatgctgttcatgccatgctgactgtgtttattgccctaatggggtgattaaacattctttattaaaataaacaaagtcttaggactcgtgttctccctctttggagccagcgtcggctgcagcctcctcattttggctgttctggtgagtggtgctgtggacatgagggagccctcccttcccacatgggtctgtgtgccatggacggtgatcatggtgtcctgcagtgggtccagagtgatgggcccgggaagcccaggctgttgcctgtggagcggggactgacaggagccttggggcttagccgggccaggccaccagctggggaggggacagccaggactattccgagaggtgcctttgcctccggaagaagagcgtggccatttcctgtggaggagttacactggctgtggcatggcctgtgttctggggtcatccccaggccagtgacctcaggcccgagtttcttccgtgtgggtttgcttatggcttgacgttgagtcacagatagcaaaatgtgataccctgtgtgggctttttgaagactcactcctggaacctcattgacaggagagaaagaaaaggcagggataggatcagagaacatgatggtgtgtagtttttcttaaaacatgtgatttaggttagaaaccctgtatttaaattaccaatcagtaacagaatatgttggcattgaaaataacatgagcattaaaaaaaatacttccttcactgagcaactgaaaccaggatttggcctcagagagaaatgctttcatcacagacacataggggctgcagagttgctgcccgcctggacctggggggcgggggctgtggggaggggctggcggtgttgccctgagctgctggcccacatctttgtgtttaatggtggttgatggcttcactggcttagcatcctgaagacctgtcaggcccctctccacactgatgtcctcctcttgcctggggaggagcccctcagacagcctgagacacccaggggcagggcagccatccctgcacccctgccttgcggggggcctcccctcacatccccctcattcatgctgtgagcctgacaccaggggcgtcaca

SEQ ID NO: 119748 - DNA, 2638 bp, Homo sapiens
catttgtagagggcagggtttactgttcctgtctggagggccgagggagccacgtattccttgtgaggacattatcaggtgctgctcctgcagtggcctctgttaacagaaggagggtgcagtgctggagcctcagaagaggctcgtggaggccgcagtgtgtctggttctgatttctaggggtttgtgaacatctgtttgtggtttgaaggctttttggctcaccaggtgggtcagatctccataaaagatgagcatctcgcaacgcggatgcactgtggtttggctgtgtgctaggtggacgtggcactgctgccatgggaaatgggagccagcagtgaccaggcacccagccaggccagtgcgccatccctgccggcgtggagcagagcctctcgtgtgctcgggtccctgagggtgacgggggtggcccagtacatgcaggaggcccttgtcaagtctctgcttgtctcttgtgtctctcaatgacccaggtattgcattcctgctgaggaggagaacaagctggaagatgtggtccacaccctgctgcaagccaatggcaccccagggctgcagatgctggaaagcaacgtcatggtgcgtccactcagccaccgcctccagcaggagctgtaggacctcctaggcacttgaacatggtttcccatgaacccgcctttcaaaggcaatgaggacacagcaaaacaaatccccagggtgcaaagggaaaggtcctctgacacaaaagccaaactgaccttccatcagattgcacagggcgctggggttttgcacggcctttgcatctgttttggggcttgtttgtgttgtgggctgctgtgggccctgggatttcttgtgcccgccgctcctaccttctgggcatgtgagaggaatgagcacaaaggcttcttcacctgttttcaggaagtcatggggctggtgagttcctgggaagtgctgctttgagctgagttctgaccagcttctctggcctctgctgaccctgccggtcccgcctgtccatcttagagaagagatggacgggggactcctttgtaagcccagcctgtgggcctgtggcctacttggctctggagatgagcccggcagcctcctggttgtgtaaccttgtcctgtttccagccctggcattgccacgtggggacagaggggcctgtgtggtcatcatgtcctcagctgtgcatgaacctgtcatcactcttggaccagtgcagtttagaagctccttcttgtgttatgaatgacgtctttttattttccacataaaacaatcttatctccttgagagcaggcctcttagggtgcgcatacgtcacctgaagactgcaggtgtccctgcgcacagggaggggtgcctcagcctggccctgtctccccagatctccccggaggtgctgtgcaaagaggggatcaaggtgcacaggaccgtgcagcagagtggccagtttgtcgtctgcttcccgggatcctttgtgtccaaagtgtgctgtgggtacagcgtgtctgaaaccgtgcactttgctaccacccagtggacaagtatgggctttgagaccgccaaggtgagcagagccggcctcctcccgcttgctgcccccgcatccctgtgagtgccgtgcgtgagcgcacacagaagcatccctgcgtgtgcgtgtctatttgtcaatagttccttttggaatatgtctttgaaattcttaagacgtggttgaaaggtcttctaggaatgaaaagttgttagggatttgtttgtatcacaaagagttttgatcagaccgttactgacagacccctccagtattggaaaactgttgaagatgctcaaggtaattgcttagaatggacagagaacctccacccatcgtgagggagtggcagctgcctctgggtagcggcgaagtgctatgacttttcctggtatgtggtgcctttctcacagggaggcaaagttttgaagagtttttaatctaaatgcaattcaagatttagaaattcagacagcctgcctgccccctccaccaagaagaaccttgacagctgcctagtaatgaaaatccaccctaaagggatgtgactcctctttcaggaaatgaagcgtcgccatatagctaagccattctccatggagaagttactctaccagattgcacaagcagaagcaaaaaaagaaaacggtcccactctcagtaccatctcagccctcctggatgagctcaggtaacagacccccagagcccacgccagagagctggacccggctgcccttcgggggctcaccccccgagcaggcctcacttcctgacaggagggtgtgtctgcagggaggccggtgtggggtgcgtgtgtcccctctgctggtgagcatggcaggccgtcactaaaggtgcgggccgtctcccgtgtctggcagggatacagagctgcggcagcgcaggcagctgttcgaggctggcctccactcctccgcacgctatggcagccacgatggcagcagcacggtggcggacgggaagaaaaagcctcgaaagtggctgcagttggagacgtcagagaggaggtgtcagatctgccagcacctgtgctacctgtccatggtgagcccgcctggccc

SEQ ID NO: 119749 - DNA, 1041 bp, Homo sapiens
tccgccaccgtgctgctgccatcgtggctgccatagcgtgcggaggagtggaggccagcctcgaacagctgcctgcgctgccgcagctctgtatccctgccagacacgggagacggcccgcacctttagtgacggcctgccatgctcaccagcagaggggacacacgcaccccacaccggcctccctgcagacacaccctcctgtcaggaagtgaggcctgctcggggggtgagcccccgaagggcagccgggtccagctctctggcgtgggctctgggggtctgttacctgagctcatccaggagggctgagatggtactgagagtgggaccgttttctttttttgcttctgcttgtgcaatctggtagagtaacttctccatggagaatggcttagctatatggcgacgcttcatttcctgaaagaggagtcacatccctttagggtggattttcattactaggcagctgtcaaggttcttcttggtggagggggcaggcaggctgtctgaatttctaaatcttgaattgcatttagattaaaaactcttcaaaactttgcctccctgtgagaaaggcaccacataccaggaaaagtcatagcacttcgccgctacccagaggcagctgccactccctcacgatgggtggaggttctctgtccattctaagcaattaccttgagcatcttcaacagttttccaatactggaggggtctgtcagtaacggtctgatcaaaactctttgtgatacaaacaaatccctaacaacttttcattcctagaagacctttcaaccacgtcttaagaatttcaaagacatattccaaaaggaactattgacaaatagacacgcacacgcagggatgcttctgtgtgcgctcacgcacggcactcacagggatgcgggggcagcaagcgggaggaggccggctctgctcaccttggcggtctcaaagcccatacttgtccactgggtggtagcaaagtgcacggtttcagacacgctgtacccacagcacactttggacacaaaggat

SEQ ID NO: 119750 - DNA, 1015 bp, Homo sapiens
ggtggccgcctaagttggagtcctccatgttccacatctattccagcactagggtggtttcaaacacaggatctcaggagccctcagaactcaagagatgagaaatacgcacccctcactgtctttagcagcctggtggtgactgaacctctcccaggaaactccagcagaaatctggaggggacttgagggccactcccaggtctaactcagaggtggtcagttactcaccttcctagttgaagaccatgttccaggtgtttggtcagttttcgttttagtccatttccagcatttccagtcctcaaagcccttggcccgggtggtgggtgctggggctactctggcgcgggcagtgggtgtggtggctgcccggccgggcgtgctcctaccttaccctcccagggcgctgtggagctgcctcctgaccttcgggtgtcctgctcttgcttgcaggtggtacaagagaacgaaaacgtcgtgttctgtctggagtgtgctctgcgccacgtggagaaacagaagtcctgccgagggctgaagttgatgtaccgctacgatgaggtcagtccctgcccgcggggtagggcagggcggcagcgtggcgccttccctgctcccggctggatgtaggcactccggcctggcagttctgtgcctggcgggtagtcagggctctgcaggcctgaggtgccctgttcttaggccctaaacccattcaggccccatgttaggatcccagggggagcggggttcctgcacgggcatttggatttgagcaatgggctcttaacagggctgaggctcttcctgcagccgcccccccggctttcccaagggctgcaccactgtggtttagacccagacccttttttgtgacctgtcccaggcacagtgggatggttggcagtggcctctccaatctgcactaacttgacaccagccccttcaggctgagagagctggaagtgtctgcggacactggggcaggacgggccccatgatgtgaaatccc

SEQ ID NO: 119751 - DNA, 2725 bp, Homo sapiens
acaaacacagtttttggtgccgacagataaatgattctcttgagtgaattacaaggatatgtataggttgagaagtgtttgcatttacttgcatggccaggttcagtggccggtagctaaagtgagtcaagtagcttgggtatttgtgtcaccatccaggatgtaacaaagcccctgggtctctttgctgagtgctccgtggtagaggcagtgctctgggctcccctgccagccctgcccttatgagcaggcaaagcatggtggaccagggtgttgatgaggatgaaacggccatgcctgctatgtggcatcaggaggagctgggaaagggagactcactgcatctgagcctctcggggttattttaaaacctgttggttggtgtggtgaaggggaccgctgccctctgccctaaacttgcccctgcatggctctcagggacagagctcttgttaatacggtatgttaactgtgtcttcctttcacccccaaacaggaacagattatcagtctggtcaatcagatctgcggcaaagtgtctggtaaaaacggcagcattgagaactgtctcagtaaacccacaccaaaaagaggtccccgcaagagagcgacagtggacgtgcccccctcccgtctgtcagcctccagttcatccaaaagtgcttcgagctcatcatgaagatgccaacgcccgtggtcgatttatatatatttttttgtaattattatattctagtttggagtacttgctgtaggattcaagctgtctttgcactagctctaaagaagattttcttctggttttagagaactaattttgttttagcattaaactgttgaacttttttttgtacttagaaaacctagatactgcagtcagattttggaaactgccgtatagtcactgttttaaaaaccccggaggggctgtattaatttgtattgccccatggctgacaaaagcctttttttttggttttgatttttttttttttgtaactgttggggggaaaaaggctttttaacccatttttgaagagggtgaagtttggagaacaaatttaaaaaccatcagtcatgtgagcagattttttagaagggataggagacacacgcgcacacacacacacacacgaaacttgaaatggctttgctttggctgtcgtcttctgccgtgtgccagatgagcttgtgatctgggaagccggggcacccccgttttgtttctctgggcggttgtggcagctgaaggcggacgttgtttcctaaccataggtggaacgaggagacgggagcgagtgggctctccaccagcacatcactatgcatctgttccaggaaagaagaaaagcgagcgaggaagacggaaaagactgcctgccttggaggggtcacatgagggagacctgtgcctgatttcattaggaaatccattctgttattttttggtgctgttggctactttatcaaaaaacccttcaatagcatccttaagatttaaaaaaaaaaaaaaaaaaaaggaaaaaaaagtgatggaagccgtaagtgcttctttgtcatcgacgtgcaatctttctaacattccatctccatctcaccgcttcttgtttgacaccttcacaagtcagcattaatctttcttttaaaacttgtttcatttatgatcatgtagagagccactaggaggcctgcagttatttttgaatgtgaaaatgcatttgcgttcatcttgtctattttttctcttcatgttgtaacaaaaaggaaaaaagaaaaaaaaatcccatcccttttgtacatatgcctgtaaattgttttaaatacttgagcctttttctcggtggggggtggggaggggggtgagaagacaagatgaagaaaagccttacatttcagtttcttcatcggttggattggatgcttacagggtttttcttgtaacatttataagtgctgcttacatcactgaacaacaacaaaaaaataataatggagtagctgttgcccttctccggttgtgtgtacagtatgtgtggaataaaaaagggaaactgttttcacaagctgttctttgtttcataattggattcatcaatcccgtagctacccatattgcactgagcttgccagtggtgactgccaggaacgtcctatgatccactttgttggttgttgttgcagaagactgaactgttttggaatatttaacaattacagaaacagtcaagtgttttccaatgtggttgtccggtttctatggccttgctgtgtactttccctctttttgacagtaaacttctgcctatggcttacagtttgacatttaatttattagcgctgctctgcacccctcccttgggagggagacttcatgtggtttattgcgagttttttgtttacttttcaggtttgtactacaaggtttaataataaaaacaaagttttttggacatttgtctgtcttgtggaagatgactgaatggaatgagctctttcttttctcgtccacgggcagggggcagaggattccccccagccagggagcagagccaccccccacactgcagtcctgctcccacctgccactgggtccccttcagcctaacctaatggtttccatgtggcctgcggccgtccccctcatttcccatcgagctgcgcccccctgctgagcttgctttcatgatgagacgacactgggtgcattcagggtggtatggctgca

SEQ ID NO: 119752 - DNA, 1114 bp, Homo sapiens
cggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaactgagagcgcacagagctagtttgtacacaaaggcttctaaatacacatgtccttaaggccactgtaactcagggttccttagagtgaagggacgtgcaggtcattgagggccaccccgggaggttgcatgtgggcagggcctgggccaggtggtggaggctccacagggctgagttctgcatgaggcagggaatgacctaccgtttcacaagtggaaaatgccacttcctgtagaagagctgactgtagccaaaccactctggcaaagcttggggttttccgttgatcattacagaagtaagtaagtatcattagtccagtagccagccagtccaacccctactttttcacactcctgggcccaaaagaacagaaacaagcccaaagcaatcctccattctttatgaaaagaaactggtcccctggagatgtgttcctgccatcactcctccagcccaatgagagagaggggacagactccccgccgggatgagggggtctgtctgtctgcagccataccaccctgaatgcacccagtgtcgtctcatcatgaaagcaagctcagcaggggggcgcagctcgatgggaaatgagggggacggccgcaggccacatggaaaccattaggttaggctgaaggggacccagtggcaggtgggagcaggactgcagtgtggggggtggctctgctccctggctggggggaatcctctgccccctgcccgtggacgagaaaagaaagagctcattccattcagtcatcttccacaagacagacaaatgtccaaaaaactttgtttttattattaaaccttgtagtacaaacctgaaaagtaaacaaaaaactcgcaataaaccacatgaagtctccctcccaagggaggggtgcagagcagcgctaataaattaaatgtca

SEQ ID NO: 119753 - DNA, 1058 bp, Homo sapiens
caactgctatttctgatttagtggaatgagtccaaaacaccatgttcgctgtagagtttttaaaattttgattgattctcctaaattaatactaatccttggagatgaagattcctccctaagaaaggtgctgtggctcatcaggctgggaagtctgagccggctctgcacagacgtgcgatgagatgcccgattcccgtgtgtggctgtctctcagctctagctcaagagaaagctaaaaagcccagggccgccaattttcttcttcaaagctttcaaaaccatatattggcgacatgtgcctgatttttaccttaaaaaaatgagcccagcattttcttgaaacttaatctttgagatactcaaaaccacaaaaatttaaccacttcatatttccttgcaggtatttccagcaggtatctgctagacgcgttctctctgccagcccgctgacttgctagctgtggagcaactgcagtacgtgcccgtccctgtcaccaggggctggccatcaacagaagctgctccttccaagccggccacgcgtctactacttcatcatcctctcgggggtgcatccacggctctccctacaatgggagcttcctgagaggcactttcatttctctgtgcttcctctgggctcaccagcaagtgctaaactgaaggaagatagagttaaattgtttagcaatcagagtttctatgactgtccatcatcactgcatctcttctatgacatgagacattggtgcgatgtgtcattatgttcaaatgtgtgggtcggccagggtgtatctgtatggactgaatgtgtccccataaaatttgtatgttgaagccctaacccccaatatgaggatatttggagctggggcctttgggaggtaattaagttagatgaggtcagatggacatggcccctgtggttgagattagccctaataccaagagatagcagagagctccaccctactgttggccacgtgcacacatagggagaagggggccgtctataagcaaggaagagagccctcatcagaaaccgatcgcgccag

SEQ ID NO: 119754 - DNA, 1044 bp, Homo sapiens
gccaaggcaggcggatcacgaggtcaggagatcgagaccatcttgtctaacatggtgaaaccctgtctctactaaaaatacaaaaaaattagctggcagtggcagcatgcacctgtagtcccagctactcgggaggctgaggcaggagaatggcgtgaacctgggaggcagagcttgcagtgagccgagatcgcgccactgcactccagcctggacgacagagcaagactccatgtcaaaaaagaaaaaagtcattttaagtttcctaatctaacccctcctcccttgtgaaggtcgagacatgattggatttcattctgatgtagaaaaaactgagataaactgaagggccaataattcagcaacacgagagaatcaaacttttaaagcagaagtagtcttgagaaaaatgttttttatgttatatatctacagaaaatcttaattctgttaaaacaagatattctttaattaaaacccctttgatgatttctgcattgatctttggttttgagctgcctattctggaattatttttcaaaagaagattagctgaactttgaagcagttgaagcatacttaatgtattttagggttgacttattctaatgcacttggcagccatgaatcatttgaacagatatgttgacaactgaagtgaaacaaatgaaaagacatcctcttcagttcatttttttttcttacgagtacactctaaattccttgcagatttattaagagtactgaaaggtaactaattcttaagcatctgagtggggcccagagcaggtgattttcagtgcatagtgagtcctggttcttggtaatatttggtgttgctccctcttcaagaggctgttgtttaaataatgctggtattaatattagctgccagctattggccaacattgtatgcttggtgattcgtatttgctacctcatttaatcctgccaacaaccttacgaaataggtgtttttaccgcacttgtatggaggagaagttgcaactctggtgaaatcagttatgtggaaaaagagtctga

SEQ ID NO: 119755 - DNA, 1112 bp, Homo sapiens
gggcagaatgaaaaaaagttgacaatgcatagaaatctaggaagcaccaacattcaccagacaggcacgagaagagagctagttgcccatagtggaggcaaagaggaaaatgtgataaggagaacatttcaaggacatgtcaagaagcagtgtcatattgttgtggagaaggcaaactgaaatatagcctgagaagctaattggtgatcttaatgaggacactttcagcagcatgggtttgtgtgtgggggtgctgggggtagaaaccagatggcagaggattggaatgagtggactgttctgccttgttcaccattgtgactcaggtgcttggcactttggtgcttattaaatatttaaatgaatgagggagtagagacaatgctttcaaaagctaaggctaaaggaaggaaagaagaatagttagaggagagagttaggttgaagggaggatttttttttttaattttgggaggaagttgagtatatttgtatgaaaaaggaacagaagctatagagagggagaggttgaagatacagtgagagtggctgattgatggagctgtgattcagaggggaccagcgggagtgggatttagaccatactattttcaaaaaggaaaaatttgtggagaagtgtttgtaactattagaattgatgacttaagatacttattaaaaatatatagcacattccaagccactggttagtgttgctgaatttgaaaaaacctttaggctaatgctacattaaaaatgaggtaggggaaaattatagatgccttgtgtgttatgaaatgaactatatttttaatttttatgttactactttcaaacagcaagatttcatctctcttttgctgtgttactaaagcatctttgtacctagatgacaaattctgttggatttagttattttcagccttccctcccctccattttgagctgcatttggtatggtcccagaccggtgcatacatctttgcacactagagcccctgagagcttgcattttgcttttatagaggcagtagattccaatgtatatctgcttaagccatcagcaaaaaactaataggcttactacaatttctttggaaaaacctgcttct

SEQ ID NO: 119756 - DNA, 1048 bp, Homo sapiens
ataatctgaattttcagggctaggctcagaagcagaaataaaaaagcaaaacaaatatgctttggttaacacagagttggaaatgggaagacatgtaagatgggccagcaggcatggtaaccatggatgctagtgagactatgattgaaatgattggctgtggagttctgactagagagaggggaggcctgaccagaccagcagaataagcaggctgaatggtacaggtgaggtaccccgtaaaggggaagaacacttttagtggttgaggtggatcttgtggtcaaagaagagatttcagtttgaaatcttagaaggggagcaattcccagtgatgatgatggctaaatttgagtaaaaatagaaggcaccaagtcatctgacttggagacttctgaggctgtgaggagtctcacttgtttggatgactcgtggatgtggcttatgcatattactggcttggcagcccttagcatgttacagatagggatgatgatgctaggtggtaaacttcagtagaatttgttggttcacttcaagagttggcttaacgtgtgagacaaaactattcagctgccattgaacaatacttaagtgactcaggttggatgatgttactgtcctctgtcctcagggagctaaaggactgtggcaaagcttatagattagaaaggcaaatatataatttgaatataatatagaaataatagaaataagtacactaaggtgggagtaattaaccagagagaggtcatgacacttgatctgaatgacgagtactcactgggctagaaaggataacaaagacattccaggaagaggaaagaacagttgtaaagatgcatatatgtttatttcaagaatacaagttaaaatttaatttcttatttattgaaggagccacaaataatttgcctggctgaagcatatggtgtgtggggtgaagtgatgagggatgaagttggacagagaggcaaggaacaactggtacccagccttgaatgccatacacaggaacttggacatttccctttaggccagtggtctt

SEQ ID NO: 119757 - DNA, 1032 bp, Homo sapiens
tttaaaagctaaaaagtatcctttaaaattcttaacattggactagtttggggaaagttaaaacacgattttacctcataatgaacttttaagaatatttcttaattaaaatgaatgggcaaggtacatggcataccacagttaaaatattgtcgaaaaagaaagattgcatcaacattgtataatatgaaaacattgttagagaacaaatccatgattcatttgaagtgtttaacctatgtttttcttagctttttaagtaactaaggtccttgacaaatcaatctttatttacctgacttgatactgtcctctcttgacttcaacaccagtatcccagatgttcttctctgcctcaggttcattttagttttctttgtaaatgttttaatgctggtgttcacttgtgctctggtcttggttgttgcctcctctcattctgcagaccctccttgggcatgctcttctacatccttggctcatctgccagccataaggtgatcattatcaaaccactgtattcagtgcaggtctctcttcttacctgcagaaccagttgccacctacacagctattcctggacttctcaacagcaccatgcccaaaattgtcttccacagcaaaacctgacctttttctgttctaataagataccatcactacagatttatccaggccacaaatatgggagtcttcataatctcctccttcctctcctaccacctgctcagttctcagtccagcccaatatttcctgactctgtccttgcctttctgtcttcactgatcctttccggagttctagcccacgtctttgtagcctgagttacactaatagcctcttaattagtcttgctgtctgtagtcttgtgtcccttcatttatattactgttagagtgctcattttttcccaaatgtagatattaagatttctgatcgtcaagataaaaaaaattaaatgatgatggtgactatagcagtagcctttattgaacacttaatatgtaccagacactgcttaaaaactccaa

SEQ ID NO: 119758 - DNA, 1043 bp, Homo sapiens
tcttcttcaacttctttcattagtgttttatactttgtcttgtagagatctttcatccccttgatctgaaactcctaggctcaagcaatcctcctgcctcagcctcccgaagtgctgagattacaggtgtgagccaccacacctggctctttccttcccttggttaaatttattcttaagtattgtaatattttgtaactattgtaaatgggactgctttcttgatttcttcccccctgcaatttcattgttgttgtatagaaatgctactgatttttgtgtattgattttgtatcctgcaactttactgaatttatttatcaagttctgaaagtttttttggtggcgcttttagagttttctatacataagatcatgtcatctgcaaacagaggcattttgacttcctcctttcctatttggatgtctttatttctttcttgtgcctaattgctctctctaggacttcaaaaaacggcaaaaatttgcattacaataaacctataattgtaagttgaaatttgaggagtttgcctcaaacctaaatgctatgaaagctagtttagaaagtcatgtaaaaagctagtacgtaaatgaaggaattatattgtagccgtttaagtgaacccaagactggaaggctgcacagccaacttgttcttcactgctcccttccccactggatcgctgttacttcctgacttgggagtcatttctggctgagctttccctcatctgtgttagatgccactcctttgagttccttcggcacctcatgccttactctgtcatgctctgttgccattgaaatatacctcccctctcctgtaagctccttgagctccaggactgtctttttcatctttgtatcacagtgactggcacagtgactggcatatgtcagtgaataatagataactagttatgaggctctgagttctcaaatctttgacctcgaaagcttttctttcgtataagaaaacaactaatccttgcccctacaatctcagtttacttagcaccctgtcaattggaaattagtg

SEQ ID NO: 119759 - DNA, 1142 bp, Homo sapiens
tcaatggctccaagctttagttttcttgtctgcaaaatgacgatgagcatacctgtcttgtaggtatttggaggattaaaggagatgacaaacgtaaccacttagcacagtgcctggtacatgctgggcatctgccacgcaccacgcactgcgtacagactctggacacacagcagtgaacaaggctgggcacctgccatcaagatgctgacgttctaatgggggcctctctagcctttgcgaattcacaaaaccattattctgtgacacgagggtttggatggatgttaggcagtttagcttgtgctgcaaaacagtttagaatgcaaaaccacaagattcaatgtggtgatattagtattctgtacattgaaggtgtgtaagcatacaatggaatatttttatccagattctatgcactttcttattctgtgaaaaaccacagtgctttttaatcataaaactggaaaaatatgtttgaaaagtatatactgaattatcttgaacttccactagagggtagtataatcctattcctttattgaagttcaaaatgttaaagccttgtctttgaattttctcttagtttattttatatgacctatttttaaaagactgttcccttcatctagaacagaagattctgggttttgtttttgttttaaaattttaatttttttaagagacagagtctcactctgttgttcaggctgtagcatggtgatgtgatcatagctcactgcagcctcagactattcctggactcaagcgatcttcctgcctcagcctcccaaagctctggcattacaggattgagccactgtacccagccagaagatgctgttaactcttagataagaattcttagatataagagaatagcagccgtatactgagtttgtgtttttcttttggtttgacctagcctgatacagtattattttgcttttttctgtacagaattttagagggcatctaacaaagagattatcatagctctgtcagtttttcatggactagattatcagatgtccaggttcctttctgaggctagacccttcaagaggcacattaattctcttagacaccttttaggctactacatagatctcatttgttccataatggcttttgcaagttaa

SEQ ID NO: 119760 - DNA, 2087 bp, Homo sapiens
atctcctcctgtttttaatattgccttattcaaagcaaaacatgactgatttacaaggcaagtaattggcaagtcataagacagttttttgtgtgtgaacaaaatagatacgtagtatttggagtgctgttgctgataacagtagctaatgtttatagcacctactgtatgtcagagatgattagatgatttacagatactatctgtaattctcacaagaaccccacaaaagtagcttttattattcccaatttacagataaactaaggcttggagaggttgcaacttgctcagaatcataaaatttataaatgcatctaggattccaaccacattgatgatatcctcaatatcagtatgaggcagtaggatgaggtgatgaggcagtgggatgggagctctcagtaggtctctatgaactgtattcttcaagtcccctggctgttgccatgcctttcagggtcagtgttttgttatttctgaaggcagggcatggaaaagagattctgggtcttagaaaagtgtaaaatggctgtgattgccgtctgcattggtttcctcttacaggtatagtaatggtccttcccaagccttggacatagcctttaagatgttcggaacattcttcttagccactttctttcagctcatcttcctgtatctctttgagtcacttgcttttcattggttgtatgtttctttgcagacatgttctcttatgataacctcttttatttccccagctgagagtaaatctgtttacggatagttgttgtttgcttaataccactctattgattaaatgcattctgccacagttctcattattttcatagtcaattctgtttagaaaatgcagtctctataagtctttcatagaatatattgtatgttcgttcccaattaggattctaatatcctgaaaaatgtttgatgtttagtgacacatgaccttattcttcagaaactgcattttggcttcttaaatgcacaaggtaggccttccaaatgttcacttgaatcctctcttttttagtaatctgagaacatctaacactaaagacaaatgaaagctaaaacattatctgatatactgttctggttaatcactgctaaattaatttgagtcatttttttcctctcatctatgtctaaccgatattgagctctttttagagagttagttcagttttttttagaaggtatgtctggatggttgcttttcatatatattgccaatctgaattatctgttagcctttgaaatacatgcttcctttgggttttaatctattgctgttatttgcctgatatttataattagtaatgaatgactgtggaagatagcatatcaaaacttggaattttagagacctagttagtatttgttggcctagaataagcccagagagagttgttttaaaatcatgaggcttttagctaagcaatttaagctttatagaatcattgctgacgatattctttacagtaggaaaacaaacactttgaagccaaatttgatggagtgagttgtgtaaacatgtatctgtaccattaatgtactttatgaattcattttgatgcatttatgtatcagtcttagattttggaaacatttagtgttttaaatgcttactcatttactgggtttttttttttggaagcctcaaaatctctcctattattacccaaataccttgacataatattacaaagcttaaatagttaagcaataataaaaaataaaaacaaacttagaagaaaatggtaaccgattatatttagtcacagggtccccctaacttctttgaacttgttgccctttcactgtcaaatgtaacaccatatcctgtcagtccctccattttccaggctgcttcactcttttggtcttactttgctctctagaggccctgcttttattgaagggcaaaggatttatgttatgtgagcaatttggacttttgatgatgcttttagctgtgttatcccatggcttcattaatatggctcctggtacctagccccttgggaattgttaagttacaacagatgatccattcatattggcttcagtccagcttacag

SEQ ID NO: 119761 - DNA, 1109 bp, Homo sapiens
tattcatgttgatattttcaaaagatcacctcttcttgctccttctaagtctttctaggcccttgtccctcccactatgttaagaccaaaacagaattgtctgggagaaactaatgtctgtcattttctttatagtctttagcaaaagaagttagaattatcttaggctattctagaatttcacaaccttgctattaggaaccctttacatctgctgaattcctcattaacttaaatcatttcctctttttctggaattctggaattggccagtttcctcaaaattcctttatatactttatgcaataagtattcctgtttaaatgtaaattgaaacatggtatattctaaatgtattagggaacttttctttgaagacttcctttcgtaaagccaataattacccgttaattatgttttatgtttgttttctttttggttgttagtggtagttttttgtttttgttttttttttttctagatttagcttttcaaatacatggtctgcttaaaacagggtatacttagaagtgacttctgaagtcatttttaaactttctcttctgtgggttaagatgcactgatacaagcagtaattggaggtttcctgcactgaatattaagttgtttcttttctaaaaatgaaaacaacttcagtctcttttagaatgtaccgtaatctctactgagtagaggggttgttaaagataacattaaatctcattacgttaactgtactttctttgtgcctaaaacctggtttcactttaccccccttcttgtgtgctgcagctggtggatagcgaggtggtcatgctttctgcgcactgggagaagaaaaagacaagcctcgtggagctgcaagagcagctccagcagctcccagctttaatcgcagacttagaatccatgacagcaaatctgagtaagtccaatgttttcattgtacattacttttaggaatgaaaacaacttgggcagggtttggtgtaatttcagagcttttcaggaacacatgaaattctgggttaacaggattttttggaaaatcatgatttcatattttgattagttgaggattccacagaaaatgatgtaaagtgtagaaa

SEQ ID NO: 119762 - DNA, 1049 bp, Homo sapiens
tatgctaattcatacatttctgtggtgctttaaagcaatcgtcctcacctttcctaatagccaatgatgtagacagttggaaattgagttacaagtaaatgaaacgtcatgcaggttccgcacgctgttgaatcaccggcagatctcagcagtcattgtagtactcaatgcatcattctgtttatctacatctttttcttttctttttttctctgagacagggtctcactctgtcacccaggctgcagtgctgtggtatgctcatggctcactgcagcctcaacctcctgggttcaagcaatccacccacctcagccttccaagtagctgggactacaggcatacaccaccacgcctggctaatttgtgtatatttggaagacagggtttcgccatgttgcccaggcttatttacatccttttacactttttgtctaagcagttttgtgagtcacccccctttttcagtaagaagcccccattttagtattttctacaaagctcaaagacataaatatgctggtgtcaaattaaggtgaagtcgttggagctatctaaaaataaaattattgaactttatgacgaatttgaggtttagtgctttgaacttgaaagttgtcattagtagaaaatagttgtcagatggctcacttagtctatatattaatatgctcacacagcacttatgtgttcatggggtgtatggtacttgggagaagaccaagaatagggctgggcaagccttttgtaggcacattgggaacctctgctttatttcaccttagcccagtaatgtagtacattggtttctcggctttcttgatggggatcacctttattataactttcatttgaaattagctctgtagtttccagaatgccattaaggtcatatttggaattttattcaattctcatggcaaatctttatggttgagtataatactaccattttacatttgaggaaactggaatattccccctaggtcagtatttccttcacagcatgtcatgatattgtaggacattaaacagacgttataagtggg

SEQ ID NO: 119763 - DNA, 1971 bp, Homo sapiens
agaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgcagatgtgtgtctttgccttctgttgggtcctcaaggaagaggccaggaaaagagtgctaattcctcctccttattgacccccgctcacgagttctccctgggtaggtcggaggtagggaggtgtgacatgaggcattgccttcgctgctaatgttttggggggaagagtacgtgtgagatgaggttctaagataaaaggcacacagccacacctgatgtcttggtttcttcagttcatgtttatgcctcctagctgaacactgctgttcacaagaggtatacttgtctttaaacatgtggtagcttcatgcgctcgtgtggcataatctatacactccttacagatttgctctaaactggttagtggtctgtaagtggaaaatttatttttacttcctgtaattcaagctcattagaaattcagcgagcagaccgggcacagtggctcacgcccataatcccaacagttggggaggccgaggcacaaggcctgcttgagcccaggagttcgagaccagcctagtcaacatag

SEQ ID NO: 119764 - DNA, 1048 bp, Homo sapiens
caacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcacca

SEQ ID NO: 119765 - DNA, 1084 bp, Homo sapiens
tctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatcc

SEQ ID NO: 119766 - DNA, 1063 bp, Homo sapiens
gaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggt

SEQ ID NO: 119767 - DNA, 1018 bp, Homo sapiens
ttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctct

SEQ ID NO: 119768 - DNA, 1031 bp, Homo sapiens
tccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtg

SEQ ID NO: 119769 - DNA, 1050 bp, Homo sapiens
aagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactg

SEQ ID NO: 119770 - DNA, 1163 bp, Homo sapiens
cctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaata

SEQ ID NO: 119771 - DNA, 1055 bp, Homo sapiens
attaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcag

SEQ ID NO: 119772 - DNA, 1559 bp, Homo sapiens
aggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacct

SEQ ID NO: 119773 - DNA, 1073 bp, Homo sapiens
tactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagaga

SEQ ID NO: 119774 - DNA, 1043 bp, Homo sapiens
gatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatgg

SEQ ID NO: 119775 - DNA, 1047 bp, Homo sapiens
atcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaatta

SEQ ID NO: 119776 - DNA, 1046 bp, Homo sapiens
tgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcat

SEQ ID NO: 119777 - DNA, 1017 bp, Homo sapiens
cattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagtt

SEQ ID NO: 119778 - DNA, 1050 bp, Homo sapiens
actgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagccccc

SEQ ID NO: 119779 - DNA, 1046 bp, Homo sapiens
attctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagag

SEQ ID NO: 119780 - DNA, 1104 bp, Homo sapiens
aaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttca

SEQ ID NO: 119781 - DNA, 1074 bp, Homo sapiens
tggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgct

SEQ ID NO: 119782 - DNA, 1041 bp, Homo sapiens
cggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtt

SEQ ID NO: 119783 - DNA, 1088 bp, Homo sapiens
aacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaata

SEQ ID NO: 119784 - DNA, 1101 bp, Homo sapiens
actgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcag

SEQ ID NO: 119785 - DNA, 1014 bp, Homo sapiens
cactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttg

SEQ ID NO: 119786 - DNA, 1013 bp, Homo sapiens
atgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccag

SEQ ID NO: 119787 - DNA, 1043 bp, Homo sapiens
ctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatg

SEQ ID NO: 119788 - DNA, 1069 bp, Homo sapiens
taggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttt

SEQ ID NO: 119789 - DNA, 1194 bp, Homo sapiens
tttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaa

SEQ ID NO: 119790 - DNA, 1037 bp, Homo sapiens
accgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtctttt

SEQ ID NO: 119791 - DNA, 1094 bp, Homo sapiens
ccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgt

SEQ ID NO: 119792 - DNA, 1094 bp, Homo sapiens
aagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcct

SEQ ID NO: 119793 - DNA, 1234 bp, Homo sapiens
accaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaa

SEQ ID NO: 119794 - DNA, 1052 bp, Homo sapiens
catgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtg

SEQ ID NO: 119795 - DNA, 1083 bp, Homo sapiens
gtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtg

SEQ ID NO: 119796 - DNA, 1413 bp, Homo sapiens
aatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaa

SEQ ID NO: 119797 - DNA, 1060 bp, Homo sapiens
attagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctctt

SEQ ID NO: 119798 - DNA, 1044 bp, Homo sapiens
agagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgtt

SEQ ID NO: 119799 - DNA, 1042 bp, Homo sapiens
tgcatgtgtctttatagcagaatgatttataatcctttgggtctatacccagtaatgggattgctgggtcaaatggtatttctggttctagatccttgaggaatcgccatactgtcttccgcagtggttgaactaatttaccttcccaccaacagcgtaaaagtgttcctgtttctccacagcctcaccagcatctattgtttcctgactttttaataatcaccattctgactagcatgagatggtatctcattgtggttttgattagcttttctctgatgatcagtgatgttgagcttttttcttatgtttcttggccacgtaaatgtcttcttttgagaaaagtctatttcctatttaatcttagattcatgatcttcagaagcccttggatctgggtctctcttgcagaattggaagagaaacactcactaccattatttctgtatttttggcctagtgaggagaactttcagctagcaatcaggaaacctgaaagacccacctcttttattaacatgaaaatgttatccaagtagcattatctcttacttgttttgtgaacttgttgtgaggaatttacaaaaccctttagacaatgtggagttttaacacaatttgaaatcctgaagaaaaaggagccatggaagagacccaaaggcttacattagagggagcaagtgtgctctttcaagtcatgggagggagccactgtggttccaagtaggaaaaactaatctagcatcttcttttaaatgaaaatttctcctatgaaaatctggctttcagcctgatctggaatggtgccagtgagtgggcaggcaaagaaaagacagtgagtggtagctaattaattagtcaatcaaaaagtatttatagttctctaggtatagggcaccatgctggactcagtgggagatgcaaagaagagtaagacccaacctcagcccctgaaaagcttgcagccggtctccttgggaggcgaggtgtacaggtgctgacaggaaagaaagcacaaggcaggtttttaattgggccgtat

SEQ ID NO: 119800 - DNA, 1059 bp, Homo sapiens
cactctggtcaggtgtttgtgtatatcctttgacctttccttgccatcggcttctacttaaataggatgactagagaagatctggggggacaagtttgagctgtgtcatctaacccagtctcttcattctccagctgtgaatctggcttctctttgttcttcactgggttcttagaatatcttctttcctgccatcttgctgtatccccctattctgctggcctcctgaagcaaattccttggtctatccccctggctctgactcattccttaccctgaccttgctgtctgtatttgctttgactaccctatgagtttcctcaacctaattcttaattcctggctgccacctccttgtcaaaacttggctaaatccactttggaatgctaaggcggatgggactgcctgggaagaatttggagaatctgcagctctgctctttcctcattcttgagagccaggctagtggctgagggtatatcgggagacagacagggagagagacagagagagtttggagagaaggcggcatgatcatccgatcatcttgggccccatcagtctccttgggaatgctaacatgtctcctggtatagtctttcttttatttattcttcagtttatcttagaaactgttctgaaagttttaaacccagagacatctctccaacttccttgcatgagctgtattttgaccgccttaggggctgtggcaggatttcagtcttgcttgtggtgattttacatggagtgacatctgagtcgcttttcgactgcattccacaccaatctgtccagccctgcagtttgtgggctgactcctgttgtctttcaacatacggagcactatgagatagtgcgagtttgggtcttgtcagggagtctgattaagccacagtcagagacggcagtcctaagtgtgaaatgtaacaggccttctcaagacagcttcatctgtgagctgctggaggtggctggtgccattctgttgggaatagaggcttgctaacaaagcaaacattttttttttctatcgcaggctaggtctatggtggtaa

SEQ ID NO: 119801 - DNA, 1182 bp, Homo sapiens
gaattagataatgaatggctgcccaaaggaagtgaggtggttatcacaccctggggattcaagagattatctgaggggtaaaggttaataaagaaggataatatcctttgtttgatcaactgttccatactaagttcgttagaattccagactgccttgatggcaaatgctacataaatgataaaactgtgtatgtactaatatttgactagggaattttttattctccatttagttaaatattgaggtcactttgtgtttttaataaaataattatcaacgatctatcattttacactgtgaagctcaatatttgcttgcttagccaccatcaatctgatataaaaagtgtaagagttgcaagtttttctctcatgacctgaatcaaaaagtaatttagaaagaggtcactgtgtcattcaacaaatctttttaaaagccaaacatattttgaccttttatttggatttgctacttgttaattgtttcagcagccttaacttagatcctctttgcagaacatagcttctgtcatctgtacaaagctgtatatgtgaaaattgaaggcaaggagaaggtaattccagctggcattccagtctggatctgctgtcataaattacttagcagagggcatggttcgttactttttatggtcatgttctatatttgtatgtgctggggggtggatcacatgacaaaaccatcatttgatattagtgtttatgtgcaccaaccagtgagggctcgattgaagcttcactgtgcagtacttttaatttgtatatttagctcttaattgaaaatgcaggcacttccataagtactaaaactacaaataatctaaataaattttatataattgtctttaggagaagacaaactgctgtaaaccaagctaattgaaatacactctgccttccagagatttgaaaacaaaattttgaactagctagtcaacattgccagaataataaagaccaaagtttaccattttccattttttagcccctcccctgattagctgatgtctgtttatttaagaggaaagacatttttcaaactaatcaagacagaggaaaaaaacagtctttttttttttttttttttttttttgttctattctccaaatccgttcccctagtgcagcttcatgcttaagtttatagtggcaaacacctc

SEQ ID NO: 119802 - DNA, 1032 bp, Homo sapiens
accttagatcttaagaaagtatatattgtccattgtttataaaatcatttgcctttttgatctaaaaattttaatacttgaatttaacaggtttttcttctggacaagttctttggcattcaagtataatcaatactttcagagtagtcacctgcatcacactggagtgactgctttaatttctaaatcatcaattagtgtaacccagggatactgatggccttgatacataatttagtcttagtgtgtggaaatcagggttttggggggcatcatctgaccccatttctttttaccacaatggttcctgctacaatgtcataagctgttcgattatgctgaaaaaacagcagtgtgatgaaagcagggaaaaaagaagcaattgaaaaattcttgatcaaagctcggatagtggacctaaaaagttaaaacaaaaatatcaggtaagttacacatcaaaccacatatagattaatggtatcccatcaagttcaaaatagacatttaaaacacaattgtacttctctacagaagtctacagggaaaaagacattcaaggtatagttgagagaatttttacctttgatatattttcaagtagcactgtatcatgatcaaaccacctgggctatttctaataagacttcaacaacataaaaagcagtaataaacatgtctcagaatattgaattaatggtttacagagctttctagtattttctcagaagaaatgaacattaattctgagtactttctgagtatgcttactgtagtcccatttgtctaccttatagaaaaaacatgcattttaaagtactgtgtgttctttaatcagcattttcctttgtgggatccagtgattaagcaaagcttttaaaagctttcaacaatcactcaggatggagaattatcctacttatgttagatttctgccttttagtgcactgaagggctgcagaaaagtacagtggctaggagtgtgggttctgaatccagactagttaaattcagatccatcgtctaccaattact

SEQ ID NO: 119803 - DNA, 1056 bp, Homo sapiens
tgaagtcttattagaaatagcccaggtggtttgatcatgatacagtgctacttgaaaatatatcaaaggtaaaaattctctcaactataccttgaatgtctttttccctgtagacttctgtagagaagtacaattgtgttttaaatgtctattttgaacttgatgggataccattaatctatatgtggtttgatgtgtaacttacctgatatttttgttttaactttttaggtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatca

SEQ ID NO: 119804 - DNA, 1855 bp, Homo sapiens
agttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtactattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaa

SEQ ID NO: 119805 - DNA, 1058 bp, Homo sapiens
aatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgcatctgtattttgtctatttctttgagacagtttgctctagaatctgcttagggagaccttgcctccaaatacaggttttccagtgggtttagcagtaaactagaatgctttcagaaatagagatctatgaaaaaagaatcgcccatctttaaggatatattcttttagcaggcacactcagaagttacctgtacatgaattaagcttactattaaactaatccagtccttcaagagttgttaaccatcacaaccaccacacaagtctcatctgggcaatttaaacccagttctgaccttaaaagcctttcccattctaacaacttttatgaacaggtccagagagaaggcaggaagcaaaacaacgggttcctcactcaacaggggcaaagataataaaggataaactagactgtagctaaaagatggtcca

SEQ ID NO: 119806 - DNA, 1550 bp, Homo sapiens
aaatatgttctccaacataaatttaccatactataattctggaggattatattacagtttgagaaaaaaataacagtagcgtgtgtgttaggtgtagcagaaaatgtatataccaatgtgagtctactccccccccacccgaccccccttacccttgtgctgctcatggtaaatgttagcatttggaaattttgctcagagcatcatgtcacattatgaagtttttatttttcacaggtcaaatgggaaaaatgtgttctcttcttctggaacttcattctctggtcgcaagataaagactgctgttagacgcaggaaataaaggtcacattggtgttgtactcaattttaacaacagctggtgccctgctttcagatactggattgtactttgtgctggggttatctgaagtcagatctgcctaaggacttctttaattttggaattttcctcctttctctttcgttacagaagccccaccctgcctcacccacccttttttaaataaataaatagctagactggtgactgattcttcagcaaaaatattttatgatccagcagattattcactgatttgacatagtctggctgtacccaggaatggagcctgcacggtgaatggctttgtatagaacctctttgtctacaccattatgtgcgctgataagcgttcatggaacgcgttgaaattgtaattatatctgaggaattctgtatagattagaattctgtatagattagagagtgttgaaacggatgatttctatgctgagtttgtgctggtgtatgtgtgaagtgagtgagttgggtgtattgtgcgctaaacttttctgatagaggaagcctgattaaagaatggtccgtgctaaggacttgttagatctagttcactctccatttaataattatatgctatttctatattttcattctcctatcacctgtcttgcctttttcattattttattatgaaacttgtgtaaatacaattttgtttctgtactttttggcataacataaatctgtgaacttgaaatttgaattttgtgttagagatttttttgttgtttgtttagtcttgtctcagattttattatgtaaatcccattattcaaagttgcctaaatccatttggaaatctttaaaaaaaaaattggggattcttaaagttgaatttattggcttttctgatccagttttgtttggaccaaaaaccagtattgtacaaagtattaagcatatatttttatatttactaaaatggactgtggtgactttggataataaggaaaagtttaatattaaagccatgtttattacagtataattaacatgttaaaccatgggataaatgccatcaataaaaaattatgacatactttttgttctagttttacctcataatgaaggcacacagtattattggggggactttgtaaaataaagattaacagtgtctcattagaagaatacattgacatgatttagacaactcctaagagaaagggaaagtatctgaaagtatctgaatgcacaacatatagaa

SEQ ID NO: 119807 - DNA, 1072 bp, Homo sapiens
tgtatgggttttgtgtgtcttaaaatattttcctttgagcttggaaaccattcatatgtctaattttaaaattatctcttgtacttggcagaatagagaggtaatatggttggatttatatataaacaacattcgcaggtttcacagacttgtaacttttttaaggtagtaatgtattttaaagtgttaatttttactctgacttaagtatgggattcattcactctcatttcttctcaactttgaatttttgggcttgcaaggctagctttgaagtgcattttctgatcctgtttatgattggatttgcgttaggaagttacccccaggtccagtgctctctcctggggcagtcccgctgagttgtctcatgacactttctatttactgatgataccagcctttccatttgaactgcatatttaaatatgactaatcaaattgtattataatcctatattttcttaaaattgttgttgatttttttctaattgtgaaatataatattatgtagaaaggggtgtaaaatataagtgaacagtgtaatattgaagcaaatgctgtataacaaccacctggaagcccctcatgtatctctttttgaaaacactcctctctttctccactctaatgatgaccaccgccttgtcttttatggtaatcactgttctttgggttttattactgcatttattggctaatagatgcatccctagaaaatgtagttttgcctgcttttatataaatggaatattactgcatgcagtcttttgatttgtgattgttttgctctaaggcttgtaagggtcatccatgttttgcatatagtttgtttattgtcattgccatagagtaaatcattgtatgaatatactgcagtttatttactgttgacatatgtttcagttgtttttaactactaggaaatgctactctgtacattcttgtatatgtaccttggtgcacatatgtatgtttttctagagtatatacagtggcatgggattgctgaattaaaaggtttgtatatcttatactagaagataataaaaacttttcctgatggattctg

SEQ ID NO: 119808 - DNA, 1002 bp, Homo sapiens
atcaaaagtttttcttcaaatcagcatgtctcatttgtttttcctaacatttctaacttgtattttataaaagcagcagaacttgtaacatgccaaataactaaaagaacacaaaaggcatacttgttgctgggtgaaggtattcccttcctcctcccataattttagttcttaggggaatttttgtagagcttgacaagctaaacttattctaaaattcacatggaaaggaaaccacacaagaaattttgggaagaagggcaggcacacaggcagctttgtcctactaatatcagtccatggtataaagttataataattaaaacagtctagtgataacagtagaggaaacaagtatatgcattttaggaaatgtagtgtgtgataaagacagcattgcaaattagtgcacaaaggctgtactagttgatgctgtggagaaacttggctatccatttagataaattgaagttatgattttgccacatactgtaatataaattgcaaaataaaacatataaaagtacagctgtcttccactatctaagcttgctattcaactacagtatccagttagatttggattcgaggtgtatttttattaacctgaatgccaaaggccttcctatgaaaggcctaaaatccataagctataaaagaagatgaatgtatttgactttgtcaaaatctaatataaacagatgtccatttgatgaagtaatctatataaaaaatctattttctagcgaattctagggtaggaaaattctagcaattgtagggtaggaaaaagtactttctgagactattcttaaggatttatgtttgtttcttaatttctgtcttacagatcaaggtgcagcaaagccagtttttagtttcttgaacaacagttcctctagttcaagtacaccagccacttctgctggtggtggcatatttggtagttccacctcttcctccaatccacctgtggctacctttgtgtttggacagtccagc

SEQ ID NO: 119809 - DNA, 1516 bp, Homo sapiens
agctaccacgcccagtctgatgtttaactttataaacattgcttcaactctgtaattcttctgtttttctgttgccttccttttttaaatgcttgagtgaataacacatttattcacaagatttaaaaatcaagaaattgtgacaaggttcaatctcttctctccattgtctctttttccaccttccctcccacttccaaatgtaactgtggttagtttcttgtaaatctttcaaagtttctttatgcccatccaaggcaaacatacatacccctatatattcttacttccttttaccttgttagaaaagtctgtataccgcactccctttctgcccctttgattttatcagggattatcttggacacatctttgttcttccttcttcgtttatagctgcctggattgcatatggcattttgcatgtctatgagtttatctttaaaacaaactccagctatagaattgcaaggtcaaagggtatatgcatttgtaattttcggtaactattgacagattgctctctatgagttttgtgttcatttatacacccacctgcaatgtgtagcctgttacttccagtctcatcactagtacaaactttatcaaactttatcgcagccagtctgataaatgaaaagtggcttgtcaggatagttgtgaggattgagatatcattctcataccgactaaatataggtcaccttggattatgtttacagctgctggtaatactcttcaaagtaggccctttcaaagttactcctatgtttctttggctttcacagtgtttacattttgtttgagaggatcagtacattgagtgtctatgtggtgtcttttatatttttgtaggctttgacacatcttcctcatcttcgaactcagcagcctcctcatccttcaaatttggtgtctcatcatcctcttctgggccttctcagactttaacaagcactggaaattttaaatttggagatcagggaggattcaaaataggtgtgtcatccgattctgggtctataaaccccatgagtgaaggctttaaattttctaaaccaataggagattttaaatttggagtttcatctgaatctaagcccgaagaagttaaaaaagatagtaagaatgataattttaagtttggactttcttctggtttaagcaacccagtttctttaactccatttcaatttggggtatctaatcttggacaggaagaaaagaaagaggaactgcccaaatcttcctctgcaggttttagctttggtacaggtgttattaactccacccctgctcctgctaacaccatagtgacctctgagaacaagagcagcttcaaccttggaaccatagaaaccaagagtgcttcagtggctcctttcacatgtaagacatcagaagctaaaaaagaagaaatgcctgccaccaaaggaggattctcttttggcaacgtggagcctgcctctctgccatctgcctcagtgtttgttttgggaaggacagaagagaaaca

SEQ ID NO: 119810 - DNA, 1116 bp, Homo sapiens
attttatatgttaggatattgcctacaatttacatcttatgtcttagaatgcttgctgctttgaagaaatttgaaaaagattcttaagaaaaatttagtctttgagcccctaatttgcgagcatgattttttttcttaaaccacagcagttcaaacatgtggttaagggggagctcaccagtgagcaaggtgattatgagctgctcatttataaggttaaaagaaatcatttataaggttaaaagagaggtctattcttttttttaaacaatgtaaatatgaacagttgtctatttctggcacattctgtgttttaataggaaatattattagaaactgaacacttaaacttagcagtgccattaagatactgacatactgtaaattaaaattttcatgaaatctccccccactccccgtttttttttttttttttaggaagttcagtacctgcttcaagtagcagcactgtacctgtctctctgccttctggaggctctctaggattggaaaagttcaagaaacccgagggaagctgggactgtgaattgtgcctagtgcagaataaggcagactctaccaaatgtttggcatgtgaaagtgcaaagccaggcacaaaatctgggtttaaaggtaaggccaaaaaaataaaaataaaggtgatggtaaagcgcctttttgtaaggccatttaaaaatgaagtatttgagaacagcttcagtgttcactcattctctcttgaaaattaatataaaatgagattatcctgagatgttttagttatatctgtttctgaatattgtaaggtcatattagttgcttgtcaacagtgaggtatcttttctccaggtgggaaaaaaaatttcttgtgtcattgagcctcagagagtttttgttttttgtttttaactgctagccccctaggtgaactgttctttgtttttttgtttgtttgtttttttgtttgtttgtttgtttgtttttgagacagttttgttcttttgcccaggctggagtacgggggcgcgatctctgctcactgcaatctccgcctcccaggttcaagcaattccctgcctcagcctcccaagtagctgggattacaggtgtgagcca

SEQ ID NO: 119811 - DNA, 1222 bp, Homo sapiens
tatagcaaaatgtggatggcaataatacatatcagtaaattagtaccattgaaagcatcaaactagaaattccttgaaggagaaggtgatatcctgtaaacaaaacatcttttgtagaattttaaatggtttaagtgtaacttattaggtaattgataaatatgattacttaagtgaaaaacaattcttaagtagttcatcttggattgtagtaagtgtgcagtgaggtaaacgtcttctcagtaataataatcaaattaatgctttgatttataaagcttctctaacgttgcactctctccttcgttcattgtaggtttcgcatcgccgaagatagattctgttgctgctcagcccaccgcaacaagcccagtagtttatacaagaccagcaataagtagcttttcttctagtggaattgggtttggggagagtttaaaagctgggtcatcatggcagtgtgatacatgtctactccagaacaaagttacagacaacaaatgcatagcctgtcaagcagcaaaattgtcacccagagatactgctaaacagactggaattgaaacaccaaataaaagtggcaaaacaactctttctgcatcagggacaggctttggagacaaatttaaaccagtgataggcacttgggattgtgatacctgtttagtgcaaaataaacctgaagcaataaaatgtgtagcctgtgaaacaccgaaacctggaacttgtgtgaagcgagcccttacattgacagtggtttcggaaagtgctgagactatgactgcttcatcttccagctgcactgtaaccactggtaccttaggatttggagataaattcaaaaggcccattggatcttgggagtgttcagtatgctgtgtttctaataatgcagaagacaataagtgtgtgtcctgtatgtctgagaaaccaggtatgtttttggctttatggagtaattttgcttattacttctgttgaacagtttaatttattctaagaatccttgttttagatgtttcaggatgagcatttctcatacatattaatttttctaaactatcttgaggtaaaaatgtcttgtttgcagctagatctttatgttcagttaggataggttatgtgttaactagtctggtatatatgacgacctcctctttttgtacagttttatcagaaatttcttgttcaaagttgactaatacagattctgaaagatctt

SEQ ID NO: 119812 - DNA, 1243 bp, Homo sapiens
tatacccttatttaatattttaccatataggttttcaatattataactgaaggatattttcaattatattaatagtgtgaatttctaaaaatgaaataattgctcagttgaaaattactttttttgattagttttgtaaattgttgtgtaatcagatatttcatgcagtggatgggcttgccctagttgccatatcctctccagttttttagtttgattgttttgattatcagtcagttaattggacgataattatagtttatatttttttgcctttttattggtgggggaagttatatagtatgggaatagtgtttttatctccttgtaatggcaaattatccctgtaaagtcatttgtttattgaattaaagtgacttttttcatgaacttttagaaattaatccaaaagatggttttgaaagatttttaaaaatgcatttgagagtccagtgttttatttggcataatgttattaaatttaaaaaaattacagctcatcatgtcactacagtgaacagtacaaattgtaagaagacaccacctgaagattgtgagggtccttttagacctgcagaaatcctgaaagaaggaagtgttctagatattctgaaaagccctggtaagataattaaaagataagccttttgattacaaactcatgatctcaatttaatgtcattttgtattatactttaggcttttaaaaatttctgactagtttggtaggagatttacttttgaatagagatgtagttaggtgtaattcttttgctggaaatatcttacaagccaaaggactctatactaaaatgaaatttctaataggcaagtgtaggaggaggaaatggattctccattaatagaggtaggtcagtgaggaataagagtaagtaaacctgatgatacacatagacatgtctttctcttatgagagcactgaactgccttcttgaattattccccagtttggtaaatatggaacaaggccaagtggaaagcatctgctgaattgtaacatatacatagggagcagtactcacttgaattgaagcaagatttgaaagctagtaggtaataattagaaaggggataaatagttctcagataagaataattttttgtttgaaaacaggatgttcataattccatttatgatacatagtataagaatgtaaaacttgccaggcgcggtggctcacccttgtaatcccagcactttgggaggccaagacgggcagat

SEQ ID NO: 119813 - DNA, 1049 bp, Homo sapiens
aggaacacaccatcattattttatatactgttttgaaagaaaaagtgcctgagaaatttaaaatgctgcctgttaaactgtgacattgccattcaatataagaatctcacttttagagatagtgaaatattataaactatatcttaaaataggtgaaagtatgtttttgacttgggataaaaataacctctatatttgggccaggcgcggtggctcacgcctgtaatcccagcactttgggaggccgaggcgggcggatcacaaggtcagtagatcgagaccatcctggctaacacagtgaaaccccatctctactaaaatacaaaaaattagccgggtgtggtggcgagttcctgtagtcccagctgctcgggaggccgaggcaggagaatggcgtgaacccgggaggcggaggttgcagtgagccaggattgcgccactgcactccagcctgggcgacagagtaagactccgtctcgggggaataaaaaagctctatatttgatacttattgaaaacgaagtataaggatattctttctctttacagattggatttacatttagtgtgcctgttgcaaaaacagcagaactttctggttctagtagtactttagaaccaattataagtagttcaggtaagtaaaaatttcttacattttaacatacaaacaattgcatacagtagattagtatttcagcttctttcacctttggtaattcttataaatgccttcatttggatgaaattagctctgaaaagcaagcaggcactattatttaacctttttgacggtgctttttattaattatctttagagatacttagctccttaaatggaagtgtcagtttggttttgagagagataggcatggtagcaaatttatccactatctttgtttagtcaaaacaaggtgacaagttagttataaagcaagtctcattataagaaatttataggttgtctacattatagttgtagtagattttatttctagtttttacctttcagttcacaagcatttttatgtataaaggttatgcaggcc

SEQ ID NO: 119814 - DNA, 1041 bp, Homo sapiens
tttatacaaatatccacctctaagattgtgtgtactccttagaggaagccacattttataacacagttctgtgtttttcagaatttaaagtgagatttttaaatttaaaaggaaaaaatacttagtgtctttggaataatcagtttgcttaatgtcttttttgtcactttatttttctaaaaagctctttttgtatcatttcttaataatttggaaaaccaggtacaaatgacctctccgagcagcactggcagtcccatgtttaaattttcatctccaatcgtaaaatctactgaggcaaatgtactacctccatcatctgtaagtaacaagcaaggaatagtatatatttactgatttcaaagccatgttatatttttatcaaatctaagatgccactggtggtgagaaacactgttatttttcttccaacttaaaaaatactctgtgtaaaaaacttttgaacaatcatgtattcttcactacataatgtacatatgtatgcatattcattttcttctgtaccatttgaaagttaaaatgcaaacaactggatttccttaattcttctccatgtgtcccttaagaaaaaagacattcctttgcatccccacaatacagctatcatacccaagaaatttgacatgatataataacgacatggtccatattcagatttccccattatccccagactgtcctttaattgctgttttatttctgttggtcctagagccaattaaagactaggacctaatcaactacatgatattgcatttagttaaaacatgtgtcttgatttacctttaatctagaaaagttctgggcatttttttctttcatgattgaaaagtgaatgtttggggtaagaataacacgtagtttaatattcaaattgccccagatttggcatgtttatattattttaatatgtcattttctagttttgactgtgtccttgtcttctgacacaagtagatgttacagatcaaatgtaatttccttgccacatgctgaaatccatcagttgccccagaagtg

SEQ ID NO: 119815 - DNA, 1292 bp, Homo sapiens
gttactaaatgcttgtttcacatgccaagaccatataatgctccccctcacccccttatctgcaagggatatgttccaagaatcccaggtcatacctgaaactgcagataatattgaaccctgtatatactgtgttttttcttatacatacatatctatgatgaaatttaatttataagtaggcacagtcagagattaacaacaacaataaaatagaacaattataacactataatgtaataaaggttatatgaatgtagtctctttctctctcaaaatatcttattgtatataatatctttggatcatggttgaccatgggtcagggaaactggaaattgaaaccatggataaggtaggctactatatataactttatgtttcatattagtacaactgtagtatatcgtaagaattactatcttttttccctcagttttaccaattaggaaattggtacagaaggcagttaggttccccaagtcaaatggctggttggtggcacagctgggattaaaaatcatgttcagtttttctgattgaagaacccataatgttaacactacatggtaccatcttcttcctgtatactttcatgctgaaaataagtagagataaaagaatgatgtgaaagatgaaatatatcatgcaacatgttatgttttaggaaatggaagttccagtattaccgaaaatctctctaccgatcaccagttcttcactgcctacctttaattttagttcccctgagatcacaacttcctctccatcacccatcaattcgtctcaagcattaacaaacaaggtacaaaaccattatataaatacaggtgacatttgttctttcttaattctttatttaaaaaaaaccctatattataaacagtgtttaattttcattatggaaattaataacatagtaaacagagaaatggaaatgctgttttgcttttttaaaaaaatgtacaaatatcttggatacattataatggagtgttcctcaactcttatgcaataccatagagaaggatattcttgtaaatttgtttccaaataatgtttccagtaagatgctttttgggtaggagtgcactcaatgtttcatgtttttacttctcagctaggcgtaacatcttttaatgtgctcctgaatttttttttttttgagatggtgtctcgctgtattgccgaggctagagagcagtggtgcaatcacagctcattgcagcttccatctcctgggctcaagtgatcctcccacctcagcctcctgagtagctgggactacaggt

SEQ ID NO: 119816 - DNA, 1135 bp, Homo sapiens
attaatactatacgtattcttctttttttaagatacagtcttgctctgtcgctcaggctggagtgcagtggcgcagtctcggctcagtgcaacctctgcctcctgggttcaagcaattcctgtgcctcagccacgcaagtagctgggactataggcatttgccaccacacctggataatttttgtatttttagtagagatggggtttcaccatgttggccaggctgggtcgaactcctgatgtcaagtgatccacctgcctcggccttgcaaagtgctgggattacaggcgagagccaccgtgccctgcctgtcttcttcttgcttgcctgtttctccttttttgatgttgtattgtgaaaggtaactgtaagttttttaatttcactgcttatatatttatccagtttgaagatttaccgtaatccattctgccatcaggatacattttggtagatttctaatacacattaaagtgaatatgcacttttctgtctgcacacgtgcagtattttctctagagtatttatctaggaatggaattgttggattataggggatgatccacatcttctgctgtattagatgttgccatgttttctcttcaagatagttttgcagttcaacatttccaccatatgacaatagatagatcttggggcatccttttgtgtgttttttggacatttgagttttctcttgatccatttttttcctatggggttatttcctgtagggatatatatataatttcttatatgtatattaagaaatatgtatgtatatgtatatataatttattattagaaagagttctctatatattctgaccataaatgtttggaaaagatagggacagatttaagattggttacattaacctttctgtctatatattgctctttttttctaactactttaagttgaatgcaagtctcattttagttgtattataaatgcatttcagcttagcttaaccatttgagttttgatacatagtccttgtatttgtcatttgtttctaattaaaatttcaccagtgactccctcattgaccaatgagttttaggagtatatttttagctttttaaacatgcttttcctatttatattgacagaaacaaaatcatgttttg

SEQ ID NO: 119817 - DNA, 2359 bp, Homo sapiens
tggtggcgcacgcctgtgtacacaggaggctgtggtgggaggatcacccaggtctcacctacagtgagctgtggtctgggtgacagagcaggagtccgtctcttaaaaaaaaaaaacaaaaaactgtaaaaggtttgatctgtagtgctgttttgaatatagttccattttgtatgcatgcatgtgtgtgaaaagtcattaagtctggaatgaaatatagagtatccgtgaagccattttagaattatatgtgtgtatatttatgtgcataggtatatgaatacataccttaggttccattattatcagtttttcctcttatttgtttgtatctactgtatatttctctgggaaatactcatggtctttaggtcatgttagctattgtcaaaatttagatatgaatcattgatttatatgaaaataaatgtttttgatttctctttacctgtaaggtggattctcaatatcctcctgttcagagacttatgaccccaaagccagtttccatagcaacaaatcgaagtgtttattttaaaccatctctgactccttctggtgaattcaggaagactaatcaaagaatagataacaagtgcagtgtgagtatatgtatatttctaccagtctttgaatattgattagaataagtaagactaaataatgtaaaatataactaccattgtattctagcaactgtataacacataaaggttgtgaattagtgatgattatgaattggtatgcttttaaaatagctgtcaccttgatcaaatttttttttttttgagacggagtctcactctgtctccaggggtggagtgcaatggcatggtctcagctcactgcaacctctgcctcccgggttcaagtgattctcctgcttcagccccccgagtagctgggactacaggcatgtgccacctcacccagctaatttttgtatttttagtagagacagggtttcactatgttggccaggctggtctcgaactcctgacctcaagtgacccacctgccttggcctcccaaagtgctgggattacagatgtgagccaccgcgcctggccactaccttggtcagatcttaagttagtgttgactagtaaactctagcatgtacccattgtttaggttacataattttgccggatttgctttatctgtttctttcatgtggtggtgttgaactatctgcaagtaaatttcagacattatcttttgaaccctaagtactttgatatgcatctcctaagtactttgtcctatattatcccatctaagaaaattaattctaattccttaaaattatctaatatccagtccatattgaaacgtttttcataattgcttttttgaaccaggactcgagcaaggttcagatactgcttttggttttgtttttccagacctcaaaccctcaccctggccacattggtttctgtttcttgagataattcacatatcatacaattctcctatttaaagttttcaattcagtggttttagcatgtttggaaaacactttataaataaagtggtgtctgtgagttgttcaactgttaagccatcataatggtaaattttagaacatttgtattaccatctctcccaccctttgaaaatctcatacccatacccgtcagtagccacttagcatagtgttttcaaggttcattcacgtcgtagtatgtatcagtacttcattttttccctttttatggctgaataatatttcattgtaaggaatactagattttgtagatatttcattgtatggatatactagattttgttttatccattaatcacttgaaggacattggggttggttttactttttggctgtaatgaataatgctcctgtcaacatttatgtataagtgtttttttgtgtgtttgtgtgtgtggacatgtttttatttctcttgggtttatacctagaaatagaattgctggatcataggtttttgaagagaccaggccagttgtcttataaaatgtcccataatctgggtttgtctggttttttgtgtcatttaacttgtatttattttgtttacttaacaccttattgtttatgcctttagttatattttatctcatttctaacaactcaatttattgaaaaccttgaaacttagaaagattagtacagtgatttgccatgtatttctttatgttgattcaccagtcattaacattttgtcatatttgctttatctccctccatacttttaagttaacattaaaattttgaaaaatattttgaacatagtgtgatcatggtggctcatgcctataatcccagtgctttgagaggctcaggcagaaggatcacttgagtccaggaattcaa

SEQ ID NO: 119818 - DNA, 1033 bp, Homo sapiens
caccatgcccggcccatactttctttaaaatggtgcatgctgtcttatcattcttttgttattgtaaaggtaatttctcaatcagagaattggatttccagtaaaggcataaagaaaaaaattgaacttttaatgataccacccaaagataaattgctgttaatgcattaaatcctgttttactttggacatccattctatcttgtaaatattttcactgcatgaaatatgtgccttagattttatgttgcaacaaataatatagggtttactttacaggcaccagttagaagacaaatgaaagctaagcaactcagtgcacaatcttacggtgtgaccagttcaacagctcggcgaatattgcagtctttagagaagatgtcaagccctttagcggtaaatttttaaaatcacgattaatacaggagtgtaacaaaacttgatattattgaaaaatcttaattttgttattttttcaactttaacaggatgcaaaaagaattccatccattgtttcttctcctctgaattctgtaagttgagatttaaacctttttacaaaatattgttcatacaaaaattagccgggtgtggtggtgcacacctgtagtcccagctacttgggaggctgaggcaggagaatcacttgaacttgggaggcagaggttgcagtgagtcaagatcgcgccactgcactccagcctgggcgacagagtgagactccatctcaaaaaaaaaaaaaaaggtatttttcataactccccatctattctaatagtgttttttttttttttcagcctcttgataggagtgggatagatatcacagattttcaggccaaaagagaaaaggtaaaacttctttagcatttagttatttaaactgtctacaattttgttgtgtttaaagttcacaagtatacaaattggatttagtttagacattagggaacatgtttgaaaaataatattctttttttttttgagtctcagtctcgctctgtcatccagactggtgtgcagtggtgccatct

SEQ ID NO: 119819 - DNA, 1050 bp, Homo sapiens
atcctttctttactcctgcatcataactaatttcagatgggagtcaagattagacatattgaaataaaagcaacagtatcaaaatacgggtaaaacttattttttatggtctcagaatgataggactataaggcagaagttactttctgtattacaaaatacaccatcaaaaaagtgaatgggtttaatcaactggcaaaaaatagttgtatttcaactgttgtatcgtatcacatcactcttactggtttaaaaaaattagctcttatttaaattaattttagttagttgaaactttgttttgcctaggagtatgttatattgggcttattatgggatgccccagtgatttgaattgaagctattatatactgtaatgtgttttcttaaagtaaaaaccatttgtggtagtgtatcgctctaagttgtatattcataatattaatgcttttcttttaagaaccttcaacaactagtactgcttcaaattatccagatgtgttaacaaggccttctcttcatcggagccatctgaatttttccatgttggaatcccctgcattacactgtcagccatctacatcctcggcattcccaattggcagttcgggattttcccttgtaaaggaaattaaagattctacctctcagcatgatgatgataacatctcaactaccagtggtttttcttcaagagcttctgataaaggtattcttgacatgtggtagtacataatttgggtagtaacattaaattttatgggttttttttctgacttggttgtaatttttattttctatttataaaaatctaggctcttgtattggtgttattactatggattatgtaattttgtttcagatataactgtttcaaagaacacttcattgccacctctgtggtccccagaagctgaacgttctcactcactctcacagcacactgccaccagctcaaaaaaaccagcattcaacttgtctgcctttggaacactttcccctgtgagtactaactgggttggatttaatcacattagttttgagtgttta

SEQ ID NO: 119820 - DNA, 1234 bp, Homo sapiens
tggatgccttttctctgagattaaaacatgtattacatattaataaatctaaaatcgacattgagtatttgatggccttttggggtttttttaaggattagaataatgcagccatttgggacaattattgccttatgtatgcatatagaagaaagaaagaatttcacatctgtagaatttgtaaaaaccattatgttagcagtaactgtagtaactgaattttggcaaacttgttggacaccattgtgttttgcttggcctggctttcagtgagtaggtacttattttaaaaagataaatttctaaaactgtcataatatgttttttctctcaacagggcattcttagcagggttacagaatctgttaagaatattgtgccagggtggctacaaagatacttcaacaagaatgaagatgtatgcagctgttcaacagacacaagcgaggttccacgctggccagaaaataaagaggaccatctggtatatgccgatgaggagagctctaatattactgatgggagaatcacacctgagccagcagtcagtaatacagaaggtaagtaaaatgtgaatattttgtcatgaatgataggttttcatgccctaattttgaagacactacctagttatggtaaatctaatcaggcggtacataaaccatatgggaagaggatgataatcaggttcaaattggatgtcttttttatttatcagtgttttatttattaaggaaggttgataaactatatcagttaagactgcaagctctgatgttggattttgggttttaattttcttttctttttctttttttctttcttttttttgttttttgagacggagtctcgctctgtggcccaggctggagtgcagggtgtgatctctgctcactgcaagctccgcctcccgaattcatgccattctcctgcctcagcctcccaagtagctgggactacaggcgcctgccaccacacctagctaattttttttttggtattttttatagagacggggtttcaccgtgttagccaggatggtctcgatctcctgacctcatgatccatccgcctcagccttccaaagtgctgagattacaggcgtgagccaccgtgcccagccaagcctatcctttaaagcacgtgttttaaatttcgatgaagcccaatttatctctcagtgtatgtttctttcagtatatacattttttctttcactacatgttttgaaata

SEQ ID NO: 119821 - DNA, 1089 bp, Homo sapiens
ttaacagcataacacctatgatccaaggtgtcttagagttgatacgacttcaggctgtgtagttttgttttaaatcttgataatttatcattgccccttatctaaaatacttttgcttcttgtcctatttaattaaaaaagaaaacatattttagcttttgaattgggaagtaaaggtatttaggggtttcttgatcaacactgtaggtgctatttaatattggcagaaactaccactacccaaggaaagtattcaggtatattcaaaagaatactctccttttttttttttttaatcttaaaaataaggactttctttagtccttattgaggctttggtggacatagggtctacccacttgctgtttattatcctaggctgtcaactggatgttttgcagaagctgctgagtcatcatgaagcaagcttcatgacatggcatgttttatactaatgttatttgattaagtgtccaagggtttctgggcaaaaattaagcttttggtagtatagcagaaagttggagtaagaaacaatgagaggtctggcgctgttagttaatggatgtttgccagtgcctgtcagggcaacttggctagtacagtcacccagtacctatgacttctgcatgtgttcatttgacttgtaatttcctgttttgacttctgggtttagctctcctgggaaatgctgtaagtttactactttccttctttaacttattttttttttaatttttttttttttttttgagatggagtctcgttctgtggcccaggctggagtgcagtggctcgatcttggctcactgcaacctttgcctcctgggttcattccattctcttgcctcagcctcccaagtagttgggattacaggcatgcgccaccacgcccggctaatttttgtatttttagagacgggatttcgccatgttggtcaggctggtctcaaactcctgacctcaggtgatccacccgccacagcctcccaaaagtgctggtattacaggcgtgagccaccgcgcccggcccaaattctgatctttaaaatgtcatcttgcatgaagttgtgcagacaaattcattgt

SEQ ID NO: 119822 - DNA, 1169 bp, Homo sapiens
gcattccagggaggcacaacctcacggtgagagcagcaagcacccctcctcaggccacagcttggcgtctttgttcgcctggtcaccttgggcaagcaccagccccatctctaaaacatgctgccgcctggctggacctcagaccagaagctggagaatccacaccgtgcacttcctgggccacctcctttcccctccccagtgggagaagcggcactttgtcacttgggtgaatcaacagcctctgctttttccagaaagcaagagaactgaaaatcctggattaactaagtgacagtatttttttttgcacttactacacacctccactgtatagaaacctctacagattccaacagactttattcttgtacaattttaatcagttcttactgtagaatctggagtcaatgctctaatctgttttttataaataatatatattatgtatatgaaatgtgtatctatagtatgtctggagacagacaaggctgcacactaaaatgcagataaaggtgatttgtagaaaatcataaggtactggacttcgttacaaagcaacttgggcgatctcttatacatgagcagatgaaaaatattttattgcctaagaatgagcttgcaaatccctctttgcagaaaaggttatagaatgctgttctttataaccaaagaacttacataagacaacatttttgctgtccactcttttgtgtgaacatgtatgtttgactgcaagtttggtgccataattcccttggctaccaagccacgtgctgccattctctgtcctttgtttcataagcacactgagaaatctcacagctatattctttggtcttccacctgcccctccacctgctgacttgacattgtattataactgttgacaatgactggggtcctgactccacagttgcctggaccgtggctcagcccagctgggcaggtggaatgaagagagccgtattactgtaagaaaacacaaggacagccaggagtagtggtggggtgggtggggtgggaggtgttgatttttgtgtgtttctgtgtgtgtggttttgttttggattggtaggtttcactgtggcgtggttttgctgttgttattttgcttgattctggaaaatgctgaggagatggactgagctatgaagttcaatggttca

SEQ ID NO: 119823 - DNA, 1835 bp, Homo sapiens
ttagcttcagttttttctgttatgctgagtattctgcatttcaaaaacatagtaacttgtaatgcttctacaatttgtaaaatacaaaataactggctgggcgcggtggctcacgcctgtagtcccagcactttgagaggccaaggcgggcggatcacgaggtcaggagatcgagaccatcctggctaacacggtgaaaccccgtctctactaaaaatacaaaaaaaaaaagttagccaggtgaggtggcaggcgcctgtagtcccagctactcgggaggctgaggcaagagaatggtgtgaaccccagggggcggagcctgcagtgagccgagatcgcgccactgccctccagcctgggcgacagcgagactccatctcaaaaaaaaaaaaaaaaatacaaaataacttacatttgtcacatagcttaatacagcttttttttttttctactagagtttcacgcagagtttgaagaggagaatatccctgaaaaatatattttattcctgtggtgtaacctatgaaatagtatccaatataccaaaggtaaaatatatgctactttaggccgggcgcagtggctcatgcctgtaatcccagcactttgagaggccgaggcgggtggatcacctgaggtcgggagttcgagaccagcctgaccaacatggagaaaccctatctctactaaacatacaaaattagctgggcatggtggcgcatgcctgtaatcccagctactcaggaaggctgaggcaggagaatcgcttgaacctgggaggcagaggttgcagtgagccgagatcgcgccattgcactccagcctgggcaacaagagcgaaactctgtctcaaaaaaaaaaaaaaaaaaaaaaaaaaaaaaatatatatatatatatatatatgctactttaaaaaatatcagtatctaaataatggagaatgtgttcattctccagacttctaaaacgttttctcaccacactttggatgaaaacgttgttcacatcaaagtattgtcacttccttcctgtcctcgtaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggcaagtaactgaatatctggaccgaggatgaaagcaccagccttcacccccaatggacagatatgaatttacttaccaaacacctcactaaatctatcagagaaggagcacttgagccatctctattgaaaggactctggcaaaatagtaaccaaaataaaaataatgactaacttttattgaataacccctacttgccaagcactgagcctgagtaatttaggtatattatttcatttaatcttcaagataaccccctgaggtaagtactgttgaaatccccattttcaaatgagaaaattgaggctgatagaagttagctaactcacccatggttacacagctaggaagtggtacaaagtcggatgtaaagccaagtagcttgactccaaagcacatatgcttaaacacagacttactatctccctaatttttagacctgagttaacttttgaggtgacaacaggtcattcaagtgaaaataatccactaagtaatgcaactataagataagatatgtcatttcataggagcaatagttgacattattgggggaggtgttgattaataggaggaatgtaattggcatctgtcagaaaaatcttcccttagtggaaatcccacctgaattgctgcatgagt

SEQ ID NO: 119824 - DNA, 1306 bp, Homo sapiens
attaattaatttaaaaaatggatgatcttaaaatattgcagttatccatccataatcttttagatagactcttatctttcccatgctaaagtgcattctgctccttacatccaagagctaatattgttgtaatatgccattttactttacaagacttttgctgaataggaaaattggagacattttatgcgcataattgtgttttgtttagccagctttcttttctcatttgggtcacacttagttctccataacctatagaatttaaatctcagctttttctggttgggaatctagaaaaaatatatagatgtgcaaattgagattgtacctagtcagcactgactggcctgatatcatggagtgtggggttacgtacaaatagtcaaagcagcaaaccaagatgaagctttctgggttcggttcccagtctttgtacggattctccatacacatcttcaaaggatgttttcccagtgtgccttcctacatgtaaaatgtgggtacagtggctgggcgtggtggctcacgcctgtaatcccagcactttgggaggccgaggcaggtggatcacaaggtcaggagttcaagaccagcctggccaacatggtgaaactccgtctctactaaaaatacaaaaattagctgggcgtggtggcgcgcgcctataatcccagctactcgggaggctgaggcaggagaatcgcttaaacctaggaggcagaggttgcagtgagccgagattgtgccactgcactccagcctgggcgacaagagcgaaactctgtttcggggaaaaaaaaatgtgggtacactgttggtaaagtttcagaggtccaagggctctattcttgatgtaacgtcttaagtcttaaactagaattaggcaagtcaaagagcatttttaatagaattgatggattttctttccctactcataattccacgaagaaaaacctttaagggaaatatcagtatccccttgaatctcagcaatgccattgactaacgtcctgcggctgtttgtgcgcttcctggcacatttttcacagtgcagtccaatggctgcctaggggatttcttaaagcatggctgactgcatgttggagtttgcatgggagatttttgcttagcctcgtggtggttggaagtaaaatgtttgtggcaagtttgaaaagttctctgctgacctactctttgcatttcagaaaatctatgttatcagaccactgaactatggagctatgaaaatgcctgtcattttccattccatttgttgttacttggtttgggctctgttcatgct

SEQ ID NO: 119825 - DNA, 1035 bp, Homo sapiens
ttattcacaaataaagtattactctgcattaaaaaagaaaaaaactgtttatatccatatggatgaatctcagaaacattatgctgaatgaaagaagccagacacaagaatacataatgtgtgattccatttatttggagttctagaacaggcaaaactaatctctgagagttacacagttgctacgggaatgtggggattgaatgggaatgcatatgagcaaactttctgaggtgatagggcaggttacactcatatgtgcatttctcaaaactcatcgagctctatactcaagatgtggacatttcagtctacctcagtaaaataaataaaaagaaacaatatgacaggttggttttgagagttaaataaggaagtaacttatacaagataaatggcacagtgcctagcacatagtaagtgctcagtgaatggtggcttattactattactaacagtatccctggacgatgacgctcttgcttgttggaatgtgtttctgcaggtggaatgaagtaacgcgaagaatagaaatgtggatctccatattagaattgaatgagttaggagagtatgctgcagtggaacttcatcaggcaaaagatgtcaacacaggaggcatctttcaacttagacaggtactgagtttgttttgggtttttttttaatgttttctctctgttccactcttacacattgtttctggggattttctaactatttgtatctttattctctaatccttttccccttctttatcccgttccttttcattatcattcctggcacccatactcctccccaccctcttcagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggtaagacaagcagacttaaaatagtatttaacaaagcttggttaatgcaggtcccagggggacctctttgccaa

SEQ ID NO: 119826 - DNA, 1130 bp, Homo sapiens
caggctggtctcaaactcctgacctcaggtgatccacccgccttagcctcccaagaggctacctaattgacagagaatttgtaacgtatagcatatcataatttttcaatgtatttgattctttgggcttgttaggaaatgctgtatgtttatattttaacttttacttaagttaaaatataaaggaaggactaattctcggggttatgtgcattatgaatttctctacattatatatttcacgaacatttttaatctcattgatcatttggaaatattggaccatcccaatcacgtagcttaacagcagtcactggaacccagtccagccttctgctgatgtgtttcttatagatatcgttcacacccacacatacccctacacctcactcactgtcccgcttaacattgctttatgtttctccatagtacttaacaccattggaaattctatgtaccatattgacttaactgttttcttatggcctgtctcctcccaccagaatataacttttcatgaaagacgggacttcattgggttcagtgctgtattcccagcccgagatcaatacctactacattgtagactctaataaatatatcttgaatgaatgaatgaatgagtgaatacaaggccttccgcagtagagacccaaccttctcttccagccttaactctcactgctttctgatatttgccaggggttcttggcccctgaaatcatctagtatgtccagaacctttctttagtgtgcttccgtatgccatgccccaagaacaccctatctttatatttctgttgaaattattcttatgcttcaagaactatctcaaatatatcctctttctgcagcctttcttggtctcttaacccatcatgatgtctctcctgggaagcccctggcattttgtacccttcaatagcacaacactctcctcttttgtgctctagttatgtggtcttgttccctctactagattctaagctccttaagagccaaaatggtgtctggttcatccttggtgcccctatcacgcctgccacaagatgtcatgcactgtagactctctgttaatgtggttgagcagagtagcatgtgtaatcccattggcattgtccccagaaaca

SEQ ID NO: 119827 - DNA, 1041 bp, Homo sapiens
gatcgcttacaaccttggggttggttatatcatcactggctgaccaggcagctggcaagggtaaaagcaaatttgtgccttatcgagattcagtcctcacttggctgcttaaggtaatccattgctctagtgttcttttccaactaaaaattggctattccagatgtgacagagtaaaggtgtgtacaaagctaaccaaatacctaaagaactctcctgatgacagttattctaattcctaggaacacagaatgaaaactattttctactcctttttattccatttgaatgctgtttgacaggccttattcattgcttgaatatagagaggacacatttcatcttgtcatgacgttatttgtgaaatgcaagtccatttccacataatgtttccttcatagagaataatgtcatacctaacacatttagtgcttttatcatatgtgttgtccatggaatgggcttcctaagatgctgtttgaaatacttggcaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggtaaaagcagcctggtactccctgctggtaaagttccctggcttgcgggatttgactggcaagggtgtgctcatttgcaattgtaggtcatctgatatggtttcgatttatgtctctacccaaatctcatgttgaattgtaatcaccagtgttggaggagtggcctggtaggaggtgattggatcatgggggcgaacttcccccttgctgttctcgtgatagtgagttctcatacagcctgtggaaccatgagccaattaaacccccttttctttataaattacccaatctcaggtatttctttatagcaatgtgagaactgactaatacatca

SEQ ID NO: 119828 - DNA, 1012 bp, Homo sapiens
ataataataataatagtacctacttcaccgatttgttagggataaaatgaccataatgtgcttagaaaaatgcctagcacttagtatgcagtgaataaaaattaactgttatagctgttgttttttataatcaggataaccattatcatgattccaagttcaacagaaagtagtttagtgtgtacttgtaatctttttctgttgagctgtaataacttagggtttcgtttaggacagaatgtgacaagaggaaatgtattcaggaacatgtttgcacagcttgcatttaagatgatgttaacacattattattttcatatacaaaagtttaaaaattagaagtaaaatagtggcccctctatcagatggacacagccgtactcacagggaaagaccactactataggaagttaatcatccagtcattctgtctcctgctctgataacaaaggattttgctgtatttcctgacaaggcattgcaagattccagactggcactgcagccctgcatgccaaaatgagttcagaaaccaggatggggaggcagaaatgggagtgtgaaggagcaggtttcaaagaaaagattgccacgcctcgtggagattcatttgcaagtgctgggccatgcctgccggtggggcttgtgggatcacactagaaagtctgtagacttgttggaatttagagtgtgtgtgtgtgtatgactggcgtagatgtggaatgaccactaactttattgagctcttgctaatgccaggcactattctgaatgctccatatgcaatgtcacatcagcatcaaggcatgggtccgttatccccattttacagatgagaaaaccaagacagagcaagtttaatgatgtctcccaggtcaccaagttctaagtgtggattttggaaatggttgccgtcaattggtctccgagcccaggctcagccactgtggctacacttgtggggatggctgtgcattctgtttgccaggcagcatctagatgatacttttgt

SEQ ID NO: 119829 - DNA, 1026 bp, Homo sapiens
actccagcctgagcaacagggtttgaggctaagttggccactcttctgctatgttaccatggccagtatatggggaaaccttgtatggttgaagcattgcattttgctccctcctctacctgttcttctttttccttgctgttctccaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggtaagttagtggtcaagattaagtgtgttaatagggggagataattttaaatgattctaaagttaaaattggaagtgaatatacgtatttaagctcttggtgactacactggttttcattcatttacagaaaaatcatcagcttctcaaagccttttggtatacccagtgtttatcctacattaatgtataaagttgcctatgtatgccctttgaaaagatgtttttactattggtatttttttttgccaccatgaactattcacaaaaattgagttaggaataacacattagttcttccatttacattggaaagtggcactaatgtgttaagggtaaaagggttgaaggattgaaacatcccagccaaggcaagcaatgcccttccctggctgtgcattggaatcatgtggggaacgttttaagcatccacttgcctgatgtccacccatagagactgtattcagtagacccagggtgaaacccagggatctatattttttttaactaggtgatttaaaaatatatttatctgattcatagaggaaggggggccatttactttttctcaattaaaaaatttggggccgggtacagtgactcatacctgtaatcccagcactttgggaggccaaggtgagcagatcatctgaggtcaggagttcgagaccagcctgaccaacatgacaaaacccca

SEQ ID NO: 119830 - DNA, 1397 bp, Homo sapiens
ttccaaagagaagagatagggaaaggaaggaaaactgggggctcagtttaaactgatgaaattattgatcgtgttcaaatattggatgcttttctatgtagttactttagaaaaacaagaaatactctgtgcatatgccaggtctgatctgtgcatcaccatgcttagtgttttattcagccatgggccataggtgtctgccttgtttaatgcagattttaaacaagatagggcgtatatcctcccatttcattctctcactttctagaacacagcccactgtgactcttttatcctgtgcctcttcagtcatcagatgttgggtgtaggaatgatagctgcatttttccttccatccctggtttctttcttgctatagaaagagatttgccttggttacccatctcccagtacacacacatggtggctttgagcctattgctgctgttctaagtagggacagattatgcacaagtgtggacacccaagggtgttagcttttcaaagatctctgtcaggctgggtacaatgactataattccagcactttgtgaggccaaggtgggaggctcacttgaggctaggagctcaagatcagctcagacaacatagcaagatcttatctctactaaaaaataaaaataaaaaattagccataagtggtggcacacacctgtagtcctagctactcaggaggctgaaacaggaggattccttgaacctcgaggagttagaggctgtagtgagctataatcacaccactgcactctagcctggtggaagagcaagaccctatctctttcaaaaaagaaaaagattcatatcgtatgtgactcagggttgggtgactcaggtctgtgactttgcttgtagaaattccatacaggagctctctctgttgttctgacattgtgttatgggttactttgggcatgcctgtgttttaagacttgttcacatgattatagaaggtctaatcataaaccccagaggaaattggcattgtggtcatggttattaacaagtgaggtcaggcttgccctgtgaatttgctgcaccaggcatgtggagctaacatctgcagagtggccaccgcctttttggcatcggttctgctgaaaagtcacaggcctcttggatttgacaatgttatggctctgctcggattgtctgggatagaaacaaatactcatagatcctcctgcttcccacgggacttaacgaaccttcgtttatgggctggtatgctttcccctagacaaatagcacctcattctatttgagtgtaaactagtcggaaaacgtttagggtggagatattgcgtcttttatgggatccacccatgcactgtttgaattccctgattcccaccactcagcgtaaacagctccttttt

SEQ ID NO: 119831 - DNA, 1084 bp, Homo sapiens
aagcagtctttgtaaatgtttaagtcactgctgattgcaattaaagcattcttgacaatgaatcaatacattttttaacatttctaaaatgtgccatgttagtagataacagtgacttccagtaactttggtttttattttcttcccagctctacagaaatcttcatatcaaaaataaaaaaaaagcagtctggtagtggcatatctggggtcagtgtggatgtgaacattccctggcctgagagattctaaactgttgactcagaaattatataacagttcttgccatatggcatgttgctcaaatgtgctgaagccatgtgtcttcgagcattgttaatgccctgcaactcaggagaaaggttgtacatctgcctcttattctgctagcattgctttatactgtgaggggacagaagagcacctccaatctgtggactaatgcagtgggaagagcagccatgtttgattctgttcccatcatgggggattttatgtgctcagagctagaaatgatttctgcttcatattgcttaactaaatattaacttaactaaccagaatcgtaatgagacaaaacatttgtgcagcaaaatttacattctaaaagccaacagtagccaaaatagaaccaatttcttagctgagttctacaatattaatttgttctagcatattgtattggttcattattttactattcaggtggtctgtttgaatgaagtcttttttctagtagttaaaagcacaggctctggagtcacacttcttgtgctcaaattctgcctctgccacttcccaactgtgtggctgtaggcaataataacagcacctccttattataaatcttgtgggttgaaatgagattatgtatatgaagcactcagcaagtgccttgcacagaggaaacactcaataattgttagctattgggtttaaaccataaaagttttccctatagttatgagcaatgctagtagttgctacttgaacagtttgttaaagtagggattcattataaatgatgcatgccattttaaaaaacatttatgaaaaaatatgccaaatcctcccagatttttgt

SEQ ID NO: 119832 - DNA, 1090 bp, Homo sapiens
atagcctaaaatttagtaaattttaggttgcatgatcacattgagtaccatgtcccagttagccctgaaattggcttctgccagctcatagagcactgtctacttaaaaaatttgggaggatattttcttattcttcagatattcccattatcatacaaatactatgatgctccttctccttagcaaaaggtaaaattcatgcttactattctctcaagtttacatctattgtaaataatctgcctagtaaatacgttacgtgtagattagttgatggtttccatactaatttttctcttcattaaaaaataacaattccttcttaattgggaataaaaacattaagatagaagcattcattatctggtggaaaacaggggaagtggagaaggggaagcacatatttcctgaaaccgacctatttgtcaggctcgatgaataatggcatcattgatactgatcaggactctcaaagccgctctcaaaactggggggtagcagggagagagacagagaaagataagtgcatggattgagaaagcaaagagaagcaagggctcttaagttttgtgtggtgtgtcaaaatgttaaattctcaatcatgtcttgctatttattaaaagctataggaagagcctccacgctcccactttctgatttagaaacacgtaattctctagtgggggtataatggcattgtagtgggttggttggagcagttgaagaatatgggctcttaagtcagacttggttcaaatcctggctctaacaccttctatctgtgtaaggccgggtgagttactgaatctcacgatccttctgtttcctcatatggtaaataaggatactaatagttctgatctcatagggttgatctgagggctaaataatgtattcatttaaagtgcttaatccagtaagtacctggcgacttagggaggaggaagcactgccttaatgtttatcgttgtctttattattgtctcattgtgacaggagtcagcactttggaaagaaaatgcaatgtactgagatttatgacaactggttttgccacaaactgctagaccttgggcaggataatttctg

SEQ ID NO: 119833 - DNA, 2671 bp, Homo sapiens
atttatgtaaaaataggctgccgtttaagtacaacttgtcataaatggcagtgtgggacatttacattcttttggtctacagttctgagactattttttatgcatgtatgtatttattcagtaaacatttatcctctgctgcacgtcaagcactatgccagacccgataggagagaacccagggtgagtgtgacccggcctctgcttggaacgagatgggtgtctctagccaggccaggtgcttaccatgtgcctggtgtggggtccatgacaccaagcagggcagacctaggcatcctgttggtgcagctctgtaaaggggacaagacagacaacaaaccatgactccgagaaagtgcaacaggtgccacgaggaaacagaattccaggacaggaaggtcagggaatgcctctctggaccaagggggagaaagaaccagcaggggagggtattcctggcagagggggcagtagcttgaagcctccaaagtggaagtgttatgaattcttggagggtggaaaggaaatgggagctgggaaaggtgggcagcatttaccatatcctacagacgacaatctggaacttggtatttgtttatcccaagtgcattaaggcattgttgcaggattttaagccaggtaaatgataggaaatttatttgaaaaagataattctggttgcaaagttagctacgttgttaaggggatatattaaaggccctgaactaggttttaatcctagttttgccttttacttagtcttgtgagcagtttactcatctgagaaatggagctaatgagtccacctcaatagtggtaaggattgatgaataagataaggtgtcaagaaccatgtgtaaggccaggtgcagtggctcacgcctgtgatcccaacacttggggaggctgagtcaggtggataacttgaggccaggggtttgaaaccagcctgggcaacatagcgaaaccccgtctctactaaaaatacaaaagttagctgggcgtggtggcgggcacctgtaatcccagcttctcgggaggttgaggcacaagaatcgcttgaacccaggaggcagaggttgcagtgagctgaggtcgtgccactgtactccagcctgggcaacagagcgagactctgtctcaaaaaaaaaaaaaaaaaaaaaaagaatcgtgtaaaatgtagaatatgctcaataatgttagttccccctccgttttcctccttcccgtagagtagaatatgtgagtaaagtgttctggcatcatggaaatgcagcacagtctctagtgatcttggggacagcaacaccaagcccagtggcagctccatgaaggttatgggcacagtgtctagtggggaattttttttttttttttgtaaagttgacctggtccattcaagtattgcaatagtaatggtggctttatttatagcttgttgtattgagattatgagtttcgaatatttaacagattcttcccttcttcatgccttttggaagagagaactaagttgctaatgcagtactacactactgttacttcaccaataatactcagggttatattaataggagaatctgcaaagtttaatgccacttgttcatacctggggctctcctctaaactaaataaatttcttaacctgtccattcatttgtattttcctgttgttgtgaatctctaaatatcttgcacaaataatgagtttcctatacaatttgaggagactgtgttattctgaagaattccatcatcataatggtgttcattgggtctatgttgtgagtttgtctaatggaaaaaagatttgtttctttttaactgcataaatagtagattcaaataaaatgctgttaagtggaatgcaggtaataaaaaccgattcagacatggcagctagcctgatggggtttgtagcataacaggaagagaaacttgcaaccttattttagccatccttagattggtctcaggtttgcctcatagtgaattctgctctgggaaggtaacaggcgttataggaaagtcatatacacagtgaggtttcacatgagggcaagctccttattacctacccatttatttattctgtaatgtggttggatgtaatttaaaatgggtccttggatccccccttgactgcttttaggtttatgtaggtctagaatcaaaatccttgtattcctagtttgctgtccacaatgaagatttttaatgtcatatttcctaacctagagaataatactgccatgaacgcttgccactagtgtgacttttgtcacagacatgtcattggcagagactcatttgtagctcccaggtctgtattgggaatcaggatgagaaacgccatcctgcccagttagcatgcctcctaaaatctcatttgtaatagacatgggattcatttgaactgtaatttattttattttattttatttttatttttatttttttttttgagactggctctctgtcacccaggcttgagtgcagtggtgccatcttggcttactgcaatgatcctaccacctcagcctcttgggtagctgggactataggctcttgctaccacacccagctaatttttgtctttttagtagagacggtgttttgtcatgttgcccaggctggtctcaagctcctggactcaagtgatccacctgcc

SEQ ID NO: 119834 - DNA, 1049 bp, Homo sapiens
ggatcgcttgagcccaggagtttgagaccagcctaggcaatgtagtgagaccccatctctatttttttttaattaaaaaaagaagaaatatgtacaattaaagaataataatagaaatgaatatccacataccctctatctagctgaaaacacagataacccatgttttagaagagtggacccaaaggagtgtccttctaaataacctcactttcctgatttttatggttatcatttctttcttttttttttttttttaagtttttcatttaactatttatccccaagcaatatatttttagttttgccctttttggtgaattaatgtaatagaatcatgttgaatatattattcacgggcttgctttcttctttcaacattatttttttcagattcatccacattgatgtgtgaaactgtggttaatgtccttccactgctgtaaactgttgcattgtatggagtaccatggtttatttttccatcctccaggtttgtttcttcactggtgtttggaaaacaacatggactccaaactcctcaagtcaccttgccacagatcccttgagttgggggttgggaatttccaaattgttggctttccttagtggaaatactagatgttctcatttctggagaccttctagagaatggactgtgatggacttttgcaggggctgttagctgttgacctgagtctcctgggtctggagttaaagccctgtgtctgcaggatcttgtcgatgagccctcccctggggtcactccttctagtgacttgaaataagttaaattggacttgaagtgagttaaattgttgtgggcccaaaaatgcttccagtgttgttaattaaaagttcaatgtattgtgtttgatgcccctttttacctgatttaaaagcttaagtttctctttggattaatcaataaaagtacttctataagtaaactctgcagattttttagtcactcaactaataggacttgcaggaaaagtgaaatgtctataagcaaaaaacaaaacttctactgggggaagctttggagc

SEQ ID NO: 119835 - DNA, 1032 bp, Homo sapiens
aagttcaggtttaaatgattcatgtgaccaaaggtattctgaagttgaagtttaggactttatgtgacctctattatgtgttttctgtgaacatctttttaaccatcataattttttgcatggttatattctgatgacatttaacacatgtgaccttacttgaagcagggaaatacagtttcttactttgtggtgttctaatggtaaactatcttggacagcatgatacagagcagcaaagagaaggtatttatagtgaggcatttgactgctttgtagtctccttgtagcataatagatacagcagaataaagtgaactccggatttccttttccctcaatccctttgcagcactttggtccatgaagtagaacccattgtggctcctctgccctttggtggtggcctctgatgtggctagcacctggtattcccaggttctgtagctgtctggatccactgacaccaccaccttagggctctgagagtgtctagattctctcatgttactgattccaactggtgtggaaaggtttccttgaacttcatctgagacaggtttggagtactttgaacattttagaaaataaaccccaaaaatatgttcacacaaaacacctacgctatagagaagcatgcacatgaggggtagtcattttggttcatgaaactgtactgtgcaaagtctgatgaagatgggatgagttggcccaggtgactagcttcacagacttcagtttatttttccatacttaaaccagcctgggaagtagatacctaaatttctgcaggaggtcttcagctttcatatattgcattttctcgcagcctgtgtgattttgcacagtatacaggacagaaagattctagactgcctttctcttgctgaagcctgtctttcacatatcagctggctgatgactgtgagtggtcagggtgttgttgctgtctgctggtgccagcctctggagtgtagggggtgctgctctggtgctgcacgggctcacgccaagaggcctgccaggtggaag

SEQ ID NO: 119836 - DNA, 1013 bp, Homo sapiens
tgggtgaccttgagcaaatgaaaagcttgactttttcctctgctttaccgtattgtgatttccttggggttggcagagatttggaaagggatgtattccagaactggaaaaataatttggccaaattaagcaaaatctccatgggatgttggtgccacttaccccagttttttttttttttctttccattctcacagacttcctcctcgcttcaaccctctctctgctatctgagtcaaggcctctggcctgcatacaagctgtaggagcttgcatagcgtttctggaatctgtacagtagtgctgtgctgtggtggggtggggagaaggcaaatacaagggtgttgaggtgacagttccggtgtgtcagattggtgggtcagagaactgtttgctcagtgccagaatgttggaaaacaaaagcaagtttctaagtaaccccaaaatagattcacaggcaggatcaagaagctaatgcagatgttccttattttttagaaagaagatctaaaagccttatgcaactatgcagaatttctaaaatggatttcataaggtcgcaacgttactaaatgacttgtttattcagccagcaatgctttagtctggctgactcttggtgtttaattgcattagttctatgaagcattttgtgatgttgttcaccgatgtacaaggcattcgggcatacaatacagtatttatgcaatatttaggtgattttcaaaatataagcctggtgccaaatatggatgtaaaattttaaacagtatgtctaccataaccccatttgggaggggaaaagttatgtgtgtgtatctgtgtgtgtgtctagcatgtgtcggtggttctcaaactttgacatacatcggagtcacctggagggcttattaaaacacagattgctgtgtcttcccctagagtttcttattcagtaggtctgcagtggggctcaagcatttgcttttccagtgagtttccaggtgatgctgatgctgttagtctggggacca

SEQ ID NO: 119837 - DNA, 1158 bp, Homo sapiens
tttgtgcttagatttgtttaaatcccttctggtttgtttgaactgaatcagcttgttctcagctcttcttttacttatatatgaggaagcagagatttgtaattttgtatttatggagatcaacaggaaaaatcagatactcacactctgagactctgccagatgtaatttacatttgaacaaggatttacaaaataacatggattaagttaaacaattagagcagtatgccacagactatatatcctaggaaaactatttgggtcagtagtttttgttttcaacagacccttgcattgtgagtgcccagtaaattggttgtaattaataattgtcccagtacaagtctttgtttaggaataagggagctagctaaagtaagtttgtgactgcattttgtaggaaatatgttagttaatcagtgtgttttatgaatgtgaaaatcattataattattacttttaaaaccaccaatagtgcatttgttatctcttaactctgtttagaagacctcttagtttgtcattctttaggcttaaaaactcgagttggcacttgtttttttattactgtatatgcagtataatgactgtgtagtgcaggacatttaaactgaaggcagtgaaccccctgacattaaaagtaaaagtgtgtgtatgcatatacaatttctaagagtgagacttcatgtctttgatcaaaatttcaaaggcttctgaaactctagaaaattaagaactggtgacaggtgtattttgtgatgttgtttagaagtatgtttttcttttcctttcctgtctcctctttaccccttaagagacctgcactaacaactaaatacatttagagaccctgtatgcagttaaggtctccagacagtcacagttgtttatattaaagtgctgaaatatatcagcagctacttactatttctctaatcactcagtagccagaattaaaatgttgatggtgtctttaattcatagcaggagggcttttgtggttactgtaataaatattaaacagagccttctccaaagccattggtcacatgctttgtcccactagtaattaacttatcattgagctatggtacactctggcgactttttcctaaaagatttattttgacaaaccagggcacgataaatttttcta

SEQ ID NO: 119838 - DNA, 1039 bp, Homo sapiens
aatgatacgttatactgtgaattcactccttgatgacgaagtcagtaggggcttcttcccagctcatttcacttttactttgctgtttctcctgcactactatatgatagacaccacaattctttacattcctttattctgctgggaatatacctctgaggaatgacatataaaaatatttctgaaacatttaaaacccatggtccctttggatcaacttaaaaatctcacctcctcctgagagatgatgctctcgatatatcccctgggtaaaggaaggagctgccctgtaccccaaccccaactataactgatataagaggatccctctttgggtaatagtattgaaggttattaccccaaaatggtcactgatttgttagccaggctgatcacattcataaatgcatagttaatacatagaaagagatacctatttgtggggagagtttgcttagcaaaaacatcttggttttaaagtttagcagtgttatttttagttataattcatttgttaagtttagtcaacaaacattggtgcccagaggctggtccattagtgtttccagttaaggcaaaatccaaaattattttttatactcgctctctttttgctactctcaaagaatgtttacttttttttagttactaaagagtgattttccctttgactcataacctttttttatgattttaccttgttggcagatttttaactcctaaaatttccccatgggttgaggaatcacaaatgccattcaaaatgaatgcatgataaacctttttctagccaccatttggggaggacatgttaattggtgagaactgagagttttgttttttgttgttgtttttttttttttgaggtggagttttgctcttattgcccaggcttgagtggaatggcgcgatctcggctcaccacaacctccgcctcccgggttcaagcgattctcctgcctcagctcccaagtagctggtattacaggcatgcgccaccacaccaggctaattttgtatttttaggaaagacgaggtt

SEQ ID NO: 119839 - DNA, 1059 bp, Homo sapiens
ctgaatcagatgcatctgagtaagaaactttggggctggctgataacatcagtttgattctattcattgcattgtcattaataagccagaactaattggagaaataaaatttgagtcaagcatgaggaagattccaattaaatggaaaggtgtagattggctgtgttacacctccaatgtatggaagctcagaggaaagggagagagagagagaggaccacaggaatttgtctggccagagtagatataacagaagtactctgtggttgagctgcctccgggtgcctgtggatgttgtccagactcagccttacttgcacacagcccccacaccagcatcagctgttcctgagggcagggccggtacagatggttgtgtcctgccccaccctctttcaagtggagcctctctggctgctgcctcttcctggctgtgctcatctctgtggtccgtgtcatctgttccctccgttgctacttgcctgcacaaattttctcctcgctctgcttttttaacggtctcccttatgacttattgcttcttctcctcagcctttgcagcaaaagcttgaccttttatggacatttcaagcctgttcttcaatttattaccatgttttttttttctttgttttttgagacggagtctttctctgtcatctagactggagtgcactggcgcaatctcagctcgctgcaacctccacctcctgggttcaagtagttctcttgcctcagcctcccaagtagctgggattacaggcacgccccaccacgcccagctaatttttgtatttttagtagagatggggtttcaccatgttggccaggttgttcacgtgatccacgcgccttggcctcctaaagtgctgggactacaggcatgaaccaccacacccagcctattaccatattttcagtgcacctaaaataccatcaattataagacacattggtatgtaggtgccacacaaaagaaaaaccattgcccgttgaactattaaaccttgattgtcaaatgtatcccaattctgaaattttaagatgtggaaaatagac

SEQ ID NO: 119840 - DNA, 1036 bp, Homo sapiens
cagaattctaaaaacattgacctgggttatctgggataaaatcaaaacaactgtgaagctctactgacctaagcccatgaaaaatttgccagactagtatcatttttgtccaattgtctatgttatttcaaaaaaaaattctttaaacttctgtctttctcttcgagaaagcagcattggtgcatgcttattttgataggattccacctacactttcttcctcaccgacattttctactgtttttataaagtagataacactgacttttctactgatttttataaatttgatttacttatattttatccaatgattgggtttagtacttattttaatttttgctttctaaatatatatatatatttgagggcaatagagaataaagtacaattacttgatgtcaacctttgagaaccacagacaagatttattacaacatccttttaggccagtgaatgatcacagcttgtaaaaagtagaaacttgggcttttctgattatcagttatatttttcaagggtgtttgttttataagaattagggcgatggctacgatatgagctgctgtaagagaaggaagagagttgatggagctgatttactctaaactgaataattagttcttggctaatatactttaaaattaaccttattgagaggtgtgggtgtgtgtgggtgtgggtgttcagagacagggtctcactctgtcacccagactggagtgcagtggcatcatcatagctcactgtaaccacgaacctcctggaatcaagctatcctcctgcctgagacttccaaagtgctggaattacaagcatgacccattgtgcctagctgaggtgtaaatttatctacgataaaatgcacccattttaagggtacactttcttgagtttttacagttgcatatgcctgattaaccactatcaccattaagatatagaacatattggccaggcatggtggctcacgcccgtaatcccaacactttgggaggctgaggtgggcggatcacaaggtcaggagtatgaaacc

SEQ ID NO: 119841 - DNA, 1061 bp, Homo sapiens
aattttcattttagccttacttttggtttgttttgagacagaatctcactctgtcacccaggctggagtgcagtgacacaatcttcgctcactgcaacctttgcctcccgggttcaagcaattctcatgcctcaacctcctcactagctggaattataggcacacgccatcacatccagctaatttttgtatttttagtagagatggggttttgccatattggccaggctggtctcaaactcctgacctcaagtgaactcctaacctcaagtgatccgcctgcctcagccacccaaagtgctgggattacaggcgtgaaccaccacgcccggccccattttagccttacttttatccaaccacctacttatttgagaaataaataaagattgtacgtctttttaattttacaagcaaataatttgatgagtttgtggttattccttaatctaaaattatgactaaagataatgtgttatctatcaccaaaaagacaaacataaattaacaaggtcaagatcaaccctgttaataaagccactggataagtaatgagatttaacatcacacatatctttattgctatgctctgaaaacatctcactaatgaagcacagttaaattgctttgttttgagtcacttgtaataatttattttccttcctgctgctaaaaagagaatggaacttttgactcagtaaaagctatgtgaaatcttgtaaggattggagaaccatttctgcatgtgaactctgagtttctctcaataattattgaaatactggttattaaaatggtctgtaggagatttgaatcatatacaacaaaagccttattcatctctacctatgatatttcatatttgaatactattcttagtaaagttctagatggtttgtatggctagatggttgtatggaaacaacacttatttatcacctaagtaaatttgcagacagaacatagctaaagattaaatatgattaggatatctaaacatgatactaagaacaattagagaaaattaatccagacttcttggaaagcttgtaaccttttca

SEQ ID NO: 119842 - DNA, 1055 bp, Homo sapiens
agcctttgaggaaagggaagctttgctctttactgttggccctttgtattgtcttggggagacactccctagactgcacacccaccacaaatgaccataaatatttctgtatctcaagctggagcctcaggaaaaccagaaagcgcaaaacgacgaactgcataggcatctgttgcgagtgttgaaaagatctgtcccggattttggaagggccacattcaataaatccacatgtagtttgttgaacagattaacaagcctttaaacatacttacattctgttctagggtttaataaaacaagtcctcagaattgatgcctttggcgcccacctattttcccagctaaagagagaatgtgtaaagatttatagctgagcttgcagttgtaattggacctttgtaaggtttttaaatgaaatactgtttttggttttgttttgcctttttgctctctacttctattcatacagttaattaaagtttagtattcactatgcaaattgtaacagggaatggttacattatgacattgagaaagatccttaaaattacttgtttcaaggataatgttttgaataaagaggaaggaggatagtagtggggaaggtttatcaagataacggtgttaaatttgagcagccttatccacttttaagcatctccttttgaatctagacttacaaagagttacagtacaaataggtaacattagcatggtaatatcgctttaagttttttgaagccttgaagtattgttggctttgatggaatagtattcttctttctaggattacagcctagtctacatttttatgatgaattatgcattggaaatagtgttcaaaaattgctggtctactgtaatcctagggacattttttttaagctctctagctagattattatttaactagttttggtttttttccctccaagagtgactgttagctgcccttgctcattggttctcagacttaaggatttttaaaaaacagtagaaataaaaatttggataaacagagagttcccagcctcttttaaatatgccgagta

SEQ ID NO: 119843 - DNA, 1420 bp, Homo sapiens
tttcatggtgatagtaagtaaactcattgagtacattaaatatttacagattaaattagatgcccatatcaccaacgaatgtcccctccccccacccccccgcaaactgcatattgtttcgggaaaaaattctgttgggtcagattcttgaaagcagtctgggggaacaggtagaatactttttagctcctgttgtgtagccgttacttgttttccttgctggcttggcacctgctccttgtcactcttaaccataagcagtgcgactgttagctactgtttaatgacatgaagtgttgtcatttgtgaagagaaacagatttgattttgtgggatttggtacaatctataactgtggacagttggttccaaatgctaagtaatcagttgatcatttttcgggctgaaccacgttagttactaatcaggatcttttaggtaaagatttgaagggtgattttgggatctattcatctgcttacttacgatagtcccttatctggagttataaaaatagcattgaaatatgggtactctcgtgttttgtccttctgacggatctaattctttgaatagcagatgagctttctgtgggattctgtcttgagtaccggtcatttcatttacagacaaactgagtagtcaacaaaacagtgctccttgtacattaggattactgtctttgcacagatgaagacaccaaatgcatttttattttcattatgcagcttggtttcatatttctccacagacttttcccttaaagtaacagtgcatttaaaaatagaaacaattcctcccttgggctctgggttgattaattgcagcagtgcttcatgctatgtttgcaattcatttctgtcattggtttttagatagtgctcagggcagggcaaaggtgaagagtagaatactgagaatgttattatttttcatatctgcaagtccaaggtttgaagtgtaagaggtctttaaatgcatattggcaaacctgtgtcaaattgagaattactgtttttctgaaagttgcaagaaattaccaatgaattagccatggatagaaattgaaggttagtgggtgaaagttttcagtcttaccagtaaaaacaagtgagaatgcattgacgtccagggaaaaaaaaaaaaaacagatggggtcagctttcattgtttccccattttacaaaaccaaagccaagactgtgtagctaggactaaaagatcagaggatctctgaggttaaagatgtttgttttgttgctgaaattctagtattgtaatacattgcataggtccaggttagtagttgatatgtatactgatcaccattctgaaacattaagacacatggatttgtttcttaaaataccattgcattgctctccaggagacatttatgaagttcagatcatttcagtac

SEQ ID NO: 119844 - DNA, 1071 bp, Homo sapiens
attggttatatttaggtgtgtttattaatttgaaaaatcaagaaggaagacattttagtatactaaaaattttttcttcattttaagacctaaggacccagcaagtggagatatataaattacatcaagtgccaaaagttctgagaatggattcatataaccctcaattgtataaagttgaaaatatgctatcataaaaaccctcgataagatttaataatggcttttatagctcatgttttcatttccttgttaaccatttcttgaattctttgttgcattaagtacctattttctagtattcagttagattaaaatgtttgatgaaatttcaggaaactatactttcttttgagaatgcataccttcccaggtgacagggtcaaatgttgcatgaacctaggctgattcatttatgttcctaaaccacacatttgacttcagatatttttgctataatacttacatatactatacatttacaaatactatatatttacatatatttgtggttcatgttatgaataatgtcaggtatattttatatataaatgaagagatttgtatatttatgtatataataattaatatttatatgtgtctatgaagagatttgttagagtggacagccttttgaaaataaagtccaaaaagccttctttgggtataacaattataggtagatagtccttttttttttttttttttttttgagatggagtctcactctgttgccgaggctggagtgcagtggtgtgatctcggctcactgcaagctccgcctgcggggttcatgccattctcctgcctcagcctcccgaatagctgggactacaggtgcccgccaccacccccggctaatttttttgtatttttagtagagatggggtttcaccgtgttagccaggatggtctcgatctcctgatgtcgtgatccgcccacctcagcctcccaaagtgctgggattacaggcgtgagccaccgcgctggccggtggatagtactttgaacatcattagcattttctccaacagtatgatagatgttgtagaactaaatggcagtttatt

SEQ ID NO: 119845 - DNA, 1054 bp, Homo sapiens
ctatagtaaatgcttatggtgcccattttatgtgtgagaacactgaggcttagagaggttaagaacttgaaaatggtggcttgagccaggtggtgtggtgacgtgcacctgtattcccaactacttggagctgaggtgggagaatcgcttgagcccaggagttccaggctagcctgggcaacatggcaagaatgtctcaaaagaaaagaaagaaaactgtagctttgtatttaggcaatctgacatacattcttacctaccaaagtgtataataacttgctccagactgttaaaaatatttgcagatgctaatatttaatggtctgatttttcttttgcagattatttaatgtaatggcaactccacgggggaggacaaagaaaaaagcatcttttgatcattctccggatagccttcctttgaggagctccggtaggcaggtagtgttcatttattcattcaacaagccttttttgagcatgcagaattactgattgggactggagaattagagttgaaaagattactccagccctcaagttgcttgtattctaggggagaaattctcagtacggtcataacacagtgtgataacatgatagaatatacaaaatagaagcattatctggcagagggaactgtaagtataaaggcgtagagtgtgaatcagcataggatgttcagagattcacggctgtgtggttgcttccagagtgtgaggctggggccagatcatgcctggcttggatgtcattcataggaatttggacttcagcttggaattggttgaatgctattggagggttatgtatagggctttttgggtagggcttttattcttttaaaagaaaaaattgaacaatgtaattctttctctataatttttctagctttttatttaaaatagagggggccaggcacggtggcttacaccacctgcaatcccagcactttgggagtccgaggccggtggatcacaaggtcaggagatccagaccattctggctaacatggtgaaaccccgtctctactaaatatgcaaaaaattagctg

SEQ ID NO: 119846 - DNA, 1069 bp, Homo sapiens
aggaaggcagaggccacagtcttctttctttcagagtcccactgcccacctcagcactgagattagtctgtgagggctgtcatcacagagtaccgcagactggctgccttagacaacagaaacttattcctcacagttctggaggctggaagcctgagatcgaggtgtcggcagggttggtttctcctgggtcctctctgtttggctggtagatgctgtcttctccctgtgtcctcacatgggcttccctctgtgtgtgtctgtgtcctcatctcctcttcttatgaggacacaaatcagattagattaaggctcaccccggcgacctcactttaaagtaattacccattggagaccatgcgacgaaatacagtcacattctgaggcactgagggttagggtgtccacatgggaatttgagggagacacggttctgcctgtaacagtgccctgtacctttttttacacaattgtcttccttcctttttttcttctcacatcatacacacttccctttttttttttttttgtaaggatataaaaggctcggtattttctacgtggattctatatttactgaagccctagaagctttgactacagctttccttttaagaggagccttggccagctttttttaatatcgcacacatgcagatagtctcttttctccacggagctcaggatactttgtttgccagtgtactaaatctcaccatctctggagatttgtaaatggccatggcttatatctttttgaaataaaggagcagaaatagaagtgaaatgactcaaaagttatgtaagttaaagagaaaggggcattcagatatgttgcttattttatttcattttaatttatttatttttgagacagagtctcactctttcgcccaggctggagtgcagtggcacaatcttggctcactgcaacctccacctcccgggttcaagcgattctcctgcctcagcctcccgagtaggctgggattatgggtgtgctccaccacacccagctaatttttgtatttttggtagagacagggtttcaccatgtttgcctggctgg

SEQ ID NO: 119847 - DNA, 1083 bp, Homo sapiens
tatactggtttgctttaaagaagggactaaatatgactttaaagagacttcaaaatattgagtattttaaaaatttaaaagtaggtcagtttataacgagtaaatacctaacacaccaagaatgtgcagtgaacctcaggcatttaagacacctcccccaccgcccgccccccgccccccccaatcaaagtgtggtcccaaaacaagccaacagctgtatatctcaaaagttaacccaagacaactctgatatttaggttatttgttgagactcattggtactgactggcaagtattctgctttaaagtatcatgtattaaaatgtttagacagcatgtgttttaaagtgataaatgcaaaatgttaagtttgaaatggttaacagtaaattattatgttagtttccaggcacttgaactgtgctacaagtaggggaaaacctactttaaagtatggtaaatgtgtgttttaaacttcctatcaagtgacatacttcatttgattttttgtttaagaagccatggtacttttttcttgagttactttggatatgttttttcaatgccatctgaagattttgtaattgagtagcagtaaatatacagatttacaatgttttaactacagttcatgaatagctggttgtgtaaaactaataaaaaactagactttcacatgtactctgtactgtagtggtgatacatccatttaataagtgtgcgtactcatcaagaactttcatacagaacaactccatttcctcacttccaaatactctatgcatgactacttaccttctttatagcaaatggtcataaaattaaccttaattattcagttttgtgaagtcactccaagaaaatggtccattaccacaaaagagtattccaaattgtataggttatagggctgaatcaatttaaaaatcccttttcagaattattccccataaggaaatgctatatacacctataagatatcaaatgcaagtgacttaaaacaccagtgatttagatttatttttattgacaaggtttataagaacaaatatttaaaatcgaaggccaattattaggtctcat

SEQ ID NO: 119848 - DNA, 2983 bp, Homo sapiens
acagctcactgcaacctcaacctcctgggcccaagccatcctcctgcttcaccctcctcagtagctgggattacaggcatgcatgaccatgcctggctactttttaaattttttgtagacacaaggtctcaccaggttgcctgaggctggtttcgaattcctgggctcaagtgatcttcccacctaggtttcccagagtgttggaattacaggcgtgagccatcacatctggcttgtttatggttagttaattcattccagactctcagcctgaaaacactgagaatgtttgcatgctagttttccacatcatatacaatattattaaaatactcatttggaatagaattccatatgggttaaccagagtactgttgggatggttgtggctatttgcacgtagcagatttcctgcttttattcaaagacaatattactggattttaaaatctgcttttaacattatttttccttttcactatacataggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacgaggcaaaggtgaggggaagatcagcaggtagctgtaattctgtattgatctcaactgatttttgaaggacaaaatagtaaaatagatgtggaaaaaatgggataaaggtttatgatttatggcaaaataatgtttctctttcattacagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtcatgcatagagtatttggaagtgaggaaatggagttgttctgtatgaaagttcttgatgagtacgcacacttattaaatggatgtatcaccactacagtacagagtacatgtgaaagtctagttttttattagttttacacaaccagctattcatgaactgtagttaaaacattgtaaatctgtatatttactgctactcaattacaaaatc

SEQ ID NO: 119849 - DNA, 2872 bp, Homo sapiens
tgtaaatgggagaatttaaaatatcttggaatgtttaataggaagcttttcctttgggaacattaattaaactaagaattaatgctttctaatttcacaggctccacatgagacaaagtatgaactctgattttgtctttttttttttttttttgagacagtctctctcctggagtgcagtgtcatgatctccactcactgcaacctccatctccagggttcaagcaattctcttgcctcagcctcctgagtagctgagactacaggtgcccaccaccacacccagctaatttttgtatttttaggagagacagtgtttcaccatgttgaccaggatggtctcagtctcttgatctcatgatccgcccgccttgacctcccaaagtgctggaattacaggcatgagccaccatgcctggcctgtcattttaatctatccatatttatgtattttgtttgtgtctaatcacctatgggttagtgtttaagaacacaagttctggagtcacatctatatttgaatcttgcatgtttattaatgtgactgtggacaaggtaaccacactgagccttagtttcctcatatagtcataagtatttattgagcaactactgtataccagagactattttaggagttagggaaacatcagtgaacacaagattctaggccaggtgtggtggctcatgcctgtaatcccagcactttgggaggccaaggcaggcagatcatctgaggtcaggagttcaagaccagcctggccaacatggcaaaacctcatctctactaaaaatacaaaaattagccgggtgtggtggcgagcacctgtaatcccagctactagggaggcagagacaggagaattcgcttgaacccgggagggcagaggttgcagtgaaccaagatcgggccactgcactccagccagggtgacgcagcaagactctgtctcaaaaaaaaaaaaaaaaaaaaaaaagattccagttgaaagagagagaacataaataagagaagataatattatctatatttaggggtcccccccaagattaagtagagtaatgcatatgtagtttatccatagtgttgaataaatatgggcaactcttgtgtgtgtgtgattgtgatttgtcatgcttagacttgtgttgggataaaattgttgtatattagtcatctctcaaaaagaatttttaattgctgataccaaatatattggttttctctaatattattaaggggcataggggaagtagagggatgggatgggatagcattgaatctcatcaatatgtgtacttttactttcttttgtaacagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaaggtatgttagaaataacattaatcagcaactttaaagatatagcatatattaatatgttgtacatagtatttaagtgtgtgggagaaacaggtaaactgcagagaacattgcggggagaagtaatacaggttgaatatcccttatctgaaatgcttgggacaggaagtgattcagattttgcaatatatatatatagagagagagacagagagagagatatcttggggatgggacccagtctaaacatgaaattcattcatgtttcatattcatcttaaatagcctgaaggtagtttaatattttaactaaataaattatttattgcagtggtgccgttacagctcactgtagccttgaactgctggactcaagcgagtctcctatcttggccccccagagcactgggtttacaggcttggaccactgcccttggcctgaaaccaagttttgactgcgacccgtcacacgaggtcgggtatggaattacctcctggtggtgtcatgttggtgctctgaaaagctggattttggaacatttcaggttttggatttttggattagggatgcctaacctgtataccagttttttatagtttttgatttttcaaattgactaaaatttgtatgcatgttttataggtaactgtagagtagtgatttataatttttttgatccagtacccctttgagaatctgttgaaagcttaaaattcatctcagcctttgttaaatgttaatttactatgtaagaaaaattattattattatattacttttagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtaattagacaaatgtttagattattttgcttttgctagaaaaattctttcacttatctctgaatttgaagctaaatacttacgtgcattcacttattgaagaaagatttattgaactactatatgccagatctccttacaggtgctgggataccacttaaaatagtcaaagtctctgtcctaatagagttattttataaacaacattaaaatgaataaagttagagtgaataaaattaaagtgacacattccaaaccacataggaaactttttctgatctgtaggttgtttctattgatgtatccttagtttatgttagtttaaagaagcagaatctcatgaaccgtcttattctcttcttagtgtgataaatgagctgttatagattaggttcttaactcagacttctgcagcgtctttctaatatttctaatacttctcaggaaataaagtggccttgtcttgaatatgattccatagggatt

SEQ ID NO: 119850 - DNA, 1033 bp, Homo sapiens
tgattgtttaaaaaaatgaatatgcaacaaagattatatgtagccgggaaagctgaaaatatttactatctggcacttcaaagaaaagtcttggtgacaaatctagtccataaatgtgcttttcattttatgtggtatagctagatgagtcacctctggagcttcaaaaacatatacaggtgctcaggaatcaggatgtttggctgtaacacccttgttcttacagcttcacaataccttccataaagtagggataatgaattgcaggccaagtactttgagagtatggattaatcaaattgatggtattgtgaaagatttagaggaggtaattgttaagctaggtttagaatcatgagtggggttttcctaagtacaggggaggaatgaaagtaatgaagatttgaaagttcatgtaaaattaaaggggacattgtttaacttgccttgtcagctctccctgtgtttttttctgttacctccaaattctggttacccatatttaccttgacagacaaaaattgtccattgtgtcctaataccaaggtatgtcctttgagatgcccccattttccagagacctattcctcctatacctaataaccttcagggcagccgaagtgatgaaaacctgcaggactaaagcacaagatacaaattcattagtagttttactgttcagctttcatgatttcttaactcagcattaatctaaaaaagagactttaccaaattcctaccttaactttgtcacagaagaatttacagctggttgctaaagataaatgaaattctgtataaatgacatgacgtattactatagatgtttgcgggccatgtcgtatctactataatgtagtgaagtaagtgcgatatatcatggctagttaatacagttgttattgagtttgtctcactgtgtttataatttccagtctgtgtatctgccctgcttttaaaaaaaagaaaattagttttttagagatagggtcttctgattttgcccaggctggtcttgaacctctggcctcaa

SEQ ID NO: 119851 - DNA, 1096 bp, Homo sapiens
gtatctcgaaagtatgaaacaaactgtggagttttacgagtatttagaatttatctgaatgttgccatatgttatcaggaatgttttctgctgaaataattgtcagccttactaataatgttcgaaacaggagtttatttttctttcatgacaagaagcccacagacagggacattctagggccagtacagcagttcaagaaaggaattgaggatgtgggtactgtcctttcctgatctctcatctttagtatatggcaattaacttcatgatcacaaggtggttgttttacctttagacattgtattcatgttccagataaggaagagcaaaaggttttcttctagtgatgttttggcttttttccctgaatgggatgccttttaccagagatctccatatacatggcatcagccagcactttgttgtctgcccacctaactgcaagagaagctctgagatctaggtgtcagctttcctacctttataagaggaaggcagatcaaaagtgggtggttcagtgagccatcttacaatgtttgccaagtcagagaaactccattataatttttggtaaactatctatttggaccattcaagggattatctggtagtggtaaggtgaatgtgaaagttttgttagtcctttcacattgtgttttagaaaactaaactatctcttcctctcacacgttgatcagaggaattgcaaaatctgtataaaccatttaaacctttcgttggaaggcagaattgaataatcaccatactaaaacccatttaaacttgctttcataatcttctgtgaaatataactagacttgcacattctttcctcttggcattctgagttttctcagccaaattgttgaaagaatagtgtattttaagctaatttttattttgttcatctgttcacccagtacaacctttctgctgtgaggacagaattctggctctgtgacaggcgtcttttttggagaccctccttcaagagccctgctgcctataaatcataggtaagccttgctttcccaagattttttttgccttccttcaaaaagtgcttatgtcattcctctgattctgtaccttc

SEQ ID NO: 119852 - DNA, 1802 bp, Homo sapiens
agtgaactctggtattatatgatatgtgtgggtgtttagtatgtatgtttgtcttgagttatttacaattcatgcttgttttagcgtcaaattttataaagacttctataaagctaagtatgaaatgcttcatcatttaagaaagagggttacgaatctagtaggtgcttcataaatatcttaatatatatttggcacaaaggaaaataagtaatctgagcattaaggtctttatggattggatatccgggaggaaaacatgtttgtttgtatgtatatatataacagtggaaatttttaaactgatagtatcttcattcaggaaatatttggtgtctactgtgtgccattcagattcctaaactctctttatgggcagagttaaagcacgaaacattatcatagaatataaatgtctaattttttcatagagacgttagcatgggctctggaaactgagttcaaatctgacctctatattggattattactgtattagtataagcaagttatttaaactatacctcagtttcccatctgtaaaatggggagtgataatagtattagcctcatagggtcatattaaaggattttatttaaaatacttagagcggtgcctggtgcatatagtatgtaagtattagttgctattattattagaattaaaatgatgttttatgacaagtaaaacttctaaatcgaatcttcttgtcattactaggtgcaggttaaaaagtgagggcaggccgggcatggtgacccatgcctgtaatcccagcactttgggaggccgaggtgggtggatcacctgaggtcaggagttcgagaccagcctcaccaacatggtgaaaccctgcctctactaaaaatacaaaattagctgggcgtggtggtgcatgccgataatcccagctactcgggaaggctgaggcaggagaattgcttgaaccggggaggcagaggttgcagtgagctgagatcgcaccattgttctccagcctgagcaacgagcgaaactccgtctcaaaaaaaaaaaacgagagcattttatactcacttttaaaattcgctttctaaattgttgtcccatagttctgtagaggtagttgaacttggtgtatgcagatgatacctgatttatacccatattggttccaggataataatcacaagtggaaccatctcactataaatcaaacctttaccttctgtagtgccctaatctagggtctgtgactagaaacccaggtcaattgatgaaaatccatgggagaagaaaatgtaaaaatgctttcagacattaggtgtatgaaatcacacaatataaaagctatatcatattttattagagggatttttttgctacctttgctagtacttgacagattttataaaatgtaaaataaaatttggactgagaaattgtttcccccccttttttttccctgataaatgtctctccaacaagcattgttgctttaaatttagcactgtcttcagctttttattgctgattcagtttctgtgaaaggcctttgaaaggtaagttctggcaggaggaacagtgtatctgtggcaactttgtttttccttattccattttatgaagactcagttctaaatgtcagccatgttaggaacttcataaatggagctatttttggtcattactatggaaggacctcttttctaagaagccataaagaaaagttgcaagttagtcacagaagttttggattgcctgtagatttctttatgataggaaattagtgagttaatattctgtttattttctgacacag

SEQ ID NO: 119853 - DNA, 2513 bp, Homo sapiens
gcagccactttttcttaatttttgtgtaggtgacagtgacccctagactggaggttcctgggaggtaaaggacctgtcgttctagtctctgcaagaaaaatattgcctaaagttatcacaaacatttacacaattggataccttaaggttatgttatggaattttaccttaatgtttctgcttattgcagaaaataaagtaacaaaggtagaaataaaagaatataaaagatgctcaatcccagaaataaatattaattctgtaatgcgcattttaacattcttgatgttaggtaattttatggttttcaattttagaatttagcaaaacttccttgagaaagcacttaaaaattaaatttattgtttactgtaatcaactcattttcatcaggtgatctctgcttttaatatacatggtttaattgattatcagaataatagcagcatattcttagtttcataattaacatacttatcatttattgtatacttataggcatcagtgataatatgagcctgacattgttgaaagtagaggccagaagtaatgaatataaaccgtatagttcattcataaattcaggatgtataattggtaataaagttatacattttttttatgggccaggcgtggtggctcatgcctgtatcccaggactttgggaggccagggtgggtggatcacttgaggtcaggagtttgagaccagcctggccaacatggtgaaacactgtctctactaaaaatacaaaaattagctgggcgtgatggtgcatacttgtaatcccagctactgcacaacagaatgagactctgtctcaaaaaaaaaaaaaaaaaaaaaaaaaaaaggtttttctcccattccttcgattggagtgttgggccttctaaagcaaggagcttctttggcagtgacagttttttgttttttgctttttgtgtttttttgagacggagtctcacactgttgcccaggctggactgcagtggcgcgatctcggctcactgcaaactctgcctcctgggttcacgcctttctcctgcctcagcctcccgagtagctggggctacaggcgcccgccaccacgcccggctaattttttgtatttttagtagagacggggtttcaccgtgttagccaggatggtctcgatctcctgacctcatgatctgcccgcctcggcgtcccaaagtgctgggttggcagtgacagttttaatgcttgtagggatgaaataaattacaaatctaacttaaaatattatcatgacaaagtattaacagccgttggagcttaacataatgtgtcttgagcttctagtcccatgtcagaacctagaatacatatttctctacaattgagaagggtcttgctaggtgtttagaacacaaatggtattagtaacacagttttaggttaacctgacacggttaaagattattctctgcaaagctgctgggcttgtaaatacaatttcttgagagaggaataagaaattgagttgataagttttcaagaagagaattgattgaaatattatacctcattggtgttatctttataaatttttatgcagccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggaggtaaaatattttactatatttttaaatcatttctttccatggggagagttaaatatttctgctataaggtacagccagaaaacacttccttattggttgtttttaattctgaagatgcagaaatgattaagtatgaacccatttcttttccttaaagagcttttagtttcattaccatgtcagagtatgagtcagaaaagagtgaggttggtgtggactggatttgaagtgggccttgagctggacgttgaagactagagtagataaatgggaagggaagcggaagtggtgcatatcctgaataggaccacataggagcagattcttcgaggatttttttcgtaatatattgatactttataattgacttggatcattttattttacggaaaaagcaagggacttaagggcctttttccccccctcaacctttaggggactatgtagtgagaataaacagcatttgaagtttatataatgagtggataaattttgtattacctgtcattttcttttatttgggagtatttgtaaaagttgagactcttagtttccaaagtgaaacttcatgaagaagagaactgctgaagcagttaaataagagggttaacctcttcagtcaggtagatcatggagagtgggtacaggagatgggtttctattattgttaatgatgttttggtagactgtattttaactttgatgttttcgttcaaaggttggaacttgctctatagattgggta

SEQ ID NO: 119854 - DNA, 2125 bp, Homo sapiens
gaaaggttttagtgacctttaaatgtattgaaagaaattcatgtttttggattttctcgacattcagaataagtgaatgtcggtatgatttgtatgagatcatacatatgatctcatttgtatctcatacaaataagaggcaaaatcatttgtatctcatacaaatctcatacaaagtgaatttggtgtaattgtatctcatttttagcaaatacctgataaattggatgatagttctttgctaaaggattgttattatactgtacatatgacttagtatattatataatcgagggaactgctttaggttgtacgtgggcaaagtaaagttgggtgttagaatgtctgaagtagaatagaatgtctggtgcatgacataatttattttcagtgagtctgttaatctcatttaatccttaaaccaatttaatttacacaagtcccataactagtgaacggtattagctttttgtggtactcgctattctttactttgaaagaataaagtccttcttgatttggaaaagaagaattactagtaactttattacttatgaaaaggatatatttttaaatagtaactttccacatcccctggtactgtcaggtaacttttggttgtggtaaaaactccccagtgaaaatttgttcaaattgttcttttcagagacttaagtttgtaggatttttataatgttaatatgttaatgacaaatacatttttcagttttgaataagaaatgttgaatattgaacccatattgaattggttgactgttcagccagtattgtaacttacagacaggtatgaaaataaagatgttgactttgaattggctttgaatttattcttgtgtacattactgggtaataaataccattaataataaggaacattttcaggtgtcctcattaaagaagaatgtgggtcagttcagtggctttccatttgaaaaaggaagtgtccaatataaaaagaaggaagaaatgttgaaaaagtaagttatttttataaatactgtattttgatcaatatgctttaagtttattttttaatgttaaatcacattcgggccaggcacagtggctcacacctgtaatcccagcactttgggaggctgaggcgggcgtatcacctgaggtcaggagtttgagaccagcctgaccaacatggagaaaccccgtctccactaaagatacaaaattagccggctgtggtggcgcatgcctgtaatcccagctacttgggaggctgaggcaggagaatcgcttgaacctgggaggtggaggttgcggtgagccaagattgggccattgcactccagcctgggcaacaagagcgaaactgtctcaaaaaaaaaaaaagaaaaaagattcatagaagcattggccacttttttaaatgtatgtaactgagccaatttggttggctttccctttatattgtggagaacatatgtaagctttcctatattaacaccttggtttcttccattttctgtttcagatttagaaatgccatgttaaagagcatctgtgaggttcttgatttggagagatcaggtgtaaatagtgaactagtgaagaggatcttgaatttcttaatgcatccaaagccttctggcaaagtgaggatcaatttttatttttttcataaatcagttattcatagcctctttatatgaaacaaaaattgattaataacagcattgctgtcagtattcgttcatatctacattcaaagactataccttctgttgacgtatctgcagtaatttcctgatagaaataatatagatgccataggggtatgttgcttcggaaaatcagatacaagggatataaggttaagaatagtgaattaatgtcagaagggacagaaagtactagtagtcagggttaggtatctagaagacactggaagaataggaagaggttgggctgaggatgaggtgcaaggctggagggaaggggtgcaacctgtaatcaagtgaagacaaaatagggagtatattagaactggatgttttcctagatcctggaataaagtattaaaaagtgacatttaaaagctaactcttacaagtttcctatattgggtttccagaatctgcagcagagccca

SEQ ID NO: 119855 - DNA, 1068 bp, Homo sapiens
acttcaggctgttctgcctggaagtctttatttgtgtttcttttgtcagtttactaaattgttattgttctctatatatcttttgaagttcttaatctcccagtctaaatttgattattcctgaagtacagcaaactgaatctcaattattaaatagaattatgtccaaagattaaacagagctagatttttttcacaaacgaagtgactggactgtaatggcaataattttagttggataaaaattagtttgctttctaatttttttttttaactgagtccctgtgagtgccaggtgagtaaaatgttactctgaaaaaattttcatggtgctctattaattaatcaagtgttttcctcttttatgtcatttgctttccaaaaccatgctcagaagaagaataaagtattaggttttggggactttgttctacatgtgtatctaataaagttaatacaatgtttaagctttttgttaattaagaaatactaaattaatttctagaaaagagtctcatcgtggaaggcaagagggaaaagaaaaaagtagagaggttgacaatgcaagtctcttccttacagagagagccatttacaattgcacaaggtaagtttattctagcttcctttcattttgtggtgaaagtgcctaaatttgtgaaaatgatggtttgtagcttagtatcagcaaggtagtgttttatacttttggtataattttatttaatttgctctgtaagagcagagttacatgtaaattatgctgtgaaaataattctcattaaattaactttgtaaatgtattagtaagccataggtatttaattgtgatttttttttttccccaggaaaggggcagaaactttgtgaaattgagaggatacatttttttctaagtaagaagaaaaccgatgaacttagaaatctacacaaactgctttacaacaggccaggcactgtaagacctttttacactttaaacctacttgtatattacttcacaatggaatcaatttctgtaaatgttagtgatccactagttcaatttccacactttatgactgagca

SEQ ID NO: 119856 - DNA, 1719 bp, Homo sapiens
ctttccactccacactgccctagtagaggttttctttcttttttttttttttttttggagacaaggtctcacttgtcacccaggctggagtgcagtaacatgatctcagctcactgcaaactctgcctcccaggctcaagcaatcctctcacctcaggaaccacaggcatgcgccaccatgcccgggtactttctgtattttttgtagaggcagggttttaccatgttgcccaggctggtctcagactccttagctcaagtgacctgcccgtctctgcctcccaaagggcctggattacaggaatgagccaccacgcctggccctgagtagcagttttctgtgagagttccacccctgcaggaggcttctgcccaggcacccaggctttctcatatatcctctgaagtctgtcctaagaaaggggtcagattagccaaaattggcagtgattttggggaaaagggaagtgagagaaatgactagtaaaagatgactcttaggtttctgtctttggcaggtgggtggatggtattaatgttttttgaaaaaaattcacaaagtgagcaagtttggagatgattatgatttttcttttgaatattttgagtttaggtgcctgtaggacatgaattgtagctgtccagatgacagacaggcatatactgttggctctccatatctgtgggttcctcatctgtggattcaatcaaccacaaattggtaaaaatggatggttgcatctgtactgaacatgtacagatttttttattattcctaaacaatacagtataacaactatttacatatcagttaagttgtattagtcattatgagtaatctacagatgatataaagtatatgggaagatggtcataggttacatgtaactactacaccatttttttaaaaaataagggacttgagcatccatggattttggcatctgaggggcgtcctggaaccaatccctcacagatactgaggcaatattagttaatatgaatctcagatgaaagttgtggcttggagattgactgggaagtcattagcttgtagttagtaatcagagacaagcaaatagtttaaatcactaagttgatgaagttgagtgatagtaggggttgttttagtgtgtttggtcttcattctgtacaacatggccagaatatacctgttgatagccctttctcctgaagtattctttctgtgcgaatccttacattactaaatctaagctgtctttaaaagccagcacacgtgctttgttcctttttctctagtcccaaaataatcaattcctcctcagtgcacagcaatttatttgtgtatctttcttaagatgttttgttatcttttatattggcgtatatttatgtctcatttctttagtagcatctttttcaaaagatacgcagtttttatcatccatttatcccctcttagtattgagtgcagctgcacaacacaggcattaaataaatggcagaacctcgagcagtatatagtattcttttatctgactttatttcattcaaaaaatgattttattttagataaatggagcttaatgttttgaattttgaagtatatgctacctgttttctagatttttttttttttttttttttttttttttttttttttttgagacggagtcttgctgtgtcgcccaggctgaggtgcagtggtgcgatctcggctcactgcaagctccgcct

SEQ ID NO: 119857 - DNA, 2297 bp, Homo sapiens
ctatgggaggaggcaactttcagggcaggtgtcccgcgggaagggtagcatcattcagggtggccgcccggtcctgcctgcgggagtaggaggaccgagacgtccggctttcttcccgcatgcaggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaaggtggggggagtcgcatcccaactgatgaatttttcagaccgaagtttttttgtatttttcacccaggaaacagttttcttgctcttttggtgtttagaggcgtgaagtcggagtgattttcagcgagaatgtgtgcacaatttatctgcttttgttttgagcgatggcgtagaattgactttgtgtattccggtttttaaagtatttgttagcgtggtagagatgtattggagtgcagccgacttctcgtccgctctaaacgttcgttaacatttcatcatttgacgggaagtttgtaggtcttggatttgatttttttttttacctgtgtgtgtgcacctttgaagttgctaagtggatgttctaattttgtccttttcattacacatcttttgccttttgaagttattgtaaggtcttggtgcagcccgttaagactgaagttataaggctagacccggaagtatttgaatactttcgaatatttttacatttaccaaaaagtttccctccctggcaaacagcggtgaaagctgttgctacttgagaaagtagttaaaaatgaagaaagtgaactctgaaagaaagttaaatgtgagcccagcactgtctcggtttcgaacctgtgtctgttttaagggagggcgatatgagccctgatttgactggaggtgtgaaacggaaacttgactgaatagaggagtgtgctgcggcagtttatccaggatgcatgcagtgtctgtttcaggtgtacccgcttcttgacatgtttccaaacatttaaaaatccgagtcgcatctcttagcattctttgatattagcttagtctgcggttatttcgtatatgtttacgactcagccacacttgggaagaggttgaagcgctcttcctaaacccggattttttttaagcctcaaccagcctgtggtcacaatctgggttaagattacaaggtgtgccttttgtttgtttaaagtggtatgtgccctaagaagggcatatttaagtaaagcatggctttttaaatataagttttcacataaactattgcttaacaacatgttattttaaaattatttttaatacaacaacaaaattggctgcactatctcgctgctagccaaagaggctctgcactttttctccaattttttgtttgtattttggtcttctggtgggggcagggttgagatgccaaagaaatggtgaattttcttcatgtcaggaaaaaattagagaagtcatgtaaatatactgtaagtggccaacacagtaatgcttggggaagagttggtagttgaaagaatcccatgttttgttctagacaaattatttttaaaaacatgatgttgtagaaattttatcccctaatagttttattgtagctgtgatttattattctttttactaatttgaggtgtttgtgggacaagtagaattgtgaaagtttttattttacttaaccctgaatatttaactttagaactgaggcatcatggaagccagacagtgaaatactttctgtattaggcttttttttttttttgcgttactataaagaaacacttgaggcagggtagtttataaagaaaataggttttattgattcgtggttctgcagacagtacaagaagcatggcgccagtatttgcttctggtgaaagcctcaggaaacttccaatcatggcagaagacaaagggggagcaggcatttcatttgggagtgggagcaagttgtagagggaggtgccatgctcttttaaacaaatcttgagagaactcactcaccaccacggattaccatgctaagccgttcatgagggatctgcccccatgatttaatcaccttaccaggcctcacctccagcattgcaaatcacttttcaacacgaaatttggagggggcaaacatccaaagcatatcattgcacccccggtcccccaactctcatatgtttctcacatttcaagattcagttgtgccttcgcagtagtcccccaaagtccggtcttgtt

SEQ ID NO: 119858 - DNA, 1032 bp, Homo sapiens
ctgaagacccactaggttattccaaagaatgctctaaagttttggatgtggggcacgagagtcaggtagaaatcagtgatgaccttggggtttttggttcaacaactgtgagaacaggagtagctattcgttgagatgagaaagacttcgggggtgggggtgggcaggatggttttagaggggaaagtgcaggaggtgggaatgagttgttttgttttagacatgttagttttgacaattcaaaatggagattcaggagtggcagttggatttgagagtctggcattcagcagaagaaactctagctcaagaaataaatatagcagttgtcaacatgtagatggtatttaaagccctgaaactgaatgaaatcactaacagggaacataggtagggataaggggatattcaaaattgtaccttggagctctccagtgttgagaggttcaagagtgagaggggaaccagcaaaggagaagagaagagcaactgtagccagtgaagtgggaagagacttacatgaaaattgtgtccgagaagccaagtgacaaaggagtgtttttgaaggagggtgatccactgagtcacatgctgataaaaggtcaggtaagatgagaactgataattgaccactggaaataccaatgttgtgttatcagtgacatggactattctgtggggtggtgagtctaaatgttccaggagtgggaatacagagagacaggtaggcaaggaatggattcagacactctttccaggaatgttgctgtacaggaaaacaaagaaggagcagtagttcaaagggagtttggttttgaagaaaagagacccatgtttgtatgatgatgagaatgaatcagtggagaggggaacattgatgatacaagagaaggagacagtagctgaagccaatctacagtaggtaggtcaggttgggttctctgtaagcagaagctgaaacagaatttgggacaccaggtgattattagaggtgaagaactgtgaagggaagggggaagaagtaagattggg

SEQ ID NO: 119859 - DNA, 1125 bp, Homo sapiens
ggcttaatcagttttcttctctcaaatactttcaacgtcttcttctctattgactcttttccattagcaaataagcatagtctactcacctatcttaaaaaaaagcacaggtcagctgggcacggtggctcatgcctgtaatcccagcactttgggaggctgtgagggtgtttggtcaggagttcgagaccagcctgaccaatatgatgaaaccccgtctctactgaaaatacaaaaattagctgggcgtggtggcgggcacctgtagtcccagttacacgggaggctgagacaggagaatggcctgaacccgggaggtggaggttgcggtgagctgagatcgcaccactgcacaccagcctgggtgacaaagtgagactccgtctcaaaagaaaaaaaaaaacacaggtcaaagttagtgagaacctaaatgaaagttgtggcagaggggattgggaggaggggctagatgggatagatgggatataaatagtgttaatgggacttggtgactgattgaatacggcaggtgagagatagagggaggaatctaaaaataaatcctagagacctggtttgggtttatggtacacggtgcagtcatagaaaaggaggagcagggctgggagaatgaaaacctgtaacttcagtccaatgtgccttagggtgtgtaggtcaggaactctgactctgcctttgaatcctgctcctgtatcctcctaactaagcttccattctacctcaacacccattgtcatgactccttttcatagttggcccttaagccttcatttctggggttatttaactattgggagttcaaaccctgcttcctagagtttgtgagccaacagaatgtgtttgtttgtttgtttttgttttcatttttgttttctgaaaacaaatgaaaatgaactagttgatagaaatatgagtacacttgtaaatagaggatgttaaaatggaactgttttagtttccgtgttagctgtggcctaagacaatagaagccgccttccaaagtcaggtaagaatacaaagcaggtggaaaaggaagcacaggagaacaggtcagcattgtcctccaaccaggttagctcactgaccacatccagccaatgaaac

SEQ ID NO: 119860 - DNA, 1005 bp, Homo sapiens
actcaaaatcttattattgaaaccctaacccctaaggtgatggtatttgagggtgggacctttgggaattgattagagtatgggagcagagtcctcatgaatgggattcatattcctataaaagagataccagaaaacttgctgcttctgtcttctgccttgtgcaaacacaataagaagtcagtacctatgagccagaaattgggccctcaccagacactgagtctgccttgatcttggacttcccagcctccagaactgtgagaaataaacttgttgtttataagctacccggtctatggtattctgtaatagcagcctgaatggactaagactctctacttctccacttctctgggatttgtttttgtgcatctagtcctggttttttttttttagactctttctgtttagctattgggcacagagtccagtattgctaaggcctcagtgtttgccccagggcctggcaaatagcattggacctccagaaccctggagctcaggcaaatttccttgaggctgaactatagtgtgactcttcttagatgggttgtttgggattggcatcacgtgatgtccctaagcaggtagataggaaaaagctgatgtttaacagccatttaccattgttttccctaaagacagtattttcaggccactggccaaatgcttaaaactccttggagtaaggcattgggtttgcagctcctttctccccctgtgccactactcaggaagaaacctaaggcaggacaaggaaattgtgttgtgtttccctgcatgagttagagacatcagattctttttaaaggcagcatcatgtcttgtcattccttaaagtgggtggacctcagccacttgtcctgacttgttgagatttgcactgagaagcagtatgtctgaatgaaactcctgtcctctactgagacctcaggaagccctgccttttctccgagccaaagatctccacagctccaccacctccaagaatccttttacagc

SEQ ID NO: 119861 - DNA, 1049 bp, Homo sapiens
ataaatgagagcactgtagctagagaggttaatgactggctcaagatgtagaggagactttagagcttgtgcttcaacctacatggctggaatccagtttcattggctatagattataatgctttattttttcttagaaaaaaaaactttaggtagggcataatttagtgatagagaatgaggaactatatagtacgtttttaaaaatatacatatattccctgcccactcctgtgatttgttcttgggtaggtacatagtagctttgtcttaacactgtgaccctttttgccatgtccatcataataggtgagaacaccttatatgaagaatgcctgtgactttggtacatcggaatctgatacccttgaaaggggtctaggagacacctgtttctgagtagattccattgcatacaattcatagactctcagagttggaagagacaatatgagtcgtctggttcaccaggtgtttggttacatttttggttagatcccatatgaatccttaaaggttgtggagtgagtttgacgaacaatccttattattttgcatgacccttcatggcctaaaaataattctgtgttttaccaaactaagtaaaatgttgactatacaaaagaaaaaggtttttttcccttgggtcatttgggttttgagatgttctatttgaaacattttccttacaatttgttacctgttaagaaaattgcttatttaaatatctgttgaatgctacttaataaatgtaactttcaaaatgtgactaaatggtggtagttttctttgttaatagtgattattttattttgccattgttgcattgctataatttgttttcattttctttgtttctctctttataagctagatgccagttttcccccctagaattgttaaccatttacctgtgttttgtatgacatgcacatgggattcatgtgaacgttttcacttattttgcactttttagccagagatacagaagaagagagggacactcgagattaaatgttttagtgaaagttaatgggcagcatataaca

SEQ ID NO: 119862 - DNA, 1098 bp, Homo sapiens
ttgaaggatttaaaaggaggtcatcagtccacaaactattttagatgagggtgagtggggtacaagactgtcttctggaatcaaagaaggtggtggttaaaaaaagattcatagaatattattgaggtctcttgggcccagatggtatcaccccccaagtcatgttggtccagaagctgacgtagcatttgtttgtcctccacccatgatgaattagcgacaaagtcaggaactgaactctggttcctaaatgcctcctatcacttcatttgcttgtaccttctgtctccaactctgaattttatttgagacatctttgtctttcaggaaagatgtctgggtagcattataacagatgaataaagttgactttcagtgtaataaaagtccaaccacactgttgaaagaactatggtaaaatacatataacatgatattgcgcataattttttttgtaaagattgctaaggagctttaaggtaccagatgaaaatgcaacattttctccccaactggagaaagaaaatttggataaaaatgtttttataattaaagttatgttttaccacactttacttggaatgaggaagaccaaacttgttttgtggtcctttatacattttagctaatttagattcatttgcgaaataaacaacttgagattatttataagggaaaggattagattttgaatgcattataaaaggtataatatttgttaaatacaattttagctgcatcattttcttactccagttttctcaaagcagatgtcctttccttagttgcaagaacgtcaatgtaggtgtgttttgtgccaaaaaaaggtgatagtttagagttggagttgtcagggctaaaactctgtcctgtatgaacttactggatgtctggaaggctaatatcaaatgtgatttgatttgatttatatatgatttatatatgagaaaatctttattttctcatatataaatctttaagttatgtcaatatatttacatttgacatcaatggaattaaaatgtttagaatgctggtttaagagcagttagcttttcctgcatctgcctttaaaaataactaatttgaaatgtcatt

SEQ ID NO: 119863 - DNA, 1046 bp, Homo sapiens
aggccaaggaggagagaaatagacaagactgaagctggaggagcagctgctggttcacccgctgccaagacttggcagcaggttcctggggaagcagtaggcacctggttcacacaggaccagcacagctggtccagcttttgactggcagagcgtggcttccttcgtcaccaaagtgactggccctgtgattttgctacagcctgccgaaaccgagagggacacagtgaaagccgtacacctccgcgaagcaggtgcaagtcacatttcactaatgaacaatgggcactttgcacacaggaggctttgatctgaatgctaaaaagcccttctgttggacaggctgttggctgaggtaggcagcagtgagaagcattgggaaggattctctatccaagaaagttggtgcaagagctgtcatcaaataatacttgcagaggcaaacactctcattctcaggaatttccttggaggaaagcaatgtgtttatgggggtaaaatgttcatgaaaccatagatccccatgattgacagatatagtccagacctccatttatgcccctaccacccatgaccaccatatcagtacgatctctttgcctaccccatgcttaaatatttctgataaacatggatcctggtaattctattagtccatcaatcaatggattctatatttggaccatcccccaaatgaataaaatatttcttccatattaaacttaagtctgtcttctacctattagttttagttttgtctcatggagtgatacgggacaattcatcttgagaaagagggcatccatttgggagcctttcaggtatttgaaagccactctcgtgtcttccagcaaatgttaatagggtatcttttaataaaagaacaaaagtaaatacatttataaatagaaataaaataagataaatgggtacttttatgtactaaatggtacctttcccctccacagtgatttcaaaggctccatccaaatatattgtctcctcccctaaaaaaatcagcataattgcaggctttttacaatgca

SEQ ID NO: 119864 - DNA, 1343 bp, Homo sapiens
tcccagctactcgggagcctgaggcaggagaattgcttgaacccgggaggtggaggttgcagtgagccgagatggtgccactccactccagcctgggcaacaagagcgaaactccatctcaaaaacacaaaggcaaaaggaatagaagagattgctaaggaagggaatcatctcctaccaactgctgaaaagttattgtttggggaatagtaatcaattctccatctctactgaaggtgggaggagaaacaaaatggactcaaagcaaattagaagacatagaaatgatctctaaggaagaaattctgacaaagtggtaagcatatgctctgggctgaattatgtccccccagtgttgacatgttgaagtcctaacccccagtgcctcagaatgtgactgtatttggtgaatgggtctttaattgggtgattatgttaaaatgaggtcttgagggtgcaccctaatttaatctgactggtgtccctttaagaagaggagatgaggccaggtgcgatgactcatgcctgtaatcccagcactttgggaggccaaggtgggtggatcacctggggtcgggagttcgagaccaccctgaccaacatggagaaaccctgtctctactaaaaatacaaaattagccaggcatggtggctcatgcccgtagtcccagctacttgggaggctgaggcaaaagaatcgcttgaacctgagaggcagaggttgtggtgagctgagattgtgccactgtgccattgcactctagcctgggcaacaagagcgaaactccgtctaaaaaaaaaaaaaaaaaaaaaaaaaaaggagaggaggacaaaagcacagagagaagaccatgtgaggatacagagagaagacggccatctacatgccaaagggaagggcctcagaagaaaccagcctgactgacactttgatctaagattttcagcttctggaactgtgaggaaatcaattactgatgtttaagccacacagcctgtggtatttttttaggacagccttagagcccacaatactgaagattcttgtagcatctccctgctttgcaatttttaagaacagactaatcaaattatgaggggagagctcatcaaatcttcaattaacatttttattccttgatgacagctcccatcattgttggtccagaaggttctcttgttcagagacttaatgtgattttcaaatagttcgagttatgctcagcaccacagaagcaaatgcccccacctttgccatgattggttttctggaatcacagaaaaacagaacacaaaatggccttcgagagtactgtctaaattcattatgtagcttaattggg

SEQ ID NO: 119865 - DNA, 1044 bp, Homo sapiens
atcttcagtccaagtttcttccacttctttcttctgttctctgtgtagtcagcccaaaggatatttgagttcaatttgcagagaaatgccatagatagaaatgataatgtcccttcaacttaaaagggccgagcatgttttgaaagtgttttatgaactggaaacctttctatgagatattccactgtagccccataaaaccttacaccctgctggaatttcatcctgttaaatttggcagtgtttccttcctcaagtaatgagttcaattcatgttttcatttaagttcatacccagatacaaatcagtgtcactgccacaggcaacgattcgcagaattcccaggcgccaaggctgagggatggcgggttcagaagaatgaatgccaaattctctttttcactgagggcagtgtagcatttactgtcataagcctgcctcatgccaagtcccatggaggcagttggctaagtgggcttccggcttctatctcaacgcaagctcgtcttctaaagcctctctggatttcctgtggtaatccttctttgtgtacctctgagaaagaaacaataatagttcagtatttttagtttctttcttttttccaagaagagagttcaagagcacaagtggttttagttaaggattcaataaacactttggcaagaatgaggaaagctgtgtagaaaagacctagcagttcttccagttgtattaatagcttaagggggtattttcccatgaggaaaatagggcatagtcaatactatgagagcccacctctgtcctttgctgatacatcaggtaattaaaatcttatacttactcaatggctcttttaaacatggtattatcaaggaatgattgtttttgcaacaaagatggtaacaatgacagcaagagcaccagtgtggaaagttcttctctgcctgtcagggaatctatcctgatttgcaatgacactatgacttcttgcaagcaaacacctggagactgggtctaactacctgggcaggtagtgctgagcttcaaggcaatgctat

SEQ ID NO: 119866 - DNA, 1065 bp, Homo sapiens
attaggggtaaaagggttaaaaacttttttttaattggcacaaggcaactttcaaaggaaagttgagaacaccaagctggggcagaaacagacaagtcactgggcagaggcagaagcccagggattagcagtagctggcatggtgatgctggcagcagctgcagcaacattcattttactcaattcatcttatttcagctatcaaaccaggtggtcacaggaacaatgagggtacgaacttgttttcaggatgttgccaaatgttttcctcaagaaaacatgattcagatatgttatatcattggagtatttacaaggtcaaggaacacccatagcgcttggtgacacatcagaaaggaagtattaaatctgggttaaagagctggactgactgtgtgagccccataaagtgtgttctgttctgttaggcatcatgaattttgttagaaatcagcccaggataaagaacatgttaatttgacctccaaaagccttcaggcactatatgcatttgtaagtagtaaaagtaaaccacagagattttgtttcgggaccagatagaaacatgaggcagaaaaggaaaagttctgtatttcaatgtctttattttcagtatgggccgaggagtgcagatcactgcttttaaaatcaccagtcatgaaatcaattcagtggcactgacaaatattattttaaaatgaactacgatagaaaatagcagagtatattgcctatagtaaaagtaagaattgtttcattaaaatttccttcagttatgtacatacaggcacacataagtttgtgtgcactgggacacaatatatagaatttcttaatgtgtgtcacaaataaatttgaaagccactggtctagatgacatctaaagtggcttctggctctaaaaccacatgattctgctttcatgcaagttggtggcatctggcgcaacttattgcagcctccaagtttcctgtaggttgcttagagatggctacaaatggtctcagaggggctgacgtgtcagagctgcaatctgccaaatccagggcagctccactttcatct

SEQ ID NO: 119867 - DNA, 1027 bp, Homo sapiens
cagttctttttagaatgactctctgaaaaacaaaggagaaaaagggagaatgctgaattcagctttcacaaagtcatgaacagctggagtgtttctgcatgatttatcccaatgtaacaagtttggaatttttaagttttgggaaggagacatgaaatgaagttcatgttagttttgggttatctttgtaacagttaccctttgatgcctaggaatcttcaatttggaaatctagataatatgttccttgcacagcgaagatttgagaatcatcccctggacttggaacattaaccttcctacctcaggactactttacccattgaaaccagcctcttttgtgtggaggcatttcttggctttcttgctagagtttaggactctccaccggcgttgtgttagcatttcgatgaggacaacagttcacgggagacctttcttcaaacactgagtttctggttcattcaaatttctgttttgggctcccagaaaaataccatcgagaaaggacagatgtgccagtgaactaggaacatcctgagtgggtcaggatatgctccagaggtacaatgaccttcccttatttgtggtgacaagagcttctacttcgagattggcaggggccccagaaacctgtcagtttacattgctaggcaaacgatgaatggtactgttacagtcagtgccacattttaaagaccttgtttggacagtaaattggcttgaaataaaacatgaagaatctggctgtgatttcaatgcccaggtgagatggtttcaaagcctgggggaaagggcaaagagggtgtgaatcttcaatcaagaaactaaatagcagctgttcccataggcaagcagtacaaatgattctgctactgagataggcttacaacagatccaaactaatcttggtgaaactgtgctctaaattattagtgttaacaagcatttactaagacagttgcattattttctctcctcagaatttcagagcctagcaaacccctcctgcccccctgcccctctg

SEQ ID NO: 119868 - DNA, 1034 bp, Homo sapiens
aacctgaggcaaacctggtttattaataaattagggacctgattagggacctattgttattaactaaataataacactcactgtgttttgaaagtttgcaccagcccgaagaaaatagagataagtaagatactcccttggcttgaaggaggcaaatgagagtttgtaaagcatgaacgattgcacagcactatacctgaaggattcacttattgttgtgtattgggatgagcttcagattggattttgcagatcggctcacaaaatctcagatacatgggctaagagacttaaggcttgttcaaaataaatgtgcaaaaaatgaaacattaagtggagggtagtaatatgtgggccccattctccttctgctcaatgtttcgtaccagtcatagaacctttctggttctctgtaaaaactgtgcctctgagtcacagagtaagctatgcctgcataagaatcacttgaccatttcccaaaaatggaaaccatgtcaatatgagcttcttggcatttttactcttgctaatgatgtgtaattaagtagctcaaaatgatgctattggtcaattatcagaattgtgttatgatttttagaagcaggttagagaattttttaaaatgtattattttaatttccactgatacgctgaatctgagttggtttttattttagaagttggcagaaacagaaactgctgttattttagatattatttctacattggaattttggtgacataatctaatcaaagtgtttgctatatttccttcatgctctttttttatcctcacttgtcaatgtaaatggtaaaacaacacattgaaactgaagttttattctagtgtccatttaatgttatttgacctaacttttctacagttatcattagctcagataatgaggcacaaagataacaatatttacatagtgcctttttctctgtggtttacaaagcagagatttaaaaggcttattacatttatattcctctgtaagtttaggacaacattgtcaatcctattttataga

SEQ ID NO: 119869 - DNA, 1647 bp, Homo sapiens
cggcgcgccagcctgatttccgaggacaatccaggaccgtgtcgagcgcgttgtttgcgcctgctaacctttcccttggtgttcggttgctgttccaggccggcgcggtgaacaagcagggcgacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaag

SEQ ID NO: 119870 - DNA, 1064 bp, Homo sapiens
cgtgctctgttatttagtgatataaaaccttgcggtggcaaggtcagcaaagttaaggccagagtgcatgagaaatagctgtggagtgtgaggtgaagaggctgcgtgtgtgcttgtacagtctcctcgttgctttcaccgagtctctccaatgagcgcgaccctcctcacaaagtgtgcacagtgcttctctcctgggtaaatttacaggatgtgggagacagtgagtctctctgagattttccagcacttccagaagaaagaaagtttgtgttaggaaggacaggccccagctccctgggacttcagggaggctggggggagctgcagtggagaagaggaggaggttgctgaaggagaagcagcctgaagttctcaggttgaaaatacaaaccttagccccatcctgcggaattttgggatttcattcctaggatcaccctatagacctctttatgattcagtttcctggaaaagatgatattatggtatggatcctaaacacagtttcacaaggaagttctgtgtcttttggcaggggaagaatagtgaacaaagtgcaatcttacttttaaaataaatcttgaaatgatattgcaagccttatgagatctctgataatctttttttatttgacctggttttaagtaattctttttattcttgatgtttttcttaaaagcattttagaatcattcaaccttctaagaaagcatcaaaccatataagcaatctaatctaaaaaatgatacctctaaaagttgaaacttttgtttattttgactactttttgattactggaaagaataaaaaaattttactctatcaacattggattatataaactgtaaagagcttctactaagacgtgtgaaaatgcacattttctttttttatataacttcaaaattaacagatactatactgtttagatacatacctgatgctagataaagagttcctgagaaacatgccctaaacttttggactgatttaatatgaaacaattactacagagctgagttaatcagcccctttatagattttggcgaagatgattctct

SEQ ID NO: 119871 - DNA, 1010 bp, Homo sapiens
ataaactggggccattagctcggagaaggaaaggttaaggtcagccattcagtgtgggtgaaagggcccagggttgggaggcagatttgggctttggttgtgcaccaaccagttttatggtgttttagcaaatcatttaacttttgggggcctcagttttctcttatatgtctgttacacaaaataagaggggttgtactagtgtcattcattcattccctgtatattcactgagcatctgctttgaatgagggactctgctagggcatccgtgtccactggagaggacaggaggacctggtcctggccatgctgaagcttacagcgtgatatgtcatcctgctgttctccaaggtgccttgctggtctctggttttctcatctgttttcatcttgtgagcacatagggcttccttccttccgtctggcactgaattgcacttgccaaatagcccctgtgagtgtgtcatcacccttgccaaatagcccctgtgagtgtgtcatcaccccacagactgtgaatcccagagggctggaggccatgtcttggaccatcttcagctaacggtatacattacacaaaatatatgctcactaaatgtcttcctggcttatgtttctaattgtgaaagtaatacagtgatcaattggaaaacagtggatagcagaaaagcatcaggcctagatggaggctattgctgtagtccaggagaaatgatggggcctgaactagggcggtgagcgaggagaagacggaagctggggggaatgatacttggcaggtggaattggccagacctggaaccttaagagctgccggatggggactcagcaggcgaagctgctggccacacccacagggctggggtgagcggaacatcttggccagtgggtggggcccactgtgagggagtaagaggcaggtggcaggtggaagcactggcacctggtgggcgtcaggagatgcagggctgtggagggcggggtgaaacacaggaagtgaggggaca

SEQ ID NO: 119872 - DNA, 1030 bp, Homo sapiens
tctcatttcattgccccgagcctagaaataactcacagagtctcttgagcagtcaatgaaatagcggccacgggaagtgagtctgttggaggttaacctcatgtgttcacacgcccaacgcagttagcttagtttgtgtttatgacttttgtaaatttggttctctaggatttttcaggagcctgtagtttctctagattgttctgcaatttgcttgttgtagagcaggataataaagaataaaactctcctccaagaaggagacgaacatgcatagaagtaattgcgattcagtgctttcattgccaaatacaggagttttgtatttaattttgttttaatctttgattgtgattgtggtcttccttatttctgatgccaagagtttttattgacgttggttgagccatattttggatgtgaattcaggagcccccacatagctatccactcaccctttaattcatttatcctgtgaagatttcaggagccctactgtgtgctagtcagtgttctaggcgctgggataccacagtgaacaagacaagagtccctcccctgaggatctcttgttttagttagacacaggtgtgctggaatatatatatatacatatatatatgtatatatatgtatatatatatgtatatatatgtgtatatatatgtatatatatgtatatatatgaacaaagtggattactgttcatgctggctaggatacttttgaaattaagtgcatattgtacatatttgtacatagaaaacaggggagacattttcttctctcctgttcatgtaactatttagattataaaagaaaactaaagaacaagtggtcaggccaaattaagaaataaaacttagaattctgtttgctaacatatccagagtattattccctcaggtgtcttttactctatggtttcaactggcataaaggctcagatctgtgtagagcttttcttttggatggcctggaaacactattcgcaaacgaattaggtagcggatagagaggagagagttga

SEQ ID NO: 119873 - DNA, 1026 bp, Homo sapiens
aataatatagaaattctttgatactagctgataagtacctactaccctgacccctttgagtgttcctgactgcccttgccccggcccccaggcctccttgaccttcagcaactagaaggataatttctaaacattttgtctattaccatggccttaatgtggtgggccacgcattctgattggtcacatggtaaagactatggatggaaaactgagaattctatgccctgttgaggttagttcaggaacaactttttgtgaatcttgaggaatgaacattacagcagagctgttcctggtgatgcgtgatctgttatccacgttacttcccgggagtttagttgtgttctctgcaggcagcctgaggtcagggacccaagctccccagtcaggttggactgtacctccttcagtgagttgttggcaactaggcagtgaaatgagggagtgaccgctcatggctcatgaactttgcaagttgtgcaactcaactgtcccaccttgaaagggctcaggaaggtaaagagtgttgttttgggacacagggattgttgcatttaaatctttgtgactgtggtttggtctcagactggtttttcatgcataagttcttcttaccctcaggcatctgggattttacctgtttttcttccagtggtgtgccctctccgccacattgtggagcgtgctttctcaatccttcaggaagaaattcaaagactttgttttttaacaatatgcaggatgggcgtagtggctcatgcctataattccagcactttgggaggctgaggtgggtggatcacttgaggtcaggagtttgagaccagcctgaccaacatggtgaaacgctatctctactaaaaatataaaaattagctgggtgtcatggcaggcacctgtaatctcagctgctcaggaggctgaggcatgagaatcactttaccctgggaggcggaggttgtagtgagctgagatcgcgccactgcactccagcctgggtggcagagcgagaccgtctcaaaa

SEQ ID NO: 119874 - DNA, 1065 bp, Homo sapiens
attgagaccctaatatatgccaggcactctggatgcattggtaaaaaggatagacatggtttccgccttcttgaagttttttgcccaggtaaagaggtcattacaatacagagtgagaagtgctgtgactgcagaagctgagcgtgttcccacagcactgcagcagatcacctatcttgcacttgggcagaagggagggcttcctggaggaggtgacttcaagctgagatcagaaggactaagggggaggagcaggagggttgtgcaaagtcagaggcatgttgtccgggtgaaatgaatggtgccctgaattcaggtagctatatggagggaaatggatagatttaagatagacttaggaggcaaaagaaataatatgaggtgattgattctatttaatggggtgttagagagggagatacaactctagtttctggcctgaacagctggcttgttgaacaaccccaccgttagctaagagacctggaggaggaatagtcaaagaggaagatgatgaactgttaaggacagagaaatttaggtgtctatggtttatgcaagtgaggatttctgtaggcattgggctatatgcttagggttcactgtgtgtcttcaggagagacatctgggctggagatcaagatttggaaggcatggtatttggaggcataggagcgagaaacgttaccttggcatgtaacatggcatagcagagacactggcctgggatggcccctagaagggcatcatcattgcagggggggataacaggggaactgccctcaaaggagagggataagcctggtcagagaggtaagagaagacagctgtgggaatgtggtgccagggactcaagaaggaagagcagagagtaatgtgcagtgtcagaggctgccaagagatcatggcaggccaagactgggtgttgttcattggctttgcaagaaaggagatagtcgatgacttggctggagtagttgtggcgagttagggatatgttgccatttatggcacaaagggaggttaaaaatgaagtgtaactttagagattctgtggggttaaat

SEQ ID NO: 119875 - DNA, 1072 bp, Homo sapiens
cggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggtaataccctccctccccaccgtccccagccccggcgggaggtgggctcgcaccgcgcggggtcgtgggcgcgctgcgggccgctcggggagagcactgggccgagcatcgtgggcctcgggggctgcccctccaacgagggttcattgttagacctgagtgctcttcccggcgccaggagggtcggggggctcggccaggcgcgcggggcggcggggattgccttggcgcgaaccacatcaaacactccaaaacttttcgcggcccccccttcttttcctgcacttttccctacccccactctcccttcccctccaactcgaagcttcctctttctcgggcgtaggaaggggtcacgccccggatgg

SEQ ID NO: 119876 - DNA, 5508 bp, Homo sapiens
gctggagggggagaggggggcacccacttcctcctgctcgccggctccctggcctgggacggtcccggcgccctcgcacccgcccccggcaccgccaccctccctctcctctccccacccccccaccggcgcccgccctcgccctgcgccgccggtctgttcggccctccgggccccctctccagccggccccccacctccccccggagccaggctggtttcggaaatgcccttacagcagcaggttagtgaccgggacggctcgggggccgccgacgccgcgggggcaccggattctgttgggggctgaagcggtgagggtaggcggttgagcggggttttggagtgggaacggggggttgggtgctcgagggaaatgagtaagcaagaaaaatctaactaagtaaatgccccggcctccggttctaggaacctcggggcgggagtgtctgccccagggggtgggtatggtgtttacgtggattttttttctagggggcggatggatgggcgatagaaaaccggagggggcttctcgccaatggccgagttgagctctgttttctgtcttccttcccttgtgctggagggggaggggggtgggtcagagggtagggtgtctgtaggattcccaggccacccgccaccccctccctttgtccctgtaatttataaagcgcctttgagagatgatttaggtcagtatgcggcttctctttttgttggtactagaaagaagtgtggcccggaggtctcccctttctccttttctctccttcattcccttcctccatgcctccgggtcttcaccctcgtggtgaggcttggcctccacggggctagaaccgaaccagactcagttagatccatggtagcctgattataccaggcgtggacctcaccttgtctcagctccaaatgggtttaatttttggagaatcaagattttgcgggagtctttaagaaagtcagcacataggcagcactttgggaaatgggatgggtttgggaataatgaggcgttttttatttctttcctgttcccagtttctccccgggttcggtcttaactgctttccagccccagagatacttgctgggcatgtgtgatgtagtcttagtcaaagaagctcatcgttttttagtgactagggtctgccagcaggggggaaacggagcacagtacctgcttagacatagcagtatccggtgtgctgggttttcagtcgcaagaatattccatgcttttattagcttcagatactcttactgacttgacctaagcatgtttggacatattttaagcatatttgacccctgcacagttctgttactatttcataaacctaaccttaaacaaccagctattgacatacttcttggattagattcacagatttgcagggggtagttttgataatgggaaattatgagagcttcaagttgatttttaaaaaattttaacagtgtttgttgggccaggtccctaagactatctttcaagccaggtttattatatctagttcattgtatttaagtatttaaagtatactaaattaccctcaccatcttccaagttatttcaaaactttattctccttgacatgaaattattattccaggaataataatatccttttgagtttatgtgcacacaaaaggtttttcattacaggaatataaatgttactcatatacatattcagaagcattttttatatgattgcaatgtatgctgaatcattggttatctgcattttttttttttttttttttgagacggagtctcattctgtcgcccaggctggagtgcaatggcacgatctcggctcactgcaacctccgcctcccgagttcaagcattctcctgcctcagcctcctgagtagctgagattacaggcgtgagccaccacgcctggccggttatctacacttttaagagctatttctactggccgggcgctgtggctcatgcctgtaatcccggtactttgggaagccgaggggggcggatcacgcggtcaagagatccagaccatcctggccaacatggtgaaaccccgtctctactaaaaatacaaaaattagctgggtgtggtggtgcgcgcctgtaatcccagctactcaggaggctgaggcaggaaaatcgcttgaccctgggaagcggaggttgcagtgagctgagatcccgccactgcactctagcctggcggcagagcgagattccgtctcaaaaaaggagctgtttcttctgggagggtgtaggaaatttatctagtcaatgcatacaaagtcttaagcactgaatataaagtttgatttattgtttttcttatcgaaattatattagacttccatgtaagtcttcgaattttgaattttgttgatattctttccctaagcaggaaagacaggatggggaaagctaagtgattggctgaacaaagaccacctaaacactctgtgtccaagaagaggttgaaaagtcttcaggtggccagagttgcagacctatctggttctgatcccaagttctgtctcaagaatatctaaggacttaaccagaagcaacttcttcacctttttttcaatgggggtaaaaatatgagtactaccttaccagctgtaaagcatctattatttacaaattgtatgttcattggcaaataacttaatctctcaactcagtttcttcctctgtaacatagggacaaaaacagtgtcacctttaaggttcttttgaagagttaaatatgataatgcatgtgaactatttagcacagtgcctggcaaaaagtagacacccagtacaattcatatttattatacaaatgttaatttttttctgacttagtgaaatagtgtaaggccaggtgcacattgtccctttgtttacatatatgaagagaactgttaaaagtctttaagtgatctgtaattaattatttatgcccaattaatttgggcttttaaatatataaaacatggccatcctaggggtaaaatagggacatttcagtaagacacgcctatatagagatagtggtgttgaactgccaagcatatgccttgaattgtgacaattcaaggccacatcatcctcacttttttgcctgagttccactccgtccatgattccacagacctgccaacttttgggtgcagtttatgcttagcggcttttgttagacctgaactctcaatcttcaccatgtcagagacatgcattagacaaattccatcttagttggtgaactgttggaaatgtaagaactccagagaaaccatagtcagaagtgctactcaatggagcagacaaggcttcatcattttctgctgctgcttctaaaaagaagctgaaattattttattctagaaaatttgggatttaataatgtaagagactatgtcctgtcacagtcatagcaacctactgattctactttgggaaagagccctcagtgcttgaaattttcatctaagaatggagaaccataggtgctatttcagcagggtctcttttcctgtacaattataaaaagaaaagtgccgggttcctgtggttctatactcaataatcttgcttctgctgagatatatggttgatgccaagtttaagctgggagacaatttttagtcactacataccccaaaatggaagttttaatataatgcagtgcccagacttgggcactacaggtagctccactataatcagtaccaagggcgccactctaatcatcctctgaaacaaagcacccttaaatatggcactgtgggctgaagaactccaccttgtgaacaggaaaggattttttgtttttctataaatcgccaccttgtgtattacttggaagaatggattctgagattaatgttatactgtgtaaagctaacttgaaaacagaaaataatactctaagcctagacgtgcataaataacattacctggagattgacagacggggtgaaagcttttattgtggtttctcagaaatatataaagcagtagttttcctttaactcttctgtctttaatgccatctgcaaagatatatcatccatacctttaacctctttcctagggatttggacccatttggcaaatagcttcaagtactcatagttaattttctggctggttttcctaagttaacctgattttacaaatattccatttgtaggaccagtttacatctactttcccaagctagccaacttcaattcccttttagtcatctacttcctactaacagctgtaactaggatgagtcaaaatcaattgcctatgctcaccagatccctgataaattcccatgaagccacctgaaaggtggtaaaagcaaggtaaaacgtggtgaaagcaaggtaaagaaggtagatttcacaattttgttttttaaaaaggggaatcttccctgaattctttgaggtactaagtacgtggtttaatgcatattttcattcttgttagcagtttaaaaataatgtttcagagactgtattcacgattgctaaaaagcattttttctactaatcattgttcatgggacttaacaatggaagataactgggaaagcagtaaatataggaaaccactaatagtgtctccttcttcctaccctgaccctctctttggcttcagaaagtgacgaggaaaatgtatctttcacaaagaaaagttataccacagaaggtactaaaaagcaacaactgcctttggggacaggaaacttacagagtggggattattatagagggataacataccgagtttctatttcaataagagggaaattggtttatattctgttcacacttgtttcaaaccctctcctctaaaagcaatgtgtttttggaattcaaggaatgtacgttctttccccaaccttaactgggggtcagtcttatggccaccatatttgtctacaatataacttttaaaaaatataatttttgccctcaaatactctcctatccaatgcaatgtaactttgaaggagaagtgatgaaggccactggttgccagattgtatcacacagccagatgcactttgctttgatgaagaatctaagtgatgcaggcccccacttagctttgtaaactaaggcaggggtttatgtcagctcgaggtagaaagcagtgagaattggcagctgatggaatagaaaggggacaaaaagaataaaaaataattgactttagtctgctttccattaccgtagcccaactctctggggccatttgtgtggtctagacaacattcttagaacttgacagtccctgagaacgatattctaggttggcatgggcaatagttggcatttacactggtcttggaatcataacatttgagaagtgtaaggcacaagagtcctcatctgcccaatccccttcatgttgcaggtgaggaaattcaggcccagtgctgttaaattacttgcccaaggtcacaggtctttgctagtggcaaagccaaaaccgaaacgggagactcttgaattct

SEQ ID NO: 119877 - DNA, 1040 bp, Homo sapiens
cctttaaacagttggctgtgggggtaatgacttattcccaaagatacaaaataagcaaggctactttggatgttaaatgaaagggaattatttaaaaaaggaaagaatgactcttcaaaacgtgatagtaatatttttaaagatttatttgatattcgcaaatttgtcttctgtggttatatcaattctgttgctcaaaaagtgacacatgcttcatagagaatagaatctaaaaggatttttgagactttcttggggagaaggacacacagtgcccctctggtagtaacggagttttgtcctgggccaccaacatcctgagtgactgtcatgctttcagaggtccccagcccttgcccagtaacattgaacaaggtgttcttcctctgtggttagctccaagatttctggtttagcaaagtggctaatcagttaactctttaagaggaaattgtcattcctttagccaacgctaatttccttaaaatgccttcttttcctttttggaactgagaaagcttaaaaatagaattgcttcaagccctgaggcctgaaagtgaaacataatctaacgtggctgtagtgcactgactcgttaggggcagcgatatatggcttatctgtaatccacaaaccagaaaggtgcccagtgtagatacggtctaacagccagtgagcattaagtaccaactgatgagagtagtaatcagtgaagctgatttcctctggaaagttttttggcgagtagagtttgtcttagagagtggaggatttgaatgcctcttgactttctgctgaggagagcttctgcctgctctagtttttatgatcctgaagggtggtagctctggactctgagaatgatgggcagtgaactcagggtctgtatatttcgttccactctgctcttccccatttctgatgctttgggggctccatttctgatacataaccagagcagcatccctgaggcccacactatctcctgtgtgcctttctgcatctggcagtcccttggagagaaggaggctcatgtgttt

SEQ ID NO: 119878 - DNA, 1477 bp, Homo sapiens
tgcacctctctaaaaatggtgatgatgggaaggagaagtaaaccgtggaatggctctcgcctaatgcagtctttagggtctagggtctttgtatttctttataagctgcccattgacttgggaaaaagaactgaagaataagcttcttgtagtagtgctatcagtagtgatagtgtcatgaataaaacctttatttctgtgattaaatgtattaataaagtgacactactagcatgaatgacactattaacataatttcaatcctgtacagtaaaccatggcttaagactgaatggcaagaatcagggtgtctgagctgctgggccctgccagactcggagcccctgccagtgtgtgtatatcaaggcagggcggggggttgtcttgctctccagaggcaatggaacctgcctctaggcctcccttttcccttctcatctcctcacccctccttttttatgttagatctattcctaccccttccccttcgccttgccctctgcctggctcttagaaggaagcagacttgccaccttcagtggctgcttcccggacttaccaaattaattaccaccttttcctgccatcaagggatggtgaaatcttgccttttcggtcttgcttcccattcctctgcactcggctgctgcgacagtgtggtgctgcaggcaccgcagatttccctctggtgtgtttgctcgtagcttctccctctccaccttactccttttgttgccctcctcccactggcccattgaggcccacatcaagggaaggcgtaggcacagcctcccccagtttcccaggggcttgggcctctcccttcccttgggttactgcttctttcctgtaacacctcatggtctgcctcgtagcctaatcttgcatgttcatgacttactcctcctccaaacctgtaagctccaagaaatcggtctggcttgctttttcatcatgtggtccctgcagtgcccactacactataggctcagctacctgagaagaggcattttcattagacaccttccatgtgcttggtaccccattagtcctattggggatacaaaagaagtatgaggtgtgatccgcccactcttgagtttacagtctgttgaggagacaagctttaaacacaagttgatctgcaagcaagactaaacaggcggtagggagaaaacaagactcatctagtcctcagttgtgtggtgtcgacagaaagtgccagaggaacaggtgagagtcaccagactccagctgggccgtgagatggggaggccacggttgtcaatcttggagtacattagggcacacatgtgaatctcccagggcgctttttaaaaatactgatacctaggccccacccagaccaatcagaatgtctagaggtgagattaagacatggattttttttctttttttaatgtgctcagttggaaccactgggcttggtggaaagggaagattggggaggcccttt

SEQ ID NO: 119879 - DNA, 4048 bp, Homo sapiens
agtgtttttcaagtttacctgattgcctgtagcacttgttacagattcagattcccaggctccatccctatcctctgtcagaagccctaagatcttctgatgaaacattctggaagcacggctagttgagcacagggaaaagttactgaaactagattgtccaggtgaaggcaggagccttctgccacatccattcacataatgcttatctcagctcttcctcgtttggaaagaccccagggccccaagcctcatacctgctctcgtggttccaaaacttgcagactcccaggttgtagcccaggcaaaccatacaaagatgggtctcccaaaacttaaaagatgtgaaacaagaagtggtttcttggattctcaagcggttgagaatccgagctcaggaggtcaaagtgggcttggtggctagacgccaggcaccagcaccagctgggtacccttgagtggtttttctgccttaacagtaggaaggcttttcattctgtctggtctggacctgcctgaaacacagctaaccaagtggacagagcgagaaatgtgaatacgaggaccagagcacaccatttagagtacgggcgctattgagttgatgagtctggaagcaggatggcaacaatgatggtgtgaaaaggcaggtggaagtgaagggcagattaagggagaaaagaaatacaagacctttgactcccaaatatttaactccaggggctggaagaatgggtgaggccaagcttctcctctgtctggggtgtgcactgtgtggaaggcatgattagtcagaatggatggggtggttgtgagtgactccatgggccatcccgttttctgaggggctaaggctgagcaccggaagtgggactttggcatagaggttatagtggaagtcttgatgaacaatagcaggccaagacctggtctccctagcttacaaataaaagaaatttaacatggtgccacaaaaacctttcatcattttcacttcttcctctgtaatatgaaaacgagacaaattcatcaggttgatttttggggatcgatgctgtcagggctcgcagagacgagccatcagatgttatttattacatgctttaccccgtctcctagctgctgtgagaaagcccacagtttgcaacctcacaaagcaaagagccagctggaaagtactgtgcatccagacaggtcacatagtcatgtcctgaaccaagatagctctttttgccatgatttcctacactctctgatttttctcattaaaaaaaaaaaatcttgaatttattttcttaagctctagcattctaaagtttaaacatatgagcctttgaatactcctgtctaggaaagagccgtgtaaattctaagtatctctataattgacttttgatatgttacttgtgtttaaacccaatttgcaacaccccttttgttggctaattttgtcgctatgttgggtagcagaacttgtgacgatcacactaataacataaagtttcccacctttcttgttgctgttttccttgttagcatctcagacttcccaattctgggaatagtctctaggaggcaaggttttcagctttggaaatgcatgcgtgacacagtagtgtggtatggaaggcgtgtggacttgaagatccggctccagaaacacgctctgccaattaccgtgtgtgaccttttataaattacatccatgagctgtagttacctaaaatagtgatcctctctccttcactggctggaaggattaaatgagatagtgtttataggaaatgtactttgtgttccttagttgcctccccccgccactccccgtggtaggaactcttgagtacttgtcaaatctgaactctcggcatttttacctccttcagggaaaactattggacaggctcttactgaacacccgcttttgtgcagaatgcacttcctgatactctgggagtttcagaggctactaaggtgtccttctggccctcaaggagttcatctggagacagggagacgacacattttcttcaataactaagaaaagaaagggcaatgaagaccataaggaaataacagtgaagtttcttaggcatccaaacttgatggaggggacaaaggaggcttcaggaagttttaaactagaacaggacttcagcgctcttaacattttggtcagatacttctccgtggtgatagtttgtgggcagttaacagtggtggagggctgtcctgtgcattgtagcaagtttagcaggatccctggcctccgcccacttagatgccattagcaccactagttaacaacaatcgaaattatcttcacactgtcaaatgtccccgggaagcaaaatcacccccagctgagaaccaccgaactagaccttgaagaaagggtagaagaggatatcatgtttgcctcttctatatatagtacatatttaaattttaaaatatgatatacattttaaaagcaacggatttctcatagctggattaactttggaatgcctaaccaccccatggcaccccagaactgggatccactgcccctactcttggtagtgctctgtgcaggccacctaagccctgtcttttttatgatgaggcatgatattaattggctgctggaagcctctctaacttgcagaagaaaggatcaaagtctgcagttcagggaaggaagttttgcatttatcattgacccaactgggtaatttaagagcgactttctgctcagggtcaacttctcagtgtggtttttaatcccacttcatagttagatgatttggtcacatcactttccctccaaaccccatttcctcgtctgttaaatgaggaaaatcatggttcttacctcacagagttactgtaaggattgaatgcaataatgcctgtaaagtgctggctccgtccctggccatgtgctaaacactctgacatttgttgtcttcctcatgtatatcattattgtggttgtcattaagttgggcttccgtttcaggacagttcaacagtaagcagccattccctttgttgctggtgcttctgcagctattttccttgctcacctatacccacgctggccccagtttcaaccacagggccggctgacccatttatttagcagataggtgttaagcacctagcatatgccagccaccattctaggtaccaggaatacagcagtgtcagaacagacaaaattccctgcctctgtgtggtttgtgtcatagttggtgaagattttgccacatcataaataccctggtcttgtctttgatgggttctttttcttttattttttaaatggttctaagtatgtggtgctggaccagcagcattacttgggaacttgttagaaatgaaagttttcaggttgtactccagacccactgtcagaaactcaggaagtggaagtgggggtgagcagcactggtgtatggcttaacaagtccccaacgtcattccaatgcaccaagtttgtgtgtgaatcagtgtttgggaaaagaaaggagtagggggaaacccaggccgtaactgggctgcaatgttatatggtaacatcaaataaggtgttgctcatatcatgagattctagtaacatcagagtttacaaaggatagtcttaggtacaccaagacacttaaaactagcagtaccctttgatctctttcctgggcctggccacccctcctttaaatgggagggctttgggaggcctcctaagtcaccacagcacacgggactcagcaacagaaattcttagccttccctaggcttttccttgcctgatatacaaggaagttgctttccccacttttctccagacttctggcatgtttgacaattattttttcttttaattccttcagtttttattggcttcttacctggcatcattaaaaaatttttatagctgcaatcaaattgccaactggatggacaaggcttatctgaaaatgaaatggtagctctcctttgtatgtctggtaatttgggtatttaaagatacagtgaaaagtaaatgaaatgagagactatggga

SEQ ID NO: 119880 - DNA, 1104 bp, Homo sapiens
agtgtccagtgtggagctgggcacagggtgaccgtttgataaatgctggtacagtcttccccccaatcccaactcattataaaaaccaataaaggcattaaatagacaccacggttctttgtgtgaaaagctttggattacatacagtctgaatgagtgaataccataatgtaaattgtaaccaaaataatagaatccaaaatcttaagtaatgactttgaataaaaataagtgttttaaaagttagtaactttttaaaaaataagtgtaattaaataaacttttaaatttaaaaagatgttacttgatttttatttcctgataatggatttaaaaaaaaaaaaaaaggcccagatcagactggcagaaatacttttatttctgcactagcccaaagcctggatatgcttataaggcatataacctgtccatttaacagctgtcatttaattcacaaacactaattaattacagccatgttaaaaggggtgtttgggacggtttggtagttccttttgaagaaaacctgtgtcttgaaaatgcatatgaaagattaccaggttctgttatatatagtccaggttcgtcttggtggttctattcgaaaaatatctctctgaccatcggtgggcatttcctctctctttctgtctacctacagccaaaacaagttctggttacagtgacagttttaagtttgccatttgtggttggttctattatagaggctgggggaggaaggcaagcagtcctcacttcttgcttcctgccttgctctagagtgtaaggatcagcttctctaatcccttgacttttcactgctctatgtagtcagggtagacaaggggtggccctcaaacaacagccacctctggaggtctagcgtgactaaaccactgtcttcttttccaaatccagcactggggaccgacgtgtgggcctcccatctgacttgtggagtgaaagaaatgggaatagagcagcgctgtccatatagtcgagttttgtaaatatttgtcagatggaactagagatgcattatcacattcgacagtaacaagtggcaagtgttgagctcttttaagtcttgctttttatttctta

SEQ ID NO: 119881 - DNA, 1142 bp, Homo sapiens
ttaggaattctgatttactgatctggagggcggctttgtgttaatcagagttctaaaggcggacaaactagactgtgaacttaatacttaccctgagaagtataactgccaagtggacagttgcagaaattggttattgcctgtgttctcgatcagaaggttattagctgtgtcagagtaaaggcattgaatgatcccattagtaccttccagctgtggtctcctctctagagcgtacctgcaggggagggagtactgctagccacttatggagcatatggacactgtcattcacccacccaggtgtccagttccatgactctggtgtgaaacactgaatttgtttgttacctttttttttttgtaagaaaatacttgtttttagtacctgcttattatttttttaaaataaaaaatatataaggaagtggagtgaaaatgaaaatactttcttcattccctcttgatcttgcttccttcccagagataaccacaatcacagcttggcctttcctttttataatcatttgcaaatctatattttatttatataaaagtaaaaatgattcaaaaatacaaaagtgcacatcgtggcttgcccttttgcttagtatttccagagacgtaattccctatctgtatatattgttgctcattattctttgtaatagctgcgctgccactcgttatatagatatgccagaatgtgtttagttattcccatttgatggtcatttctgtcatttttcattttaactattgctattatgaacagtgctacattggatatctatgtacataagtttttgtgcttgtgtgtatttctgtaggctgcatttctaagcgttgaatttttatatcacagggcatgtatattaaaatgctgatagattagataggtccaaattaccctccaaaaaggctgaacaaatttatattcccaccacaagtgtagagagttgcctgttttctcatactttttccaacactaggtaacattagtctttttgcagttgctgctcatgctagatagtacctccttttatttatttatttatttatttatttacttacttacttacttacttattttgagatggagtcttgctctgttgcccaggctggagtgcagtggcatgatc

SEQ ID NO: 119882 - DNA, 1317 bp, Homo sapiens
ttgtattacacaatagaaggcacctaatcaaagatttcttgtttttactgcatgattgcactcttaattttgtgaaagcataggtttacttccagactgagaggtaaatgaataattattttgtgatttatttagcacttgccgccccaatcttgtttttcacgtctgcagttatggctgaaatatcttattccattcccagcctctctgttggtggtatctgcctgatctccacctagtgtcattgtgggatcgtggccacacatgggccttccagggctgtgctgttggtgaccagtggtgcttgtaaccctgaagtgttggcatggcctcagctgactgggctttccctcatgcccagggcttaaacttgaactctgcctgctctgttagcagtttttctctacatttcttttaaaatagactttcacttcttccttcccatcccccccaatacaactgccctggcatcctggctttttccattcttgacaaatgatctgtccactgtaactgtagctccactgtgctgatatctgttgaaattagacctagaatctaaatgtggctccatgaaactatgggtgagacattttttttcttcaaatagtctatggtttattggcaccccaaaccacctatccataccttctccactgtgatgctgggggaagaaaatggggtaatatatgtgtaaaagtgactgagaatgaaaagttctgcataaggtacaatgttagctggggtttttgcatatataataagaagacaaatgttcactaccactcctgcctgccttccctgggcatatcgaactgattccagcctaatagcatttcttatcatataatgggaatcacaaaccctccctatgtccactcctacagcgccttcttaccctaatgaggctttgtaactcaaagatttaaacatctcatttatgctccattgactgagttaaccaaacactttgtatttggccctttcctcttagaagttcagaacaataatatggtcctgaaactactcctgcaaaatctgcttagggaagaagggtcggccagggcaggggttacattggggtttgcagtgtagtcaggcaccagggacctggcaggttgggtgggatcaattcttttcacctcagggctccagtttctcatttgtcaaataaaagtgatttctaaggcccccttctgctcagaccttctgtgactgtccactaagccacagagactcactgtggccattgaattcttggggacctcagggaggttttgctgccgaagtgactgcccattctgccggcatacattt

SEQ ID NO: 119883 - DNA, 2336 bp, Homo sapiens
gcacacctgtcatcccagctacttgggaggctgaggcaggagaatcacttgaacccaggagatggaggttgcagtgggccaagatggcgccactgcagtccaccctgggcaaccaagagagactctgtctcaagaaaaagaaaaaaaagaattagattatctttggaaaatagcaaaaaggcccaaccaaaattctcacttaaaacacagaattcacaagagtgtgctgaaaatgagcatgccggagacacggtattcctcaacacttctcgtcatcagctgacacctgaatctacccggtgggaggaatgcaactgtctctggatgccactatcattacatctctgtggcctcaaatgggtccattgcagaatcttgctatcttcagtgaccttaaagatgtttttgcttctggagaaggaaccagctgcatcaacggtgatctgctgacttcatacagtactccgtctgctcccacctcgcatcccatggcccagtgtcccgtgagctgagatttgccttctgctgacggtgtcctgcctcaggtgccaggagcactgctttttgcttttttgtctctctaggagcagactgaacatattgcaacctgtgagtcggaggggggtcaacaccccagggccaccctctaccagtgggaatggaagccagtggataaatggccctacttcctagaaaagttccagggggcattctggatgcttcttgggaggcctcagcagaatgaagcccctgttacctgtagccatgaccttctacacacactcttcaataatacacccacctcactctccctcctcctaggatcacttcccaataaactacctgcacacaactccttgtctcagcctctgtttttggaaatatctaaatttagacacctattacattagtctggtagggctgccataagaaagtaccacagactgggtggcttcaacagcagaaatctattctctccctgatctggagactggaagtccaagatgttgtcagggaggtttcctctgaggccgctctcggctccaagatggctgcctcttcacctggtcgtccctctgtcataagctcaccgggtgtcttttccttcagattggatttgggcttaccccaatggcctctttcaacttaatcacctctttaaaggttcattctccaaatacagccacattctgaggcactgggggttatgacttcaacataggaatttaacggggacgtgggggtgggcgtttagcccaaggcacctgtgaaggagaaaaatctgatttagaatacaagctaccccaacataattggcctcaagattgtggctgttttcaaaaaactcttccatcttgtatagaactcacctactctggggccttggggaggggggtctgtgaacatggaggccatggtgttcgttggccacctccttttagattaactgcgcagcctgtgtcttcacttctgctctgtacatggagaagacagggaaggcaaggctgctgcttacctgaaggagttcaaagtgtaaataagacaagcccattagatctatcaggggaaagccgtttaggtttgtttgagacaagatatatggtgtagaccacagaccttacgtttagggaaagcgtacttcttcagtgggctgagtttcttgtaacagaaggtgtggtcggatgattacagctggggttgaattagatgatttatggaacagcttctgccctgaaattttctgattgagagatggatgtggtctggagtatgtgaaaatgggatagatggagggaaggttaggggagaggtgaacagggcctcttccagggtcttgtggaagaccctgttcgacgtttcctcacgtagactgtctgatgaggctcttccagggtgtggtatggccagggtgtgttaaatgtagggagcacaaggcaagaaagggctgcaccaagctgcttcctgcctcagggcctttgcacttgctgtcccatctgcctggaatggccttgcctcacatcttcatatgaccttggctccttgtcatctattgactcacctgtcacttcagaaaagcccttgctaccatctggtctgccagtcactctttatcctattttcatgttttattaacattcatcaccatctgcagttagactcttttgtttgcctagtgcccacaatgttgcccgacgctcactaggtgctctgtgaatatttgctaaatgaatgaagaacttgaaggaagctggcagtgggtggactcgctgagattaaggggcatggaagattactcaaggcagcctcagcccctttctaatgttttgttttgtttt

SEQ ID NO: 119884 - DNA, 1129 bp, Homo sapiens
tacagaccagttctatggttcaggttgttaatgtgggcccctggatagaattctagatattacttaatttttttgtgtgactaccctctaactgaaatttagcgttttcttctagtatgaacgtaggcactaaaccacagtagaactggcagtgtgtttgactgtcacccatagaaatagatattttcatatcacattacacttgttgcagctgtcttgaaatattgtttatgctcatcatgacttcaaaattacagtaatttttgacctgctgctggatctttttatttcacgcactaacacagaagaacatagattactgtatgataaattgctttttaatattttgaatagctatatttcaatacaaagtgtttcctttgtaatcccatatatatatatattttcttttttaagacataaaaaagcactagcctgagaaaaggggtccaatagacttcatcaggaggccaaaggaggcgtctatggcacgaaaacatgaattctggtggaattatgtgaaaagagaagtcctatcactccttaaaatcatgttaatgaagattcctatcaaatgtggtccccaccccctgctctgggtttactgcttccctgtgaatcttctccacacttttgttaattttgggatggaagtttgagagagatacttttttcatagataggttggaagtgatgctcaccttatcaggactgtaagaggatattgcaagctttgatgattgagcagaaaaatctttgcacagctggtcagaacaagcttgtcctgccttgtgggagggacagagttttccaaatgatcttttggttaagaccttaattaaaaacagcctaaattcacttgtggcaagaatttattaaaggaagataaccatgagcaaatccacgttgtggtataagaaaagggagcaccatcgttaaaaaagtcagaggcttgaattctggtgaacttagcacaaagaagcaagaaaactttagactggtttcttaacagtttgctatctgtataactaggggtgaattgatctcaaagacctaagaatctgtggacttaaagacactgatttgtggcataattcgaggtagtttaaactggaatatcaaggtgtca

SEQ ID NO: 119885 - DNA, 4248 bp, Homo sapiens
gaaaattcatgaatatagaaaattcaagatcatacattaaagaattgtcttttttttttcaaaaaaattttttttctaaaaatgtagtgttatattaaaatgtagtgaatattataataattctaaaaatgtagtgtttatattgttttcctgcttaagttaggccaaagttggtaaaatgcattttagaaccctatttttgttaaggagagcacagagccactggtttagagaagtttgtaatatccagaggatgaagaaaacggacacttgtcattctgagttcacgggaacgggagaaactgaacccttttaggttgatcatcagcttgatgtgaagggacttgagagattctctaatctattctttcctttaactggttaggaagcagagtccaagagaaatgccctgcccagggtctggcagaactgatggagagcagccttcgtggctaccaccttcccataaagtctgtgctctccagcggcgcttggtaataagatttatttaatgacacgtgtaactctaagactatttgtgatggcgaataccacagatttgactgggtaatgtgatatttgttatttgctttaagttaactttagcctttagcacagtgtgatggaaagggcaccaaacttgtgatctagaagacttgggttcaagtttcagatttgaattagctttgcttctgcaaatctgaggaccctattttcttaatccatgaaatgggaataataatactcacccaatttaccttacacagtcgtgaggattcattgtaatgggctttgtaaaaatataaagtgctatataaacataagggtgttaatctcctgtctttggtgacaggctaaaaagacatacttgtttcaaattttggatactctaatttgcataatcttacacattctctttctctatttttaactctatgttttccccatcagatttttttctgttaggagttacaatatctctcttcaactgggctttgcctcaaggtgtataaacttaaagcattatctccggtgcagtttgtcagtgtctcggcatatttgaaatttttagtactgcatttggtatatgaaagctgcatcctatgtaagaccataggatatttaaacagatgttcaaatttctattgtgaaaatcctagctcattccttgctagagatgaagcactgaggacagtacaatcaccaccttaaaacaaaccacctaagcacagctttggctgcacagattggaagggaatctggtaattacactctttagttcttctgtgaatataaccaatctgggcaatttgggcaccagagtggatttttaggcatgaattatctggttaagttagccagataattgccagctgtctcccgtgctttctgctctggagaccccagccggagtaattgtcttctgtttactcatgcaagcaagttgctggtttccattttcaaacaaaaactaactgcatgttagaatggtattttaattgagctatttttgttgctgattcagagattcccccaccctttgccaaaggagttgcccagattagaacccattaatttagttgatttggggggttccttgttgactttggggaagacataaatattataaaagagatttagaagttgatggtataaggttttccgaaacattcaaaacttatctcaaattctgaccaaacatttttctactaattttcctaactaaatggaaactccagctgtataaataatgatttttgtttgaaaacattttttctcttgattttagaaccatcgagggaattaaattataaataagtagcaggaaagaacaactttgtcaatgtgaaacagaatgcaaaattactcacattttgaactgagttccagaatgtaaagcaacgctttagcatgggctgctgaagcgagctgctctttagggaggaggaggaggcttactgagacgttttgtttgtttctttattttatttattaatgtatttgccatttctccattagatctgattttaatactgtaagtctttccactgattacaagtgcagtgacatgtccctctgcaaccatcattttcctcccattttttcttttctcttttttaaagagacagggtctctgtcacccaggcttgcatacagtggcgtgatcatagctcactgcagtctcaaactcttgagttcaagtgatcctcccacctcagcctcctgagtaactaggactaggtgcatgccaccaaagcctggctaattttttaaatttctttgtagagaggggtctcactatgttgcccaggctggtgtcaaactcctgggctcaatcctcctgcctcggcctcccagaacattggggttacaagcatgagccactgtacctggccctcctccaattttttcttaagaaaaaagagaattcatacttcatttacctgacagtcctcatcccatttaagtgtatacaatggaaatacgtacatttatgaccaatattggtctctttctttctgtaggtttgagttttgattatagacttcgatggagaaagcaatggcgccacaacccagccagggtgccctgccaggacttcctcatctcttgcagtgaaacccccttatcaaacattacgtgctatctggccccctttgtcatactttcttgcactccacttactacatatcaaggatttgccatgttgtggaaaagttggtttcataacatattttgaactcttatttaagggagttgtttttcttatattcttcattccacaaatacttaaccaaggcatattttgccacaggtacatgacttccaaagaaatcataactatagttatccaaaaaaattaaaataatttagtaatgtccacatcgtcttaaacactcttccagaatgttccaaaggaacaaatggttgcagtgacttttaactttagccccagcctacttccagctaaggcagttctcactgcagatatatgtattcattggtccaaagaaagagagaggaaaacttggctcccgagtatttagagtgaatgattcacgattctgtacatgggagtcttggctccttctctgtctctcaggctttttggtaggaagtcaatgataccagtagaaaaaaggctgtttttctgacttaggatttggtccgctctctgcaacccactagagaaactgaagttttctttccataatgatctgaagtgttgatagttaccatctctgtaaaagctcattaaaaaatgacttattttcctttggaaggagaggtcacatgctggagctagcagtggaatatcaggaccaaggatcataagcctcctgctgtaactctggtttccagatttatttgagcctacttctgccagaagtaaatttggtgggcatcttgaatggagaaatgaacagatgatcaaggagagggaaaagggtcaggagtaggggtgggaagaccccaaaatccagtgaaaagggtcaggggtaggggtgggaagccccaaaatccagtgtggcagataaggggaggcccaaaatccagtgtggcagacaaggggtgagggcatccgaaacacacagtttactattttaaccatttttaggtgtatgattcagtagcattggctacatttacaatgttatgcaagcatcatccatgtccagatttttttcaccgtctctaacagaaaatctaccattgaacaataactcccctcccatccctctagtccctggtaagctctattctactttctgtctgtatgaacttgaccactctagatacctcatataagtggaatcataaaatatttacccttctgtatctgccttatttcacttagcacaatgtctttaagtttcattcatattgtagcatgtatcagaatctcattctttttatctctgaataatattccatggtatgtataaggccccattttgtttatcttttcattcatcaatggacatttgagttgttttcttctcttggctatcgtgaataatgatgcaatgaacatggatgtatgagagtatcttctgtttgagtccccttttaaaattcctttgggtatatatccagaagtagaattgctggtcatatggtaattctgtgtttagcttgtgtttttgtttttgtttttttgagatggaatcttgctctgttgcccaggctggagtgtagtggcatgaccttggctcactacaacctccacctcctgggttcaagcga

SEQ ID NO: 119886 - DNA, 1431 bp, Homo sapiens
gaggtgctttctctggctgagggagtcaggggctgtgcaactgtattctttagtgtgaaggtgagccaacacagcgaagtatgctcgccctgcctcctccagaaacaatctgcctttgagtcttttcattctcctggtaaccgtcttcttaatagctgtggcttcatctaaatgaaaaatttatcttgtgctgcttacccaaaggagaggctcctcacatgtcagatattatttcaccaattatctcagtaacttctgtgctttttattcctgaaagcaaagttgagaatgatgcaggtttccacaacatgcggtgtttcgtgcatttttatccttacgtagttacaagaaacaaagcaaaatttagaattatttgaagtacttttaacaccctcaatttgatatgttgtgtgtatatttatatctggacacaattcttttcattgaacagtatagacaaagcatttagaggacagttaagtttctccaataatcatgtttaaacatatctcaggccgggtgaggtggctcatgcctgtaatcccagcactttgggaggccgaggcagattggatcacctgaggtcaggagttggagatcagcctggaaaacatggtgaaaccccgtctctactaaaaatagaaaaattggccgggcatggtggcaggcacctgtaatcccagctgtgcaggagactgaggcaggagaatcacttgaacctaggaggcagaggttgcagtgagccaagattgcgccattgcactccagcctgggcgacaagagcaaactgtctcaaaaaaaaaaaaatctcaaatctattttttaaatttaacctttgaaacatttgtgtaacgcaggtggctcatgggcaccaccatcttcttttggcagatgaggaaacaaacctgtctgtcaacacagaaagctgggtctgctcaagaattgctgtggggtacagtggcaatagcagggacaagagggatgcaggggtcctgtcttcgtgtctgtggaccagcccttctcaaagtccacggctgcccctcttggctccattctttgtctcttcatggaattgttctgtgggaatagtctgcatatagtgattctgcattccaacatctaacttccctgtgccttcctatttacaaaagacacagtttcttgacctgaaatccccagtttgggattattaataacatttttttgtaacctgtagtgcttcagatactgtctcagcctatgtgaattctggtagcattattgccttatagaaattatttgacaggccagatgcagtggctcatacccataatcccagtgctttgggaagctgaggtgggctgattggttgagcccaggagttcgagatcagcctgggcaacatagccagacccctatctcttcaaaaaaatttaacagggcatggtggtg

SEQ ID NO: 119887 - DNA, 1293 bp, Homo sapiens
aatggaaagtgaaatttgcaattcatcccatgttatttatttatttagagacagagtcttgctgtgtcacccggactagagctggagtgcagtggtgcaatcttggctccctgcaacctctgcctcctaggttcaagcgattctcctgcctcagcctcccgagtagctgggactactacaggtgtgcgctaccacacctgctaatttttgtatttttagtagagacagggtttcaccatgttggccaggctggtctcaactcctgggctccagtgatctgcctgcatcggcctctcaaagtgccaggattacaggagtgagcaaccatgcccggccctctgtatttttgatgggatggatggttcaacatttaaagagaacctaaaaagttaaaagtaaaagcaaagaagtcttaataacaaaaagcaccttcatgcaatgtcactgttttactgcatcttaataaagaaatgtggccaccttagacccagaatataatcaatttttaattgtctttcttggataatatcaagatagagtgtaataagttaggttaacatattagcttgcatcttgtcagggaaaataggtagatcctctgaacacagaggaaggagggacgtccacgtttgtcctgtttagtgtcatactgaagaagagtatgaccagccagtgctgggcgttctgcagcttgggacagatgttggggggaagggcactgcctttcttgtgaactttcttgcccaagggacaaatgagctaagcagtactacgttattagtgggatgtgtatgtgtgtgtgtgtgtatgagagagagagagagagaaagagaaagagaacagagcctgtaagtcttgccattttgccttttcagacaacccacccccacccctcagcataggaatgtagtcctaaccccaagccactgcttcttctgcttgcagctctaaacttgagcaggtcttgggggcagttcaccagtgcaccacactacactactctcagcaatcttttttttttttaaacagtgatttgcactgatctagcctctaaggggtaagggccgagatgaagcagagaatttatttttatattatgtcgtctggtgcagagactgctacaaaatcaggagtcaaaaatctaagggaataggctgtgaagtcattttgtccatgagttgtgttacaacacattcattcattgtaaacaatcaccaacagtcattgccataatttattcttggcagtaaattgggttttctagtgacagagtaagccatcagaattaagcaa

SEQ ID NO: 119888 - DNA, 1033 bp, Homo sapiens
ttcttgtctgatctgaggaattttatattcctgaagtctataattaggtgcttgtgttgattgtttattgaaacaaagctgaaggtgggggtgaggggagtgccacatagtggaaaacactctatggcaaacatctgagctttacttaaaagcatgggctgcaaagaaatgtaaattcattggcttaattggaagagagtatttatagaaattgaatgatccagtaaaactaaaagcctggcttctttcatcttcagagacctgccttagtaaatgctgttctggaaatcccttgcctgcaaagtggactttgccatccaatttctggcctcctggcagtcagtcactttgacctaaccctattgcttgactcgtatttactacgtactttccttttttggcttagggttgtactgaaaatgtacatgtaaagaaaaaaatgtccatgtacactgaagttttctgattttttatatagctccataatttgatttcaataactattacaaagaaacttttataagaagatacaatttgaaaatcttgctgtgcagcctcttcccatctactctgcctgcctactacgccttttatagttcaccatatccattaggttctcgaaaattcttccactgtttatgcaaatctttaaatttttaaatacttttattttccttcttagaaaaggtgacaactagatgctattctgcaccttgtttttacatggaatcatataccttaataagcttttcagacactctttcaatcttctgctattatgaagttgcagtgaataaccttgtatatcacttcatacatgtgcaggtatatctgtagggtaatttcctataaggggatcaggatttgggccagcagatatgtgcatatgtatttgtgatcgtgtggctagcccctcctttttttaacttttattttaagtttaggggtacatctgcaggtttgttatatagggaaactcgtgtcatgaaggtttgttgtacagattatttcatcacacaggtattaagcctag

SEQ ID NO: 119889 - DNA, 4051 bp, Homo sapiens
agctacagaatcagagaccctgtgtggacaagcccaacaatctgaattcaacaagcctctcaggtgtttctgagcatgctcaagattgagacccatgaccttagaggtaatatttaatttcataatggcagtttacaaccctatagcactgccttgtgggcggatgggtttggtcctaatcttcttgacatgtaaaaatgtagactcacagcaggaagtgataatatctgttctttaaaggtggtattcttagagtaggaaacttttctgagttttttccaggagtcacaaagatacctcactaggaccgctagtgctttggactagaacaccttacatccagaatcttgccactgggtcagtgcttccctttgtcatataataaaaaaccagcaaaactggtttctataatatgctaaggagttttgtagcgttgaagacttgtcttacccccacaaaagcatcattgttccttctcatcccttgcccctctgcctttaaaattaatttgataccagaatggcaaatacttctgatgactgttagccacgccataatggtgcttgtatttggcaggttaaggcagagttcccatacctctgagcctaattgccagccagggttcagctcagagcagtagttctaaagtttttctggacattagactccactggatagcttttgaaaattcaactacccgggccaaatccatgtaactaattctatatctcaggggtggaacccagggatcaggatttttttttattacccagccgatgacaatgtatatcgaagttagtttaagaacaaaggatgtgcgcacttgttttaaagtagttttggttatgataataagaattataagagggaccaaatatcaaatgcaagaaaatggtcctgaatgccaatacaatcagaataagaaatgcataaatagcgacttgcttgaagctgaaatcaactcctttttggatgcctttcttgtcttttgaagaacacatgttgtagtatgtgtttctctccatatcctgtgtgtttcattgtaatagtcttgctgattgattttgttggctgcaagcaaagtgataaaatgccagtgggtgcctgtgccagggaggtcaggactggactttcccacttggctctgttttgatgcatttagcagattgattccaaccctctttggagactctgacctacaaaagtgtctgttatctttgagagctccagggaaagctatggacctttctagatcttttcccaccttttggcccatcagatattgccttgtccacagcagaacttgacgattcatcatagaagcctatggttttatttattgacactgctgtacaattttccctgtagcgagtcatagttggctgaagagagagtcgaagattaagtacaaaactttctaaacatcctgttttccctcaagacagggcactgttcttaataaactgaacattcttttgcactggccctggggcaagggtgtcccaaaagctttgacaggggtgccatttggtcataaacagtgtggtaatagggtggagtcagaaagaaattctctcatcccttttacaactccaggcaattctagaaccaacccttgggaacccagggaaagaactctgaaatgatacgctggctgaggtttgccgtggccacacctcagggttaagcattgaaggagctaggcaaagagtgtgtgtgtttagctacaaactaagtcacagatcaagaggcttttggtattcttccatttttgcttagaattctatgatggtttttgaaatatattgtccttactttatgttcttacctgtaatctcataagtttctggtaaatttagcttttgccaggttccggtgggtcttacccagagatggtcagagtaaatgaacaaaagaaggaattgattaggatgtgaaacttcagatacgctcacaggccttcaagccctagaaagtagtatgccagtgaattttctagtcctctctacactttgtacagatgaagaaaccgagacccagggaactcaaccaaggtttcttgccattcctccagtcccccagttaaaaaaaaaaaaaaaattaggttctattttgcaaactgacaaggagaattatacaatggaaataacactcattttaatgtatctgttcttgtagtttcttattttattcacctttataaaccattctgagaacattgtcataaagagcattctcctaaattggaatgtgattcaaatagtcctgtctcctttcctccttgctttttatgaaatgactgcctacacgcactcgcgcacatattttagtgagcaatgcaatgtgcgaatacaaatagaaatagattttgttaaaaaaaaattaatgtcagtccactagttaaaaaagtaccaaagtcattacaagattcattaactatgtttaagaaaagtattgagggctttttgggggattaaataattttaatttataaataatggcctcagattcataaaccttaactgattgtagagattatgaaggtttgtttctcacacagttaattatttgttgctttttaaataaccagataattactttgcatttgtaatgattaattgcaaaaagttggttataagaatccctagatgaattctcaggtaagatctcatgcagaattctttgaagttcatttggggtcatttatcaagaaaagcaatgcatttcaggtttatgaactcactttgcccacaggtgaggtttccaggcttcgaaccagcaggaggagagtcagtgggaggatctgacgtaggtatggcttcagagatgaagagagtatttctcctccgcaccccctttgcctacacctagaaataagtttagcctagggaaaaaatgttccctgacttgtcaggttcagctagtgtaccctttgagatccttcattctctctttttctttttgagaagaagtcttactctgttgcccaggctggagtacagtggtcccatcttggctcactgcaccctccgcaccccaggttcaagcgattctcccgtctcggcctcccaagtagctgggattacaaaagcacaccatcatccctagcttattttttcttttttttttttttttttttagtagagatggggtttcaccatgttggccaggctgctcgatctcttgacctcaggtaatccgaccacctcggcctcccaaagtggtgggattacaggtgtcaaccactgcacctagcccgttctctctttaatctcccaattaacgaacatctactgcgacagcatccattacctagaattgtaggaaggtatataggatagacgtagcaaagaggtaagtgggtaagaaaataaacactcataaaaaggagacaaactgtcagagtggtcccctagctacacctgccacaattgcctcctgagaagtccttgttctgcacgagctaaaattcccattcaaataaattgttgctcttcctataatcattgagctgctgaatagagccagggtccttgatagacgtcatagtttgttattgactttatcaccagtaaaagttaatactgtcatccctttcctgcagcaacacactaccatttttttttccaaaattaatttaggtaaagaacatttttcttagtataattttcattgaattcagtattatcaagtttgtatatttttagagcttttggatcgctattccagcccacatttttcatagcaatttgtctagtatttcttcaagatctttttatgttcatttgaaaaatgaacatgacttcatatgtattcattagcaatcactgccgtaggcctttctgtttgatttttcttctgaacctcagagatagtggctcattatgaagtagaaaaaggctaactaagaccttgttctgaacttacagtgggtaagcaagaggcttcagatccataatctctatcaaaatgtttgcccacattactgtaacagggagtcattcagaatgagagtggaggaatttgactccttttaaagaatcgcgtgtgc

SEQ ID NO: 119890 - DNA, 1064 bp, Homo sapiens
tacctaccagagttggttgctctgcccactggctcctctctgcacctccctcccagaccatttctccacttcctcagccttagaaaaaacagctcactcatggtggtgcttgccggtggaccttggagataagcttctattcttggttgtttttaagaaaactgaattctcttcttagagccaacccatatcttatcagtgtaactttactcactctccaagccctaattccattctgtcctttaaacattaggagatttcccaaaaataggcttgtcagtaaaactctggtgtgacaaaggggcaaaagtgttgcttttttgtgtggagattgcatttttaatattctgttccccagaagtggttccaggatgcttccctagaagtctttgggaagaacaattagagtaagaaaggttcttccattatctgccccaggctgggtgtcttcggatgactctgtcacctcacaagttgtttaatcctgtatttagcttgtcagggatcatacgaaatggggtctacatcagattttccacagttgttttttttctttagtgatatagcctggaagggctgggggcggtggctcacgcctgtaatcccagcactttaggaggccaaggcggctggatcacctgaggtcagtatcacctgagaccagtctggccaacatggtgaaaccccgtctctactaaaaatataaaagttagtcttagcctagcgtggtggccgacacctgtaatcccagctactcgggaggctgaggcaggagtctcacttgaaccccagaggcagaggttgcagtgagccaacatcgtgccactgcactccagcctgggtgacagagtgaaactccatctgaaaacaaacaaaaaaaggtcatatagccaggaagagcttcagtgggaagaacagcaggaggaatgaagtcccacgggttatctgaagagatgtactgatttcagaacagtgatgccagctatgaaaactaactaccacttatatcattagatgaagagcctgttctgaaacctcccgttaccactatattatgtttaaaa

SEQ ID NO: 119891 - DNA, 1045 bp, Homo sapiens
aaatcactggccattggggatcaacttaaccttcagcccctctcctctccttggaggtttagagatgggtctgaaagttctgaccctctgatcctgccttggtttttccagtgaccattgtccatcctgaagccacctaagggcagccggccttcattcaaatcatcagcacacaaaaagatacttcatcttctatagtaagtgggcctaccttacaccaagactgataaagtgaggggttttctaaacataggagagaaagttcaggtgctgggcactcaaatcaagtgacagatgttcacctcgggcatcagcacagtgtatgcagtgaaggaaaactgcagaatgacagccatgcagcagacctggagaacccctagctagtctcaggtctggatatcaggaggccagagagcttcaggcaggaggaaaagtggagatttggtagaatatctgatatgatggagagttggaaaaaatttgaggatttggtgagggcaaatggtgccaacgagctagaaagacaattggaaactccaaagaaaacaaacaagctttacaagaaaggatatatagtctcagtatattatttgatactgcagtgaatactgtttatacagtcatgatgtatagcactggttttttatttaaccaaaactaattatgtaactattggggggaaatggaagaagtgagatgggtatcgtatcattgaaggatgtcagtacattagaactaaaatggctaaaccagaaatagctgtgtgagcatatcacttagagatacagaggtgaccaccaggagaaatagtaaaggtggttcccccagcaaggtagccattataggctctctgagctagtgggttttgaaaaaccatgtgcatctatttgttttttaattgtcttaaattattcttaaaaacaaaataagtttctataggagggaccgcagtcaccagttcataggttaaatggcttttattccaaaagttctaagtcagtgagattgcttttcctttagaaacattcatatatatgtggttaga

SEQ ID NO: 119892 - DNA, 1012 bp, Homo sapiens
tttaagcaaaaaggagagtttattggctaatgtaactggaaagtctgggaaagaccaacagttgcccccagggcatgaccagagccagagttttgagtggtggtctcagacccctctctctccttctctccactctgctttcccctgggaaggccccattctcaggcagctttaggctcctcacttaccaaccttactggaaagacatacctgcttcttgccagatagttccagaaacattcctggggttagcctttgctcctccagccttggtcataagccattcaacctgttcgcggtgggggcggggagggcaggatgggccacaatgattagccaggcctggatcacctgtgtgcacagatgcgcttagaccaggaaagggatggctccccaaggaacaaacagggagcttctgcctgataaagagtgaatgtttgctggaccaaccacagcaggcccacacaaggacttgacagaatggctgggaggggaagatgaagtccagcaagcagattgtccttccggagccattagaatgatgtttaacttagcactgcagtagaaagataaggtgtgccactgaggcaagccacatcgtaaaatatatatataaagaaacagatgaaataattttaatgctacatctgacccattaacaacattggggttagaggtgccctgacacagtcaaaaatttagatagatcttttgactcccctaaacttaactaatagcctgttgtttggggttttcattattattttagtgatggggggtcttgctacgttgatcaggctggtcttgaactcttggcctcaagtcatcctcctgagtagctgggattacaggtgtgatccatgcacccagccctaatagcctactgttgactagaagccttaccaataacataaacagtcattaacacatttcatatggtatatgtattatatactgtattcttacaatgaagttagagaggaaatgttatcaataaaagaaagtttggaat

SEQ ID NO: 119893 - DNA, 2584 bp, Homo sapiens
ctacagagtcacactggtaccataagggaagacttcttttaactgtatgtagtttcatttttcaactcggaatacgaacttttggcaccattctatatcaaatttaattttaacttcccttaatggacattgcttcagagtctgaggcaaactggatgtccacgaactatgccagagtcaccagtgtctgtgccgacctcaatctccagctcagcatatgatagcgtaagaattgattgagcccgataaattgcaggctgtttctctttctatcaaatactattaccgtttcttgtgggagagagagaaacgtaggttagaaatagccaactagtcccattatgtatgtgtttgcatttaacataagggctaaattagactttgttctctctcttcctttagttcatgcattaggcaatccacaaattgtgtgacactaaattaaaaccttgacctgtgcacctatgggggaacaagtacaatattaagtaaggaaatttcctttaagagagatggggagatttggcagaagacttttccaggtaattatttatcaaaatgaagcattgtttggaaaattggtgaacaggtgatacacgcacacacagataccagagcctgaaaggccatttgagatgggtctgtttaagaccttgtcctgcagtgctagtgagactcatagcctggctccatcaccgtaggcctcgtgtgtgctggtcccctgaggccacagcactctttcattcatttgacagatattttttagcgcccgctatatgtaaattcttcattggagccagggaatggtgtaagtcaaggtagaaactcttgagaaattcaaggtgaaatgctttaatcaaaccctggaatttttaccttcccttcctgctctaataaaaaactttcatagctttctatgacttgccaacaccaacagcaacgacagccttgcttcagatactaatactttggctgcagtgggaaagagagcttgcttgactgcaaagacacccttcatttctttacctttccccctatcccccacccgctcggtttttgtttttctttaagctccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgtgagtaggagtcctccccatgccccggctctgagggggtcgtttcaaactgcctggtttcttagttcctcactttcacatccacgcccacacgttcttttcttttctctcctactgttttcttctctctcattctctcttccctcctcagcttctaagccagaagtttgaagtctctttacaaagagactttgtttagatactgtcagagataaaaggatttatatttgatgagcatccagcaacggcatccttaaagaggtccctgcagttggaaagtggactgctgttcatctgttacatagatgtctgtgtgcacccacgtgtgtatctgacagatgtgtacacgtcttcagcttgtttctaataagaatctggaaatgatggcttatgggttatctatgtgtatacgtacaactgcatagttacagaatatctttatccatggttctaatagcagattaactcactttctgggtaaattaaggcaagacttaaatgcctccatttcgtctgtagagcagggatggtagcatgatacttatacagccacacgtatgattacatatgtaatatattttgtgaattttagagcatctaaatagccactataagcacagtattgaattattaaagcattttggaaggaataattctgttacaggagggctttgaaaagatactaattcagatggaagatgaatacatacctttttttgcacattttggaattttgttgacagtttggtaacccgttttggcctctggtttagagaaacatattgtgcactagtctcagttcttgcatacatcacatacatctgtttcctttactttcttttctttttagttgttgatataagaccctcagtaattacctgagtttttgatgcttttttggatgggttgtttttttgtttttttttttttttaattttgaaccattccatcttctctgtctttctctatctttttatcctttttcgcctttcttcccccaccacctgggagccatgaggcaagggaggaaggtggttgccttcttttgccctctgaatttgaaccttctgaagaagtagacctcccctggaggaaagaatcctgaaaatagcagtgcgctttcactaaatttctatgctgtgaaaagtgcagaactgtatttatgaaaaaaaaaatatatatatatatatatatatgtgtaaatgttctaattttaacacttggctaacaagcaatgtgacctcctatgtcaagaggagacatttacccaaaggatcatttctccttcccctc

SEQ ID NO: 119894 - DNA, 1049 bp, Homo sapiens
cttagttttttattttcttatgatcatttattttaactgttctgtttctatgtttaatattttaaatagccatagtctttttagaaatgggcgggataaagctattcatttctttagttgtttagagtgtcaaccagaaatgaagattcatgggagaccctaaacatttgcacatccagaaggggagacatacacatacttttttgagaaggagtctcgctctgtcgcccaggctggagtgcagtggcgcgatctcgtctcactgcaagctccacctcccgggttcatgccattctccggcctcagcctcccgagtagctgggactacaggcgcccgccaccacgcctggctaactttttgtatttttagtagagacggggtttcaccgtgttagccaggttggtctccatctcctgacctcatgatccacccgcctcggcctcccaaagtgctgggattacaggtgtgagccaccgcgcccggccacatatgcatacttctaagtcataaaatactttaaaatattccatgcatctattttgtcattttcatcatacttatatctgaggtaattagatggaagattccttgacactctttacgttagcttatgttacatatcaagatattcgaaaaattagtggccttaaagaccaaactgttatagttgtgaaagcccctccagaaacaagacttgaagtgcctgactcaatagaggtaaggagacagcgtctttgttcatctgcaaagatctttgtggaatgcctgaaattgaatgactcattgactcatagttaaagtctgtccccctcctatgaacttgatggttctttcccatttattttacttaaccatacatttgaaaacatttcaatggtttgatgttcattgagtattcaaacaacctaactttgacctagcaggatgttcagttcaaagtggtatatgatgcgctgtccctctcatactttctctttttcataatttgtcatcaacggttttgatcaatttgaatcactttggaaagtttatattgattatcctgtat

SEQ ID NO: 119895 - DNA, 1798 bp, Homo sapiens
aattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaat

SEQ ID NO: 119896 - DNA, 1195 bp, Homo sapiens
cttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagttcaggcttgtggatgggttttctttaatattatcttgtgctcctctattaattgaatttttttcattttctttttcttttttttttttttgttttgttttttgaggcagagtcaatcactctcacccaggctggagtgcagtggcacaatcttggttcactgcaacctccacctcccgggatcaagtgattcacctgcctc

SEQ ID NO: 119897 - DNA, 1049 bp, Homo sapiens
cttcttcatattatctaatatccagcttatattctgatttccctagttatacccaaaatttcttatagcttgacagacaaagaagaaacaatcaagaacatgaactgcattttgttgttaggcttttacgcttcctgttatctgaaacagttcctctcctactttttcctacttgacattgatttgttgaagaaatagttcctgttgaaccttggaatgtcccattgtcattagggttttgtctgattgtttcattgtgtttcttttttcaatatacccaagatagtacttcatccttgtgtttctttatctcttgtattttctataaatttgaagttagatccaaaggcttgattagattcaaatttggtgagaatatttcataaatgatgctacgctaagcagattttcataagttgattttatttataacttttatgtggtagagaatatgccttctgcatcctgtgatacactactggatgacatcgaagatatcgtgtctcaggaagattcaaaaccacaagataggcattttgtaagaaaggatgttgtcccgaaggtacgaaggcgaaatacccaaaaatatttgcaagaggaagaaaacagtccaccaagtgacaggtaagcttttttccttgaaattatattcattttctttttttttcttttgagacagagtcttgctctgtcgcccaggctggagtgcagtggtgtgatctcggttcactgcaacctcctcctcctggattcaagctattctcctgcctctgcctccctagtagctgtgattacaggcacacaccaccatacctggctattttttgtatttttagtagagatggggtttcaccatgttggccaggctggtcttgaactcctaacctcaggtgatctgcccaccttggcctcccaaagtactgggattactggcctgagccactgagcacggccgaaattatattcattttcattccagggagaagctgacgctactggtctgtgtgatatatataatgtctcttcattagaatctttgaacttttgat

SEQ ID NO: 119898 - DNA, 1307 bp, Homo sapiens
atattaaatatctaatacattttaattaaattttaatccattagcagtttgtgtttggtcttgtaacagtacttgtctgtataaaataacagtcctggtatgtttatacaagaatattaggttttgttttacacacctaattttgtttcttatttgggaatagttaaaaagagaaaataaggaagtaattacttgaatgggaattttttttttttttttgctaatgtagcatagtctgttgcttttatatattatatgtatttgtattaattttataaactattgattgttcctactttagaaattcatagttgttaattccagcctggcttgcatgcagcagactgtgggaatactttcttcactagtctaggtgctataggcccaggaaatataaacagaattagctttgataagacatttaagaagtaaatctctacagattttatatttaaagatttgatatgaatgacttctggattacctatgccagtagtcactttcattactatggaataatgagaatgtataaagtttattatggcttactagttgataatgttttcgttaatcaaatggaaacctaaaatattaaatgtataacataaaataggtataaaatataccttatgtataatgtatagggagtttattgaaaacagtatgcagataaattatatcaaaattagttctcagtagtcatagatatttttatcatttggggaagaaagattatgtgggtatgtatttgaaattgctgcttttaaatatgcaaattcaggatataattattctgtgttaatacttcataaggccaggtgtggtggctcacgcccgtaatcccagcacttaggaggccgaggtgggcagatcacctgagatcaggagtttgagaccagcctggccaatgtggcaaaaccccgtctctactaaaaatacaaaaattagccaggtgtggtggcacacacctgtaatcccagctactcgggaggctgaggcaggaggattgcttgaacccaggaggcggaggttgctgtgagctgagattgccccactgcattccagcctgggtgacagagtgagacactgtctcaaaaaaacaaacaaaaacaacagcttcataaagcgaactgtcagagcagtttgctgttgttcattgcctcttttcaaacccttttttattttgaagaaaaaggtggctcataacttttttgttacgtagtctcactccgctgcccaggctggagtgcagtagcaccatctcggcttactgcaacctctgccttctgggttcaaatgattctcct

SEQ ID NO: 119899 - DNA, 1975 bp, Homo sapiens
tccggagtagctgggattaccggtgtgcgataccatgcctgactgattcttgtatttttagtagcgatgggggttttgccatgttggccagactggtctctaactcctggcctcaagcggtctgcccaccttggcctcccaaagcgctgggattacaggcatgagccaccgtgctcggccagcttttaaatgattctcctgcctcagcctcctgagtagctgggattacaggtgtgcggtaccatgcctgactaatttttgtatttttagtaacgatggggttttgccatgttggccagactggtctaactcctggcctcaagtggtctgcccgccttggcctcccaaagtgctgggattacaggcatgagccactgtgtttggccaacttttaaataaactattacaaaatcgtgcctgcttgtctctcattcaaagaataaaacttactgaggagaaatgatgttagcccctaaaactcagaacaattacttgtatcgtgggtacatggatatgtgatataattagattagtatcttgggaagcaattaaactttccctgtgagcaccatggctttttaaagaaatgaatgtgttctccaagtaggcaatttttatagattaaactttttttccagtcatcctttgtttattgtttttggattatttctttgggagatgttggtaaattgttttcagtgtgctcattggtggcaaatcttcatatcttgagaatacatttagtattagaaaatggccacaggtcatttgaggccaaatctggtgaataaaatatgtgctatgatgttgcacaatgctgttctagttgagaataaattttgtcttaagtgattctgaaatcagttcttaaagagttctgaaagagtagctgtgattcttacacgtttttggtctcttcagaacctcacaatccttacacaattttgttaaggaattcgtaaccactccctagcctgatagtggaataaaggtttaggcttccaaggtgactgctttgggaacagccctcatttagatacagctgtgttagatacagctgtgttatgtttagtttgcagccatgcctggtgtgaatgaatattgtatgtgttttttggttagttggaaaaaaaagtccatccaaagaccattgactgaggctgtggttcataaacactgaagagtaatggtgttatgtgtacgaaatatttgtggacatgcttacctaagtcagaatagagtgtttagcctgggtgcccacattttcagagcagttatttaaaaattgctgagctgttaacattcttgatagtttctttgtatatgtgtttatagtttattcatttggcaaacattctctgaacatgatatatgttacagagtagagtgctaaagaggtgtaaagatatgaaattgaaccagccatggattccagcagacaagaagtttattcttttttggcaaaggaaaggccttcatattctgtgttaaatcctagaagttgttttaggaaatacttaagctcataatgtattctttcactttttgtaatatgggaggtaggacctgctttatttttttatttttatttatttttattattttccgagatggagtcttgctctgttgcccaggctggagtgcagtggcacgatctgggcttactgtatcctccgcctcctgagttcaagcaattctcctgcctcagcctcctgagtagctgggattacaggcatgcaccaccacgctcagctaatttttgaatttttagtggagacggggtttcaccttgttggtcaggctggtctcaaactccttacctagtgatctacccatcttggcctcccaaagtgctgggattacaggtgtgagccactgtgcccagccagagttgtttttttttttttttgagacggagtcctgctcttttgcccaggccagagtgcagtggcgctatcttagctcgctgcaagct

SEQ ID NO: 119900 - DNA, 1142 bp, Homo sapiens
atttttctgatctctacattctattttttttctttttaaaatggagcacagaagtacttagtttctgatgtttttccatcttggcccagtaatttcctttttttttgttattttatgaagcacaaaactaaatatttttgaaccaagagactactgtgtggtattaattttgattttgtactaaattcatgttatttacacaaatcaaatagtgtcaaccttaaaatttttttaagcaatatttttcttatgtttgagagttaacatgtatggttgattagaatcttcaccttctaaagggattaaggaaaaacctcgttcactgttgtgaattctaaaatgttttggttccaagtcctagtttttcttaccctggtattatgtccaaaatgaatgcccactaaaagttagtaactctcatggcaattaaagtattttgataatgtttataagttcttgttctcaattttgccactagtaaagatgtgggagaagttaatctttttttgttgtctttcttgtgaacttaaagatcatttttcatcctgttcaacctttggcctgaccttttcaggtcactaaatgtctggtttgcacttcttgtagcatgtgagaaataatacttcaaaattcaagtgtaattgtattaatttttgtgaataaactgctatggagtgctgaagtgtgttaagatgcctagtcttttcagaattaccggcattatggtattgaacttaaaatattttatgtttataatattttagaattttcatgagtcagataaacatatacccagattttcagaaacttgacatttgcttaattgcttaataattcacatcaggcttagagatttgtgaaatatttttgggataatttatttagaaatagcgtgtgtttaaatattaattttcttttttaagaaaatgggcagatgataaattaccatgaaagcttcatttaaaaatctgttgttagtattgtcttctttaattttggggagaaaaaacttctgagatgttaacaattgaacatgtagtgttggctctttttggccttcaatttaaaattgtcatgtgtttggattaaagacatgatgtatttttagctattgggcaagagatggcaatattgcattacat

SEQ ID NO: 119901 - DNA, 2196 bp, Homo sapiens
ggatcacctgaggtcaggagttcgagaccagcctggccaacatggcgaaaccccatctctactaaaaataaaaaaattagctgggcttggtggtgcgtgcctgtaattccagctactgaggaggctgaggcatgagaatcgcttgaacccaggaagtggagattgcagtgagctgagatcacaacactgcactccagcctgggcgacagagcaagaccatctcaaaaaagaaaaaaaaaaaaaaaaaaaaaaaaagaacagactgtagccagctcttaatattaagccagactgtaaaaccaactaccaccatttattagctatataactttgataatatctctgtgtcttagcatccttattaaatgaagatggcagtggtagtcctttctgaagattaaatgaatcagtatatgtaaagtggtcaactttgtattttagtattataataattattagatatgatacctggcacaaagtagtaattcaggtgtttttttgtgtgcattagtgaacaagtaaaaacaagtatatttcttgaatataatgtatagaagtaattttattctttttatctttaagttagaagaaaaattaaagtatattccaaaggttagataaatgcagtgtgtatgggaatcccttgagtttttcagtaaaattctatttgggtggctgtcaagtccagtctgcatagtcttgacatgtcttggataagatccttatactatcacttttcctgtcatggacactacaaattatattgaatcagaaatctaatttaatccattcttattcaattggaagcagtaattgctttcaatttaatgggattggattcagtattagaaattttgatgttccttcaaacttaatacagtatggttatatatatttccatttatttgtgtgtgttcctgtgccctcgcagagagattatcttggagtattacttgtattcacttgagttatttgcaacggttggtaaagaggcatattgtaagggtgggaatgagagtggcattctctttgttttttttcttttctacccatggaataatgaagagagaaataataagggccttcaaaatgggatttccatccactcagaaataaggaaaggaaatttagagtctctggagaagatctggaatgctatttactcttgagggtagacagcatccagccctactaaagatgaaaaaaggagagcctggggatgaaattaaatccatcaaaaaattcactgttggtcaggcctggtggctcacgcctgtaatcccaggctgaggtgggcggatcacttgaggttaggagttccagaagagcctgaccaacatggtgaaacctcgtccctactgaaaatacaaaaaaaattaatcggctatggtggtgggcgcctgtaatcccagctactcgggaggctgaggcagaagaattgctttgacctggaaggtggaggctgcagtgagccaagatcatgccactacactccagcctgggcaatagagtgagactccatcttaaaaaaaaaaaaaaattcattgttagcatgttatttcaatctttcccggcaaatcatacttagagacagctaagtttatcaattctcatgtcctatacggtgctttttcttgaatatacggtagacaagaggtaaggcctaatgggtgaagtaactacatttctgagttagtgtctaattgtttttgatcacctagttccatttgacagaagatgtagtgcttatggctcatcccattgactctttctctgctttcactccttcagcagtgttttcagtagcctttttggtgatcttattgacttgtcttttttctgatgttctttttaattgaattgctatatgatataagatggaatgattgtgttttaaccatgatcttcaagtctgctgtgtaaagaactaatgattgcagtttgagtaaaattcttagtaacaagtgaatcaaagataaagatagatcattgagaatattttttttctctccatgaggaagttcattattagctagcttacaaaaatgaaggaattgtgagagtgttctggaataaatgttatggcttaataaaactattcagaaaatcactgaacaatacaaaagtggaagacattgaaaatggtatatggacacatctaagatcaaaattaagccagagaagctttagggagag

SEQ ID NO: 119902 - DNA, 1056 bp, Homo sapiens
agggcttttaaaaatatttttgttaatttttttttagttttatagagatggtgtctcactgtgttgcccagtctggtcttgaactcctgacctcaactgatcctcccatctcaaattccctagtcactgggattacaggcatgagccaccacacctagccaacgagggctttttttttttctcattaacatagagatatgaagaatactatattggattaaaagtttttgcatttgtgaagtgtaagcagctgtgtgaatgtagtcaatgtgtattcttcatttaataaacataagtatcttttcctttccaaattatacaaaaaatactaaaagcaatcaaacgatttttacagaatcttaactaatataaaaatttgttcattgcttataatacagaataattatataacttggctcattatctaagcttaatgaattaatgttggaatgtaaaaacgagcaattttaagccagcgatggctcaatcatttttaactgagggattttgggatcaattactaaaatgttctgagcctcagtgtctttaaaatgtaatgatgctctattaatctcatgaaattgaagtgaaaacaaatgtgaggtaatatgtttttggaaatatttataagtttaaaaatagcctgcttggtacttgtgcctgtaatgctagctactcaggaggctgagacaggtgaattacctgaggccaggaatttgagtctgtcctgtgcaacatagcaagaccccatctccaaaaaagctaatatatttataaagcttaaatgttataaaatgataaactgatggtttttgaattctttgctctactcacctttcatctgttaaagatgtttttgtacaatttagctcagttcctaaatataccaaaagatggcactgtttacctatgtttaatattttaatttgcattttttgatgaaaaagtgtgttgaatgttttatctacaaatgttttaaattgaggttatttttttacatttaattttctgttttgtaaatggatctttaattcatgtaaagtttactaggaccag

SEQ ID NO: 119903 - DNA, 1556 bp, Homo sapiens
tttgattttttttcttgatttttgtttaatatcagtgagaaaatattacaagaatgaaaactagacatcactggcagtttttactttattgcatccatttttctgttccctaaaccttgagggttatgcatctaaagattcccatggtaggaaaatactgtatgtggttcataaattcatgaccttaaggtagcagagaccaaggcctaaaatagatgggagaactcaactgtttaaaaaaatttgttaaaataaaaattccatagaaggaaaacaatttatgtaccttaaatataattcatctttattatctttcctcatctacagaagcttctccttattacttatttgtgttctttctacagagaatatactaggaggggtatttttccttatttttagctcttgatctgaaagtgtaatgttcttttcgctttgtcttgaaattgttgcctccccatttttgggtctcatctggatctgaaagacattgactgactcaaatatccgaaaaacttggtaactttcaaattggtatacgtggcataattaagaatatgttggtgcaaaagtaatcgtggtctttgccattgaaagtaatggcaaagaccacgattacttttgcaccagcctgtatttcacaaacgtctctgtgcctgtgattacttctctctaaaatggtttatggagtagttgttatgattaataaatggttgataaatactagctattatggtattaagcattaataaggaaaattcactattacatgtaaatgttttgagtccctgaaattaactggcaacttaatgaaatttgatttaagcacacatttagtccatttcaatctatttaaacgtgtttctctcttgcacatctttttctgatggagagcgtgagttaggaaatgagccaaaataggatatataatggatagcctcttttggtagccagtcagacagaatggggtgatgtcttcatagaaggaatatggaattaggagttggaagatttggggtcttgctccaaagatcactttgattgttggtgaacttatttatctagtctcagctttttaattaattaattaattaattattttaatttagagacgaggttttactttgtggcccaggctggagtgcagtggcatgatcatagctcactgctactttgaattcccaggctcaagagatcctcctgcctcagcctcctgagtagctgggactacaggtgtgcaccaccatgcccagcaaatttttttttttttgagacggagtctccctctgtcgcccaggctggagtgcagtggcgcgatctcggctcactgcaagctcctcctcccgggttcacgccattctctcacctcagcctcctaagtagctgggaccacaggcgcctgccaccacgcccggctaatttttttgtacttttagtagagacgggggtttcaccgtggtggccaggatggtctccgtctcctgacctcgtgatccgcctgcctctgcctcccaaagcgctgggattacaggcgtgagccaccgtgcccagcaccc

SEQ ID NO: 119904 - DNA, 1012 bp, Homo sapiens
gagatcgcgccactgcactccagcctgggcgacagagcgagactccgcctcaaaaaaaaaaaaaaaacaaaaaaacaaaaaaacaaagaaatgtgaggtgtgaaatccttcttgaacatttttaacttcactcctccctatgctgccactctgccccctcatcagactcttccttaacacactgctgtgacccagattgtctttatttcttcttgtagcacttgttagactctattgcaattatttatgtatttgtctcattagactgatcttgagtacagagatggccctttattcttgtattcaaagtacctaccaccatatttggcttataataagcctcagtgtttgttgaatgaatttatatcaatatccatgccattcatgagaaacaaaacttattatatagagcatagaggtggtttctaattcgtgttgctcttatttttactgttagatgtaaaacgttgaatgatttgttaccacttggcataattaaatttagcatttttctagtttaagtagttcagtttttgagacacttttatgagcctcactatattaatggccttattggtgctttacagattttgtgattcatgggcactgtaagtataaatttcatgcttacagcaattgaataaaataggcacattgttctttgttagtttcttcagttggttcttttaattttcctgttcttactggtgattccttgaggcatctggccagtgttgagtatttcttcctgactcatcatcccttctgccacctgccaaaggaatgcttttactttggtcaagagcatttcgagtgagttagatttcattattggtgtaggctatggaccacctgataagtctaagcatgtcatactaattagcattgactgccagccaccataatgcttaattcaggtgctatgctgttttaattctaaaggtgttgtgaagtatggaaaaatcctttacctgaatatgaaactagctactaaatttggagttctctccct

SEQ ID NO: 119905 - DNA, 1049 bp, Homo sapiens
aaatgtctttggtataagtcaggcctattatcttgagatttatgcctttattctggaaaattgaaatttttatctcataaaagaggaaaataatttgaatggagttaataaaaatgaaaggagtaaaatttcacttagaaatacagtgaggcatccaaaatgaagaaaaatcccttatttggcttctagatctaaaatgatattctaatctatgcaggttggttcaagagcactttacccctgttggaggcagccaggttagctttattgaatgtaaatctctgacttctcccaagatacccatgaaagcaactaaattcattggttattaggcagcaagagtaagttcaattttctctacacttgtgacaattagaggttggttctagcctgtctaatgcttaagtttcaaggctacctgtatttgagagctgttttggggagataaccttgtaacacatacattttaatgagtacattacttttaccacctgctgaagtcgacttggagtgactactgacctgaagtgaatgcctgtgttcaatattaatatggcatgtctggatccagacagcaatctttcattttgacatgcacatagtcaaagtaaattaatgtttaaaacccaaacactttaagttcagccagtgtgtgcattccataataatccttcagaagcagtttacatagaaatgctgagtgctttcttatactttatttatcatatgtattgggtccacattgcagtacttataacgagatttatccagtgctgtttttgttccttgttttgtggaggctaaagaagttaatttatttcaggatttagtctctgcatattttaagcaaaattatacttaaaaatcttcatgtgcctggcaagatagtagtctaatttcagttatattatttttagatggaaaaaaaaaatcaagctaattgcatactttatttctgctcaaatgatcaccaatttttgaaagtatagtagtagtttaaaaaaagaaaaaaactaggcccagatatagtgtatgtttgtgactacatg

SEQ ID NO: 119906 - DNA, 1050 bp, Homo sapiens
accataatgagaatagtaggtgattggagttgtatgcaaatgacagttttcataacacttttgcagtttaatttcaacaaaaacctcaagttatatttattagcaaacatatttcagctaaggagttttttatgctccaaaaagatggcagatggaaatgaacctaatatgtgttcaaagaaagtatgctgcatttatttcaaattgtatctgatacatcagcatgatgatttatatgttgtcttagaattaaagtagatgccatacttttactgtaaaagtcaaaattagatttcttctatatttgacagaatttattttctgttcataaataaatatagtatttggtttaggatgtagaacatcaaataacaactgttagattatgcttaatatatttatcattttctgaattttggatgttcttaacatcagaaaaatatgtcctttacccatacagtgactttagattggatttggaagcattgtacagagaagacctattgttcctattgaataaggatgccgtacagagatgagctttttgacccactgctcttccagtagtaatggatttgcactaatttgagcagagtatgccacttggtcctgtttttcagttgtcctgtgtgatggctggctagcaaaatcaaacatctgcattttgactgtggaaggcagtataactagctggctcatactggttcaaatttgcaacactgatatggttagtattatggtgtcactacctgaattaagtagttgtggctaaattgtttatattatatgaacatattcgttattattctgcatggagaatttttgtcctcatggattgtttcataaagtgttttattagcttggattaattggaaaataagctttttaatatggacctctcccctagtcagagactttgcaaatgatttctacaaaaataaactataaaatagatgatataatggggcctattattcctgatttgattttaatttgcttccttttataatttttccacaataaaacagagcctctcagaaagtaaaagga

SEQ ID NO: 119907 - DNA, 1018 bp, Homo sapiens
tcagcatttcattttattctgtagcatttttactcctgggtaatgcatttatttgtgtgacctgtgaagatggtaaattttgcaatgcttagcgccttctgtttccccatgttccttgtagcaaactctatgctagtccttatcatagaacctacctattgtactttaggagtcagctcacaggactgacacctcccacttgactgtagccaccttggaggcaggagcttgcttttctctgtgtgtggcgtggagcaggtgttcaataatgtttgttgagagaacagtggtcagaatgaatggaattagttgtttgtgataatgtttattttctctatatggcacaggtatatatatattttaattttttactgtgtatgtctaaaatgaggttgaaatatgttctccatacccattttgtatttaacaatttttttgtagtgtattttgaaatcttggtaggctatttccttttgccttttcaggcctccatacactcctattacaagaggacttctgtctctgttccacatttcccttcgttgttggcgacctaaccttggtgaccgcaagcgatcggttgtgagagaaagagctgtaagtggggaaggctttccgagtctataggtactacctggtggcagtattaacacattttattatgaactatttgacagagaaaaggattaagagaataaggaccagttatatatcacctactcagatttagaaatgaaacattactgatatagctgcagccctccatgtagggggcgggggttaggtgggagtatatttttcattttcactttgtacctttttgctctacaaaagcttcagacttcaaaagaaatctttccttgctctgtgctttcatagtactaccccaggcctaagtgtattattgaacctgccagtgtattataaccatctgttcagatgtctgtcacctctaccaggctgtacttcatctttgtattttcagtaccgtacataatagctagaatggaataggtgc

SEQ ID NO: 119908 - DNA, 1068 bp, Homo sapiens
gtgtttctcaaaggagttttggcaaaatttgcataatgacttggctcatttagctttgtgtattgttaagagttcaaattctgtggatatgaaagtttacagtgtataccaaataaaaaggtcgtgtggtaggcagtgttctcaggataagcctgtgttaggtattcaaatctaatttgcatattggatctagacctatgactattaactccatttacagttgataaaaatttgcataaaattggtcatcttgatagcttaaggtatactgagcaaaatgttaactccttgggtagcatgtgtgactgtatgattgtcaagatgaaagttaatctaagcacatttggtttactgataatcatttctagaaatgagctgtagtatcatgtcagaatgtcagaaacatgtctgacaatttaccttttcatactagaaatggtggatgacatgtttcaaatcctggcagctgtgctgtatcaaatcctccctatgtgaatatcatgcttggtacttagatagtttaggagcagtactgtggcttgtgatttgttgtataattctgaaagaaaatatattaattttgtgcactttatattggctcttgctttattgtagcctttatccattaatctgctactgatggataatttctcaatcatttggtcctttttgtaatggctatgtggagttggcaattctttttattaaatattgcatgactgtatatgtgttaataatttattggggtagtgagctgatataaatctctttttagatgaagtttttggctatttacaaaggttgattactttttagaacagtgattgcctcagatttgcaaaggttgaggaaaagcacacctcttattttacctttttccatttgtggttaaacctattgtaaatatattggaagggttttaggcccttgaagacgcctctgtatttgaacagtttgattctgtcaatttcatttaaatcattattttttgtaagacctcaggataaataccacttttgaggtagtgactgaacaaacatgagttcttgaatagtttctattaaaatg

SEQ ID NO: 119909 - DNA, 1041 bp, Homo sapiens
ttctgccagcaccaccatctgtagactcacataaaactttattcactgttagggcattctgcattgtattgcttctgatcaagaattccttctctagcaaagaaggtgcggctatgggctcgtgctcttggaattaactggtcttgccccataccccgtgatctgaaagtggctagcctaattgaaaggtagaatggcttactgaatactcctaatgctaattgaaaggcagtaccatgaaaggatggggttctgttttacaagatgtagtatacaatttgaatctgtgaccaatacatgtgctgtctctttgactctgggattcaaggggtaagtgagagtagctttgctcattgttacacctagtaactcacttgcagatcttttatttcctttcttggaaatactgagctttgctgagctctggtttggagaccttggacttcaaggggatagtgtttccactagaggatacaacagtggttctatgagattggaagatggggctgcttcttggccattttgcagtccttacactactgagcaaatactcagaaagaggagctaatttagtcactggagtaattgatactgataaccaaggggaaattggggatttgatacactgcagtcaaagagacaatatctgaaattcaggggattctctgggcacctcttagtacttccatccccaacagtgaaggttaatagaaaataataccagccaaaaaagggcaggatgattaatggctcaaatatttcaagaaggaaggtttgggtcactccaccaggtaaagaactcagagcagctgaggttgtttcatctctggagctttgatctgggtcttctttttaatatcctcgagttctatgcttaatttttgggtacactaataatggttataataactttttaatgatttatctattctaacatctgtgccaattctgggtcagttcttattctccaatttttcttctcattatgggattcctttttcttattttttacatgcctggtactttttgataagatgctaa

SEQ ID NO: 119910 - DNA, 1159 bp, Homo sapiens
gaagctgaatgtgtagaatttcaagaaggtaattgagaagtccgggagtagagtttatctcaacaccaaaagaatcatttttaaataaatacagggtgagaaaagtgaagaatcaaaagagtagcttttgaagcacagtattcctaaggtcttgttttaaggatatgtttctgtgtttgttttttattgatttgagatcatcttaatgcgtgttagaaaatttatcaggctgaacgagttgatcctaaaatgctgcagaaaagttggatgtgaaatgggaaagaaaactaactttcatgagatgcttcgtaaaatctatttcaattcagggtgaaaattgcaaaactgtctgccaatgcgtttttgatggacattctggctatttgtgtgagtcttctgcattgaggttttatttattgagcttccttttgcttcactctagaccaggtggtttacatatgttatctcatcttgtccttctgacaaatcctgtgaggtatgtggtgttaatctcattttaaagatgaagattttcaggcttatagggtttaggtagttgacttaaggtcactggtagtaagcagggattatggctgggtctttgactgctaggcaagtattaacacctcatcacacacatgggctgctttttctgaaggtagtaggtggagatttctttccttgagtaaaagggcaaaaaagaaagaacgtaaagtagtttttagaagtagtttcttctggtcaccaaattaacaggaaaagggaaacttgtctaacctaggtgttgtgttttccccattattctgactacagtaatttctgttgaaataaccacagtcattttgttgaaaagccatacgtgtttctaaataaaatagttacataattttaagtgcatattttaattaattacacattcttttaaattattcatagactatcatagatttttatatcagttggcatctggagtcacaatgtaaatattagaaaaaagattcagaggacctttttcccaaataaaatcatgtgaccctaaagaacaatttaaataacactataaaaacagagttatcaggagagggagtggtggctaccgatatttaccattttttcttggtggggatttataggaatagaatacagtcagttcctctat

SEQ ID NO: 119911 - DNA, 1056 bp, Homo sapiens
ctgggattacaagcatgtgccaccatacccggctgatttttgtatttttagtagagacagggtttcaccatgttggccaggctcgtatcaaattcctagtctcaagtgacctgccctcctcggccttccgaagtgctgagattacatgtgtgagccaccatgcctggctgcgacaaagtttcttattttattttttgaagtagtagtatattccattttgaggatatgggatatttatatacagtaaatatttatatatttatatataatatatattatttagccattccttttattctagacatttttgttgtttcttttcttggcttttgctaataacaaaactgctacagtgatacccatgtctttgtatttatgtatcattttgcatatgcataaatatatttttagactatctggaagtgtaattactgggttaaaagttgtgtacatttctaattttgatagatattacctaattgccttgtgtagagattatattaatttatgctcccatcaacaacatatatgcttgctggtttccccagaaccttgccaacatagttctatgtatcatgagttttttttgatctttgcccatctgatgaatgaaaaatgggatctcagtgtcttttagtttgcatttcttacaagggtgattttttgtttcattttctgtgacctgtctgtatccctttatcatttttctgttgggtgacgcttactgatttgtaggtactctctatttgggaaatcaacccttcatgatatgatttccagatttttccccctttgctatatttttatgttgtttatggttgctcttgccatgaagaaaataattactttttacatagttcactttatcagtgttttcttttactccaaggtgatgatggtaattctctgattgtttctgctgttactttaatggtttcattttcttacatttaaatctttgagttacatgaaatttattttgatttatgcatcattgatggttccagctctccttcccctggatgactagccatttctcctgataccatttattaa

SEQ ID NO: 119912 - DNA, 1024 bp, Homo sapiens
attttcaatagttactggtagagctttgccagctattatttttcatttaaaagaaaaaatcgtctttcatataatgaacagacttcaagttgacccttggtttcctcatcttatttctatgaagcactcagggggactattttaagagaacaaactcattatataagtaatctccgagaataactgcttcttcctagtagcttctatttcctttagtcagagactcactctacagacaccaccaccatacaaagggccagttcatactcttgagagtttcagaatgggagcataggtactctttgtcagtgtcttcctatcatttctcctctactctttcctccttttcccccctttttctgctcgttctcccagcgctccaaccctagctggcttaaaggaaaatactttatcatgaatcacttttattctttttagaaaacagattttgaaaacatggttactccatgctgagcattgtgtaagtccaaataaagaaaaataaatgaaatgtaaagaaaaaaattaatctattgaccagaatttttattttgttttctttttgttttttgagttggagtctcgctctgctgctcaggctggagtgccgtggtgcgatctcggctcactgcaacctccgcctcccatgttcaagtgattcttctgcctcagcctcccgagtagctgggattacaggcatgtgccaccacgcccaactaatttttgtatttttagtagagatggggtttcaccatgttggtgaagctggtcttgaactcctgacctcgtgatccgcccgccttggcctcccagagtgctgggattacaggcgcgagccaccgcgccgaccattttcattggttttaagaagttatttttcaagttgtaccttaagggtgctttcgaattctcttattaaagcatactctattctcagtttttagtaggcagtcaatgatttgtgttacgtaaataaaccctctgggtatgggtaaacgtactgcacacttaaaatgtttggact

SEQ ID NO: 119913 - DNA, 1044 bp, Homo sapiens
gaaccagcctcgcatccagggatgaagcccacttgatcatggtggataagctttttgatgtgctgctggattcggtttgcccagtattttattgaggatttttgcattgatgttcatcatggatattgacctgaagttttctttttttgttgtatctctgccaggttttggtatcaggatgatgctggcctcataaaatgagttaggaagaaatcccttgttttcagttgtttggagtagtttcaggaggatggctttttgaagggttttttgtgtgtctatctccttaagagtaatactttaatgggaacttttctaataagtaatttcagtatttgtgaagttagctaataggtgatttttgagtatttgttaagtgttaactatgtgttcttctcggagaatcaatgcatactttgtgaagttgcctgacacagtccttgcctcttttccctgcccattagcactgttctaagtgctgcagtacctggctttcaacggaattgcactttgttgaagggaggtgggcatattaagtccttgcttctttctttgttccctcaagttaacgtggaagaagtatccttttttcacattttctctgaatcttatctccatggatcttcttagaaaccttcttctagaaattatttcctcattccatatttccaacctctccaactcccctggaaccttttcattggtatttaaacatacctgggtctaatcggccccctgtgcccctgttagctattgtcctacattttttcttgccttcccagccagacttttaaaaattcttctcttcttaatttcattcttatactcattctttttcccctttattggttttattgtgaaatatattaaacatacattagcgtttataaaacacatacagtttaaataataataaacacttaaacatctgccacccagtgtaagaagtataacattgtcaagaccgtagaaactgccgtgttttcaatcataactcccaagaagtaacctttatcttgacttttgtgagtcatttccttactt

SEQ ID NO: 119914 - DNA, 1042 bp, Homo sapiens
aggagcagaagaaggacgaattaaactaaggcagagaatggtattcaccagatgctgtccgttttcagagaatgctttttttttttaatgagaagcctgtgattgtctcaaattatgtatttttctctgtagaaaggtaaacaagatacaaagatactttactgctactgataccccctatgtactgaacctagagaatatagtttctgtgattatcaactttataatgtaattaatggacatagttctagagtatttctaaaagtttaaaaactcaaatataacttgtgtcaatgggttttgttatatatgtgttattaatatggttcaaagtaatgaaatgctgtttgaatgattaagtagaaatggcaagaaaagtttgccatttaaacactacaaagctagtggtagcaagcacaggttcctttaatgtactattctgcttgattgaaagaaaatttaaaaagatattatatatgattaagtatttttaatggccttgaagacttttgatcatcacaactaattcttattaagataacacttaaactaacatttgatttctttccagaataaatacaatcctgtaaaaggtacaataacagttaacattgggaaaatatcagattgaggtgacatttatacatataaaatctttcagtgatggattactcttgtcaagcattttgctttattcagatatttttccagttgtcaccattgcctaacacaaaacagcaaagatgagtagtgtaacattgttaaatgttaagtcgtgctacacatgtgccttttctcatcctccagcaccatcctttccctttgctgtcctctcttgcatgcgttttggttttccatgagagtgaggtaaagcttagattcaaagagagcctgataagatgttgcttctccttctgttgcacccaatcctttatacccaaatgtaaagatttacagcagtggggtgggacctgtctttttctaacctggactctttacccatgattgcttcactttgctacttattcctgtgtgtcatcat

SEQ ID NO: 119915 - DNA, 1053 bp, Homo sapiens
acttcataagaatagagaagtggttaccttttcagttagtaattatccagtttaaaagaattaaaaaaaaccctttccagttctcttgttaaccacattcactagtaattttcttttttaactaaacttctaaaagttacttttatttactttttgagaccgggtctcgttctgttgctcaggccggagtgcagtagcacgatcacggcttactgtagcctcatcctcctgggccaaagcaattctaccatctcagcctcatgagtagctgggactacaggcatacaccaccacacccagccaatctgttattattattattatttttttttagtagagagggggtcttgctatgttgttcaggctggtcttgaactcctgacctcaatcaagtgatcctcctgccttggcctcccaaagtgttggggattacaggcatgagccaccttgcctgacttccaaaattaatttttaattaaaaaaattttgtcattagaaggtaaaaaatcacagggttttgatttggccttttgtgagaaataagttagatgatgcaagttatttgagttatactttaaataatactatagtttgttgattttttgttaaacttagatattttaattttaactcttctaattatatgaaatggctatagtttagtatcagtttcatctttttgtttaaaatgttagtggcagattcagtgaatcattgtgtgcttttaccagtcacaatctccttttttcagctatccttgcccaccaaaaagtatccttttacatggaaagttagttcaaaatattagactgaattaattagtattattggttgggtattgtctaataagattgtctcccaacagtgctatgcttaatatgaatttacattttcctatcatttgtcatctccttccactgtttggatattgtctgtatgctgatttctcccaaatcttcgtctttgatctgtatatctccttacaggctccagccttgtatatcccactgcttccttgacttcgccatttggatgaccttgaccatggacacc

SEQ ID NO: 119916 - DNA, 2211 bp, Homo sapiens
aaatcatgtgtttacctgctcatggacatgtgttcaccagatgcaccctgtttacccagggctgctgatttcttaaagaaatatgcaccttctggatagagttgcataacttaggagaataaaagctcgtcaagccggagctctcaatctctgcatggcagaatcagctgtagcgagaagaccatttacatttcttaatgagtggtcaatttagatcacagaaccatgtacagcattatttacctttcttcttttgatttacttagtagtttaattttacctgtctactgagttatttaacagatagcctcccaaattgttgactaaattgtagcagtagtgactaaccagtcttttaagatgatggtgttttggtttattatgttatttttgaaaacatgtttttcagaagacatattaaaaatgtacccatccctccccgtttctaaattctgattgtggaggtccggcttttggattaggcattttttttttttaacacctcatgagtaattcttatgttcattaagatggagagtagttactttaatattttatttactaactatcaaaactgaatttattttttccaccttgcttctgttttattctgttttttaaaaagttaaactgatgagccaggcatggtggcacatgcctgtaatcccagctactcaggaggctgaggcaggagaatcacttgaacctgggagccggaggttgcggtgagctgagattgcaccattgcactccagcctgggcaacaagagtgaaactccatctcaaaaaaaaaaaaaaaaataaataaaagttaaactgaatgatagtgactcccctaacatgtgtgccttaaatgttcaattttgaaaaggagtacatttaactctctataaacctagagaaacaaggaaagtcattgtttcaggattttgacaggtgcaaaactgtaaataattacaggcctgggcagaaactagaacagaagttgcacagcagctggcaggcctgacctgtgacaggtctgacctgagttaagtagcctaaatttcatggcaagctcagatttgttttatggtatgaaattcaccttctgctacagaaagattctactgattgaggctagatatttgccaaaaagggagtaacatacagaatattgagaaagaaaactgcccactgagccacctcttgtatgacttcaggaccagatggaactagtgtagatgcattttaaaatcaatttacatttggactgaaataaatcactcaacaccaaatggtatacagtggttatagctgaggagggtggtctggaggtttttgggtttttttttttttttacactttttatgtaatctgtttctaaaacattttaatttttagacttaggagcatatctgactttagtgaagaggaaagcagttttaatttaatatcttgcgaatacctgaattgtatttttcaaggtctttgtagagaataatacaaaatttcgatgagattttatcaccttcaggttccattaagcagttctccaccttaggacaccagatttgttcctggtccataaagaagccggctagcagcttccatccccacatgctgtgttgcgaccctggaaagctgcagtttagaaaggatagggttctgatgacttatgggctcaatctcacctatacatgaagttgtttttttttttttttttggcttgcccagtgtcttgaaaatttgacaatttcacattttaaaaaatctgtgtttctagctttcttggaaaaaccgatgaatggcagtgctgggcctgcactgtactattgctggaaccaagtagtagctctctgcttttagactctctgatttgctccagtccttatcattccctgttgtactttcatgtctattaccttcctgtagatacatgagttaatgacccctcgagtagaggatatgtgcctcagaagtggagacatgcagagagaagacagctttcaggaggatgcttgtggaacctttatacagttaggcttggtgtgcccatgtcttctgccccctcccactctgtctaaggtttttccctttttttctacgtaatacctcaattttccccttcaccattagggaaattatacctaccagaactttgagttatgttcccccagccacccttagtaaatatcctatgtacctggtgtgtaggagttttgtgaatgt

SEQ ID NO: 119917 - DNA, 1024 bp, Homo sapiens
gtatttcatggacctgagtacagtacccagcacatggtagaaattcatcaaaagggttttgagtattaaaataataaagatagaatttggaacagatctccttaatactagcatgttctttttgtgtagcttgtcgttttatgccattttttttcctgaagctctgtgtgagaagacatgtgttaattaaacttaagtttctgtctcaggatatgttgagtatatgttgataggctatcctaaaacaactccaggcagtttatttaaatgcaatatgatatcttcagttatcattggaggacaggagagtgataatttcatacttcattgaaacacaaaatattaatataggatattttttatagtgtctccaaatacattaaaggaaacctgcattgatgtgcttagaaaatgtgtaacattgactcaagcataaggataaacacaaattttgtttcttcgtgtaaattacttgtgtaatcgtttttttttttttccaggttcagcagatagatcgtgtggtagaagttgtggaggagacaattaaaggtaatcgttgaaagtgagataaacagatgtatatattttctgaactacatagtagaaacaccactcaggtaactcttgccaggcacctttataaaagttattgttttagatataaaatcataaaatgttatccttggcttcatgaatttgccagtctaatattggaggcaggcactcgctgtatatttgtttggcttataaatgaatcaggcaaagagcaatggcttactcctgtaaccccagcagttggggctggggctgaggctgaggctgaggctggaggattcctgaggccaggagttcaagaccagcctgggcaagatcctgggatctctgggggagaaagtcagcttgatgctgtggtgtgcacctgtagtcccagctacttaggaagttgaagctggaggatcatttgggtccaggagttcaagtctgcagtaagctataatcatgtaactgcactccagcctgagca

SEQ ID NO: 119918 - DNA, 1048 bp, Homo sapiens
gctgaagatgtttgtggcagaggtaccatgcatttttgtttggtgtacctctatattttttagtgaagagggtcttgagtaatgcccagttcttggactcttttgcccttcctccattcagttgtaatgcagttctgggcagtgacagggagcgtgcttcccagtgttgctcagaaacactgtgcctctttgaaggagctttcatttccacccgggagcatgtttattttcaggactttgagagaggtagttttagtcttggtaacttggtttgccgagagaaaaagtgatttgaggggatttaatgtaggtaacattacctagagcagtgattctcaagaatgtttgctgggagagggatggtggctgagaggacccatgacctgagaggggagatggcagactgctcaatccagactattgggaaactgggagctggggagttggccctgcagccactcacctggattcattgccatggtaagcccctgttctagacaggtaaggatcatatcactcaggcgtcctgaggtggaaaaacagccttggctctctgacatggtccctgaacacacgtgcttatactcacccaggaccatgtacggttccaggttcattacctatgcctttttcccgtaactcacacccgggaaagtacatcacaatgcaaatgagtgacttcacaggggtgacctttaatctactttaatttgtatatttaagatgtcattcacaaacttgtgatcatcttttttttttttttttttcaagacagagtcttgctccgtcgcccaggctggagtgcagtggtgcgatcttggctcactgcagcctccacctcccaggttcaagcgattcttgtgcctcagcctcccaagtagctgggattacagacatgcaccactatgcttggcttatttttgtatttttagtagagaaggagtttcaccatgttggctaggctggtctcgaactccttgcctcatgtgatctcccccgccttgtcccaaagtgctaggattacaggtgtgagccaccacaccggcct

SEQ ID NO: 119919 - DNA, 1014 bp, Homo sapiens
ctcctttcatctttggccagatataacaagtgactgttacgttatttcctactttgtctttagtgtgcaatagttttcaattaaaaaaaaaaacagactattgttaggtctgctgctctttaatgaatcattggattggaaaataactcattataccatcaggcagagatactttcctttatttgcatgtagatagtgaaggtgaataatttatcaaatgttattagtgcaggctgcatattactggagtcgcagcaggatataatgaaatttgtctcatgcaagtatgaaaatagcatgcctttgcatagtcattattgaattcttggcatctcttgaagaactattatgttagcatgccagtcttgctcacctcttcattaactgggcttttgattggagagtttaacttatcttgaaaatctgtggaatccaacatgccaaatgcttgcttgactttagcatgtttccatatcagagcatacattttcagaacgaataaagtactaaatgtttcttattaaagtgagtagtgcaaagaggctatgactgatggtgttattacttttggttgtgaaaagttgtaccggagatatttaagcaataaagctttctgaaatgacaggcgatgaaacatgtatataactacttagaatcttagagctgtacgaattatgtatttgaagttattttaatgattgctttttaaaagttgcatttaatatgcttctgtcgtgatggcatgaggaggtcaacaaaccttctcaaaagcaatgctaaagctgcacaagcagtcaaaagcaaatcatgtcagtactctggaaatcaactaaaagcattcaacaaactgaaaagtgtttattcatgaaaaaactgaactttggataaaaacagtgtaagtctgtggtattaatgctggggctgctccattttccctcctctattcggtgagtaaggttgcaactagggcaaaacaggccatgaaagccagcagcttctttgctgctcccaaga

SEQ ID NO: 119920 - DNA, 1055 bp, Homo sapiens
attctttaaattatgagtccatcagaaaaagaaacattttctgaaaatttgatgagatgaagggcttctgtttcttaaatcacagggagcacctaattacccgtacaaccacatctcattccccacagatttaagctgttctgccccttttacttcatcctccttcccttttatttgaaattgttttccttctgttctgctctttcttcatgctccttctcattgagaaccggtgaacagcttccttgtccaccatctgcctgtttctctgaatccaatggctttacttcctccaggacagtggcggttgtgttgtcagtagccctcttttctgtagtctcaccactttctggtttatcctccacactgctgtcaaagactagagaaggttgaccaaagtcattcggtttttcccaaaaaaccccatggagtggcattcagtgacttggtgaatttgttgtagaccagcatctggccttcagcgttgaagattcagaaacccaaacttatcaagctcagaaactagtaattaaagcagaatttaacagtgagaagtacagttgtcgcttgactggagtacctcacatattcattctgtctgtctagcctgagccgaattataaatgcaaggctgtttgctttccccttcctcagttcttttttccccttcattcaaacattataatactttcccgcaactcctgattatcctatttaaaattgcaaactttctaacattccttctctttttctcagttgccttgttttcctctgtaactttaattggcattgaaatatataaatgatcatttatttgtattttaatggtctctcctcactggcatatatgctccatgggggcagggcctttttgattgtgttatttaccactctatccccagtgagtagaaaattatacacagtagggatttaatgcatatttatttattgactgaatgaatgaataagttttaaaatttgacagtttagtgggactatgctaaattatcatcatggtacagattgccttgcaaattggacaataatatttggag

SEQ ID NO: 119921 - DNA, 1379 bp, Homo sapiens
agtaaaaatcctgctctgtcactatatatagtttgagaaacactgatttaggctagtgtgtgttgtaagattctttattctgttttggaaaatattttacccaatctacttatcttgagtgtcccttctttaactgagaccctatttcgactgtcttttatgctattaactacttgtaattagtagttgaccagtactttcaaaaatggaaacttattatttacatgctaattagcaaagcttctagtattgactaaagataaaagatagcttaaacatacagagcaatctcctctggaaggtggcctttctgattaaatactagctaagagtgtgactgtgcctaacagttgtagcttacatcaagtcacacaatttatatgatgttcactacattatattctttcaaaagtaaatgtatagttttcctaacatggctctcatgaaacttaaaatctaggtattataactgctatatttgcacaccgtaaggtgagtacagagctgtggttattattcatgttcttctgtaagctttatgggtggcaggaaccttaatctttgtcatgagccgagaatgtgacaccagcctattctggagaaggtagtagaatctataatacattggaaagagctctgcacttggagtttgtagtcatagacactttattttctagctgcatgacttgagtaaattaggtgagatcttagagatgatgtcttttctggcatgggtatagtgctacctactgaatgtatagcttagcacattaatacatattttctttcaaatcttgatgctgctgtatcttctactctaccgtcattctctgagaccccttctacccttgatttctttttattctttctattatttaggtaagaaatttgctgggactagaatgtgaggttacgactttatgctgttcaatgttggttcttcaatttcctatttcacctgttcagttttaagtgaatgtttgacaaacaaaaaaaattcatcttagtctctcctgtagctttcagcgcagtgtctttctcacagtattcactccataaatgtttgttaagtatttcacttgacagcagtgtttcttaaatgcagaaaaaattttctggctaacctggaatatagttcgaattgcttctcttactatagatgattgttttgtagaaaagagaatatgatagtttggactatgaatgaagtgaaagttatatgaaacaattaaatgtgtgaaattgaggcatttatggcaattgtgaactgcgtttttactcttttgtccacaaaccagttgtcctaaaatttgcagccttttttatgtcttcaacggaatcccaaaatatcttattttcactaaaatattatacaaatg

SEQ ID NO: 119922 - DNA, 2842 bp, Homo sapiens
ctgtgtgtctgggtctggggctttttagggtctcagaatggggagtgcatgctgattggtttgtgagtacacaaaaaaggttaaaatgaaggcaccattcaaaggtaggcacgacagtgtagaaaaccaataaggaaagggtaggttaaagtaaaattggtggaggaggggggatcaatcagagggaagtgtgccaaatgagaagacaggttctcaatccggtccgtggatttgacttgtagcttggctttcaggctttaaactgtctttggtttgaaagtggggtttcactggggacccgacaccctctgcctaggcatttgtctgcctcctgctgctatcattggcataagttattcaacctctctataggtttcagtttcctcatttataaagtgatgatgataataatagtgttgtgagaatgaaaagaggtcacaggtttaatcagcacaatgcctggcacatagtatctgttcaatatatagtattattaactttattactatgatagctatgagaaggcaaacctcaggcttacgtagactgctatttgcttaaggccacagagctagtaagtggcagaattgtgactcgaaccacatcatctgaccagtttttttcaataaaccataacgtcagtggcctctagcctcattttctgcttctgggtctgtactgtagttgtttagttaattgaaaggaaagccacttagagctaaagtttgagactcatctggaagatagcctattaaatctgagaaacatgccgtacgcagcagagttttacagagagaatggggaatatggggctaatgtagtgagtctgtcaagtggaggtaggctgggagaatttctgctgtgtatctatgttgtattgtcagatgactcctaagatgcatccattttgtccaatggaatggaatttgaaattcctattatggttattttaaaggagggactgctaaatcatatagagatgtatgaccattgtgccttcctttcttgcctttttttttcccacttctactggagctaaggtgcatgaaagtgagttgcacttggaagggcacagtaggagcagatcattggatgtatccaaagagccaccatctgtcagctttcctgttgctttaagaaaacttgttttccagccctatcaagagagagaaaaaaaaaaaccctgaaacttgtgtagcccaactttaattaagtataattgaacacacatgtgattgtggacgagggcctgtcagttttttccaatacaagaataatatatatcccatatttatttttgaaaccactttgcttttatttgactgcatctcagcatggtagcaccagttgttttatttttttctaaccctgacaaagcagaatgttttgtttggctttttaaaaaggcaatagtgcatgtagttaagacctcatttactttatctgatgaaacagtctctgaggagtgtctattttttggtaaatccactaagaaaactgggtttaaaacgaggtcatttttaaaaatactggtttcagtttttaaacaatgtatgtacctttgtgatttgtaatgtatatttttgtggttctttttaggttaaccttaaagtaagtattaattgtgagatcatataggtttacaaagttctttctcccttgtgaaatatattttatgtactgttctgttactgctcttgcggaaaacataaactttctgaaatggaatttttagtccgttctcctcccccactttctcctgtctctgttatttttttctatataagtttatgagaacaagatatgcaagtatggatttatttatttaggaccaggagccccttgtaactggaagatatcctctatcaagattggtggtctgttttattcattggtttgttttattctctactcattcactcatttactcaacagaaatttgcagaacatctctatgtatctgaaaatgtactaagtgcaataaaagaaacaagacctagtaatgtatcactgctcttgggagccttacagtctagtgtagtttagttaactgggaaataattttgttttagtctacatggaatataatagtagttttatatgtgtaggacttagagttgtgtacctagaagtttaccacaaatatggggaatgtatcagacttgtttcaaatgtgatagctgaaaataggctcatacaataatggtgtacaacatgtatgtcatgtgaaccagcagcacgttctttggtaatttgccactattgagaattctgtcactagcatcacatattgttctcactctggaattcagtcaacccgggatcctttgagtgtagatttctgtgcttactcctaaaattaacgcccctaatttcacttccaaaaaagattgcaattgttaaagcccctttctgtctacttcaactttctcattcttatttctactattggtcttatttttaaaattttcctaccttaattctcaattatatgcaaaggaagaggcaaagcaacaaaaataatgacaaggtgtcagtagcggcgttgatgttgacacattgcacgcatcttggaaaaagagatgtcaaatgcccatgaggatggagtatggttgagattctgctactgctgaaggcaaattttcctgttgtttccatgatgcctaataatggcaacgtgatggttggcataatgagagtcttctgtataagtgagttgacttgcacttaaatattttgcagttatttgtcagttatttatcaaatgattgtttatcaaataatttatcaaataattaattttcttaattttattggagatttgtcatccaaatgttacatt

SEQ ID NO: 119923 - DNA, 1053 bp, Homo sapiens
aaattttctatcctcatctaccaccttaggcttgctaacgaggctctgcagatgaaaccatagcaggcttttacattttttcccaaaattttattatgaaaaatttcaaatggacagcaaagtcgaaaaaattttacagtgcacacctgtctacccaccatgaagattgttattaacattttaccatctttattatgtcatatctttcttcatccatttctattcatccatcagtccaacttatttttttaacatgtttcaaatgaaattgcagacatcagaacacttcctctaaatactacatcagacgtgacattatagacatcagtatttgtaggattttatgtaaaattttgaaaccatggaatatatacatcttaagagcaagcacatggctgagtttcgacaaatgcgtatgcctgtgtaactcccatctctattttttaaaaaacctgtgaccagatagtatttacataatttcgcaatggaaatatagtaatccccctgatttataaggatgtgttggtaaatagtctgcattttctgtgttgagatcaaagctgtaatcccctccctgtctttgtccctatagtgatggaaataatagattattttagcccaatgtgtaacatccttcttaaatgtattaagaattttaagtgtgctattatgcaacaacttgataaaatattttcttaaaatatgtgtttttaaccacatgcaatatttgctgttaacctttaaaaaatatgaatgacggccgggtgcagtggtggcaaacgcctgtaatcccagcactttgggaggccgaggtgggcggatcacaaggttaagagattgagaccatcctggccaacatggtgaaaccccgtctctactaaaaatacaaaaattagctgggtatgttggtgcacgcctgtagtcccagctactcgggaggctgaggcaggagaatcatgtgaacccaggaggcggaggttccagtgagccgagattgcgccgctgcactccagcctggcaacaaagcaagactccgtctcaaaaaacaacaac

SEQ ID NO: 119924 - DNA, 1049 bp, Homo sapiens
tgtattattagtatgaggtagtaacagaaaatatggatgctattttgatgtatcctgtacattatacttatttcgttcacaaaataagtatatttttctactgtgttttctattttgaaacaaggctgatttttcactgggctcctgaaatagactctggtcactaagtaactgctgtctttgattttgtgttgagggagctgtttcagattctcttcttgactacatggcataattctcttttactacatcaaactttaatttttagctataacacttgaagtaaatcttttttgaaggcaaagaccatacatgcattttggctctattaatattgcttgcagaaaccacagtgtttttatcagagggaaagcaaaaacttgtttacagtggaaagcataacaaaatctgtgatctttttgcctgaggactctttccaaaacaacttactgtaacagacatctaaggtcagtatttcctaattaagacttttcagctacagctcccaaccccagtcatcactcacagggccattccttccttaacgcagtgggtatttcaagttattagcacccaggggccatgcgtttcttcacttaatatgttgaagaattttgttctacttcatatcactaatgatttttaacttttttgggtgtctgtttccaaaatcaaatttagaagtacaacaagctgattaggtatcactttttgtagccatctgagagcagaggtatcattttttgtaaccatctgagagcagagaatttaatgtattgatattttactacacttggaatgatttttggatctggagtagttgggaatgaaacccttgcttcctggccttagaggaggcaacatacttttttccttttttttctgttctcatatgctttccccagaatgcatcattctagtgaatactcagtaaatatttgttccattgaattgaataaaatgagcaaaatagaaggctaacaattgaagaataagtaaacgtagaaaggaagaagtcaattcaaagatgagttgctctacttcttgaa

SEQ ID NO: 119925 - DNA, 2030 bp, Homo sapiens
gaacatgtttttcatatgttttgtcacattttaaaattccttaatgtaggagggtaaatccagtccctgtcactttattttggccagaagcaaaagtcttctgccagttgcatttagcatttttgcattggtattcttgagaacggttgcaggcttttaaaaaattttttgtcagatttcagaattattaccatgtttgtttcctaagaaaagtatcagatactttgtttctctgtttttagtagtttatatagtacttgtatgatctagtctttaagggttgagtagaagaagtgttttaggttctctgtttctcctgtgctaattgaacttcttagacttttctgggttcagttttggtaaattgtatttttctacaaaattatccagtttaactgggttttcaaaatcacttacagaagtttgtataatctctttttctcctttttttttaaataaactttctcttttttgatggttatctgttttttgccctttctaatttttcatgtttttttctttatgctttgcttcctgattagtttaactgactacacttaaaaaaaaattagtcatctttattggattttgttctgattatgaaagtaaacatgttcattaaaaaaaggtttagaaaatttgaaaaaagcacaaatagttggataaaaatcagctagtctaccacccagagataaccactgttaacagtttggtaacttctggtatgttggtatgcatataattgcatgttaattttaacacaactgagatcagttttctgtgcacattcttgtattgatttcctggggctgtcataataaaatatcacaacctgggtggtttaaaataacagaaatttattctctggcagttccaaagaccagaaacccgaaatcaaggtgtaggcagtaccatgttctctccagagctataggagagaatcctttcttgctgcttctagcttctgctcattgctagcaatccttggtgatccttggctttggcagcatgactccattctctgtgtccatactgatatctggacacatggccttaatatgtccccccccccgccttttttttttaaggacaacagtcattggattagggtctcaccctgttctcatctgacttcatcttaacttaattatatctacaaagaccctgttttcaaataaagtcacattcacagattcctggcagatgtgaattctgcagggatactagtcaacccaatacagcattctattgttactttcctttctgttaatgtcaaagctttctttgtactttcatttctatcagtgaattttagtgtctgctgctaggcaaaattggtactagagtgtatcagcattgcaatgtgctagcatttagttatacctacagtttgcccataaacacagatttccatcatgacctgacagtgcttcatcatagaaaagcaaatcagaggtcattaaattttcttagagcttatatcctggttaattttagaaaatgagaatgctctttgttacaatgttcttgaaaataatttaattgtattatatctctaagtgaatagaatatgttttcagacccaaattgtgaatcataaagaactgaataattaatctaattggatcagaaaactaagaaaaaaaaaatagtggcatgagtgtttttgtttggtgtggtatataacaagacattcctggtgctcatcctggtccttatataagctagaacatatctggtcatttttctcatttgttgaacaaatgtttaccacctccagttttatttttgttatctcaagagtcagtagctattctctataataatggtgaattaagtattattgtggctgtgtttaatttaacacttagattagtttcagattttcactaatctaaacagaggattgtggagggcagggtttggaagaacacccaaaattctttgaggacattgtgtgttatgcactgcgctatgttgcatatgctatttttctttaactcctgtaatgctatgaaaggtaggcatta

SEQ ID NO: 119926 - DNA, 1051 bp, Homo sapiens
atgaacacaatgtgcggggtggccctggcagactgttcacaacctgcaggaagatgtcatgtttttatgctactcatttttttatgttattgctttaaatgacatggagaattttaggtgtttaaaaaactatctgaaaagagttgactaattattgttgtttgaagcaatagtgatatggtgtcttctacctccggcaagcatacaaacaccatttgtctaaatagctctgtgtgatccaagatatactattatttacttagagtttttatggtttacatcagtaaggaacttttatcatagggtgtttgtgaaaaaagaactgcctgatctcaaggaatgctttatgataataatgacaggctgtattagcatgattgtagcctgaagcctcccattcctgaagaaggggccactactatttcttgagccttttccttccactctgacccccatcagtcctctttaccaagtactcatttacattatagttcatagtgtggtgtcagctgttcccaaaggtgctctcctcaagcgagtgaatcatttctaggataatggcttgtttcagaacttacacaatgtcttttttggtcttgggagatcaaatgacaaactatcacaatcaagggctagattatggttttttgataacatgtctcaaactagggttagcagtttcttcacttgaggtatatttctggattgaattctataaactgttccacagtagtaatgtcacgtggctcacatttttgcttttgttactcacatactatacagcaataaactcaaattattatgcattatcagattgtattataaatagcaatccagcatcaataattatctcttttgagtgttttgtcttgaagaaaagtgctaagatccttcttagtaaaatcaagctaacataacttttctgtctcctataattgaaatcaattacttcaaaaataaatatagttctatattatgacctaaaaaatatagttctatattatgaccattgaaaataatgaagtgtggttatatagttgcccagttggga

SEQ ID NO: 119927 - DNA, 1456 bp, Homo sapiens
gtttattgagggcctactgtgtaccaggcactgtttgaggtgttagggatattgtggtagggataaagttcctgtcttcatggagtttcaattctagtggtggagacagacaggtaaacagcagactagattaaaatgtcagatagtgaacagtgtaatgaggaacaataaagcaggagatgtagagctgttttggacagagaacttttaggggtggccttcgagatagtgatgtttggtctgaaatatgcaggaagtgagggagagagccaggaggatgcctagagaagagggtctcagcgaagcaaaaggccttggggtggaaaagcaaagaagccactatgagcagagtgtttggagggagagcggtaggaaatgagactgggaggcaatcaggaaccagagcagactttgcattttattcatcatgcaatgggagttggcatgagcaggggattggcatgacctgatggagttttcagtcttgtgtggctgctgtagggacgatatcctgtcgtgaagtccgaatggaagaagagagaatgggttgctcccgtgatagtctagatgagacatggtggaaacagcatcctagggtaagcccctcctctggaggcttgtagtccagaacactcttctgccagctgtcctgggcccaatctgatcacattatttaactttaccactcccttccttccctggcatcccaaagcctggttactcttctgtatttctttcctccatagcacttattgctctctaatgtgtggtatcatttgcttatatattaggtttatttatgactttcatcgcttaccagagcttaagctgctcaagggcagggatttttctattttgctctgtaatgtgtcccagatgctttggaacagagcctggcatagagtgtgtgcttggcaggtatttgctgaatgtatggcttaagtgctgatggaggaggtgagaggagatgtaatttgaagacaaagccaacaggattttcttctggatgttcttgtccatttctggaagttattctagtagactggaggtaataaacttaacttggtacctgacataaaatacaacctcaataaaccattaatatatcattataaggccaatgtgcagtaaagggctacattttactctttcatgggaaaataaattaatagaagaaagtatagattagaggtcagcaaactctggcccatgggccaaaatagcccattgcctgcttttgtaaatagagtttaattgcaacagaaccatgctcgtatgtttacatattgtgtatggctacttttgctctatgacaacagagttaggtagttgtaacagagacctatgggtcctcaaaacctgaaatatttactgtctggctctttccaggaaaaatatgccagcccctgatatagagagcattatactgagtatatggtattatatattttgcagt

SEQ ID NO: 119928 - DNA, 1128 bp, Homo sapiens
tccccaatgttgttctcatgatagtgagtgagttctcacgagatctgatggttttatacagagctctttcccccttcactcagcccttctccttcctgctgccttctgaagaaagtgccttgctttcccttcaccttccaccatgatttaagtttccaagcctccccagccatgctgaattgtgagtcaagtaaacctctttactttataaattacccagtctctggcagttctttatagccatgtgaaaatgtacaaatacactcagtgtgtttaaaatttttctgtgaatcttggataaattaaatacaaacttctcagcctggtgttcacttgcctttctaaccagactctgtcttaataactcctactctctaataagcacacgtacacattctcgttttctctctctctctgtctctctcacatacatatatacgacagttgatgtccgtccctttctgaagagagatgttgtttctttccctacccttggtatccatttgtgaaattccactttcttactcaaggcctgtctaaaatgctgtctcctttttgaaggcttttctggttccagttatggttgttaccttccttgatttggccattcatatggtccttgtcatgtttccttacagttacctgtgcatttgtattattctaccctattagattctaacggatgacatagtgttttgcatagaatgcgtcttcagtaagtatagaatttaattgaattgatacaaatgtttgtgtgtgatgcattttaatatttgctaatctaaataataaaaagtaaaatgctgataactcataatttagaaaactgcctttcctgttttgaaaaaaagagtgcagcttgctgccagtgctcatttaattttacataaacatgctctgtgaggctgaagcaaatctgactgattttcagtgtgaaaataaaacataaaaaatgttcctggagttacttctaaacagaattaacatcagaactgtctgaattatcagaatcgtctatttcagaaaaattggattcatcaaataactcttcggtgaacaattatttgagaacaatgttaccatcatacaaacgaatgctgcgttttctaggatttgacattttcagcg

SEQ ID NO: 119929 - DNA, 1051 bp, Homo sapiens
tcttttgagccacaggtaatcatataagtagactggcttgacaagtctaaaggccctgaattagttatctattgctgtataactgcgaacgttgctgcttaaaacagcacacatttattatctcacagcatctgtgagtcaatagctcgggcataatttagggtcctctgccaggctgcagtctaggtgtctgcaagaactagagtcttacctgaaggcttgactggggaaggagattcttccaagctcacatggttgttgggagcatttagttctttacaggctattggattatgggcctcagtctcttgttggctgtcaatcagaggccacccttagtttcttgccatgtggcctgctccatagggcagcctacaacatggcagcttcttcaaagccagcaaaagagagagttttctagctagatggatgttataatgttatataatgtaatgatccaagtgacatctgtcacttttaccatacttaactggttagaagcaagttacagatcctgcctacacgtagggggaaaggattccgcaagggcgtaattccaggagtcaggattctggaggccatattccagtctgttgttaagaggctcatataacatttttattagagctatctgtatagaagtgctatgattttcttatttgtattttaaaaattcttgactgttaaaatggcatgtttgtgataattagctaatatatcttgcttctttttcctcttatagcagataagttgtagttaattggtagttcatgttaaagttttatttatatttctgctttttcctaccatttcttctcatgagtaggctggagagagcatgtgccaaatcccgactccttggtattatctgaaatgattgattagttctgccatctttaactcttcccttacattccaggtagctcctcttctggttcttcctttttcctttttctttgttcctttccattcttcccctttggatcattttctatttcactctgcagtttaatgacttttatattccccatatatattttatatgctctat

SEQ ID NO: 119930 - DNA, 2271 bp, Homo sapiens
atctaaagtaataagaccacagtaaataaagttatctcccccaatagcatgggtaatgttctaccactgcaccctgcaggtcctccttcccttttctctaccccttctcccctcccctgtgcccctacacctctccttccctccttctctcctctcctattaagaattactgctattcacaggactggggcatatctcagtgttgtctttggcaaggaaaagtagttgagaactattggtgtggaagtattaaaccgcatttcagaaaatgtgggttttgcttcttcaaactaattagctgaatcacttggtctgcatttcttacatgtaaaatgaaaaggttgaactagacaaatatatgtttttagatttttttttttccaactttgattttttttttcttatgattcttgagtcttagcaaaacccagaatttggaagcctaacagattgtctgcataatctattttatatagtctctatattacgtccaccctataatattaggttggtgtacaagtaattgcggtttcataccatgaattttaaatcattataactaggctcaaacacacctttattaatcaaaataggaaccattacaatcaatacatttttgccaacgagaagtgtgtttattccagtagcataaaaatctgtgcttcagggtgtgatgaactcttggaaaacattttctgcatcctgctggtggtggaagcaatttcactgcaaacagtcgtcaagatacttaaagaagtggcagttggttggcaagaggtcgggtgaatatggcggaggaggcaaaacttcatagcccaattcattcaacttttgaagcgttggttgtgcgatgtgcggacgagtgttgttgtggagaagaattgggccctttctgctgaccagtgccagctgcaggccttgcagttttcagtgcatctcattgatttgctgagcagacttctcagatgtagtggtttcaccaggattcagaaagctgtagtggatcagaccagcagcagaccaccagacagtgaccatgacctttttttggtgcaagtttggctttgggaagtgctttgcagcttctcctcagtccaaccactgagctgctcctcatcagttgttgtatacaatccactttttatcgcacatcacaatctgatcaagaaatggtttgttgttgttgcatagaataagagaagatgacatttcaaacaatttttttgatttccggtcagctcatgaggcacccacttatcgagctttttcacctttccaatttgcttcaaatgctgaatgaacgtagaatggtcgacgttgagttcttcggcatcttctcatgtagttgtaaaaggatcagcttcaatgattgctctcaatcggtcattgtcaacttctgatcgccggccagtacgcttctcatcttcaaggctctcctctcctttgcaaaacttattgaaccaccgctgcgctgtctgttcattagcagttcctgggccaaatgtgttgttgatgttctgagttgtctccgctgctttaagacccattttgaactcaaataagaagatttctcaaatttactttatgtctaacatcatttccattgtctaagataaacataaacagcaagtaataagtcattagcaaaaaaatataaggtgagaaatgcccattaaaatgatttataacataaccatatttatgtaagaatgtattccaatatcaaatggcaaattccaacaatgcaaaaattggaattcctttttcacttttctaattttaaggcagggactatctatttatcttgtaaatctcaaatgatcaaatgaaaagcattttgcaaagttgacacctagaaagattgcaaattcaaagcaatttgttagcctggttaacatagtgagaccctgtctctaattaaaaaaaaaaaaaaacaaaacacgtgaaaataaattagccaggtttggtggtgcaagcctgtattcccagattcttgggagactgaggcaagaggttagcttgagcccaagagttcgagggagcactgagctgtgatcacgccactgcattccagcctgggtgacagactaagaccctgtctctaaaaaaaggaaattgttcagattaaggaggatataaaattattttggcaaacaccatttacttggttctttgaagttcttattgcctttaataggtacagtttttatttagatgtataaatttcaatggcatatcataaataacttaatgataatgacatataatgac

SEQ ID NO: 119931 - DNA, 1031 bp, Homo sapiens
attgaaaatggatggtctttgatagactatcaggccctttatttctcttgttgcatagtctgcttggaatggtgtacagattgtagtgtgtttataccctgtgtagggtcccttgtcttacagctctcgtctccaagctttactttcctgttcccagcttcctgacctctaagacaagattgttgatcctttgtctggcaagatctgcattattgctctgtaccttctcgattcctgacttccatttccctgcttcattgtattttactggatacctttctgcctagcactcctcctagctgtgtagcccagtattggcttgtcaactggtctgtccattatgaaatcaccaagagatttgtgtatttattgttattctaatagtatacaagtcactgtgttaaatgctatagcagatagtaaataaggaagataatacctgttccttaagaatattgagataagcatgcaactaatcatgtattcttacacagaataagtcagtgtttcttaagagaagtacagagtacaattggtgataaaggaaattcaaatgcaattggaaggatctttgacttggctggctgtataactttgagcaagtttcttgatctttttgagcctcagtttcctctacggaagaataataatgcttatatcaagattgctgtgagggtaaatgaaacaattaatgtaaaatgcataactgagtttctggcaagcatttggcagctgtcttttactatcactggccacttctcccctcaaactattttaaagattgtgatgattttttacagggattgagaggtgataagtataattctttcaagtaaagtgaataacaaaaaaaggtacagagttaaaatatgctggaacaacattttggagcaaaggatgtagctgatgggaatagagtaagagcaaatacagctgcaattgtgtttcaatttagtacacatattttaatgcaggggaaactaactccgaaagttcacaattgaagatagagacaggagagacgattgagt

SEQ ID NO: 119932 - DNA, 1834 bp, Homo sapiens
gatagggaaacccaactctgaaagggttaaatgagataaggcatataaaatatcagtaacaggctcactggctcacacctgtaatcccagcactttgggaggccgagaggggagggtcgcttgagcccaggagtttgagaccaacctgggcaacatagcgagaccccgtttctattaaaaaaaaaaagaaacagaaaaacaaaaacaaaaaaaagaaaatatcgacaacagtgtctgatgctcagtaagggctaaacaaaattgagttactctaccaaggaaacgacaatagaatggttttccctttccccttgttatagaaagggcagaatatgtaaagagaagacatagaacaactgggagactagaacctctatttgtaagagaagccacaatttgtgtttattttaaaaatgtaaattacttaggaggaaaagagtgttagcagttcaagattatgtggtcggttaaatagttaaacacgttttaaaatgtatgttactttacttaaggatcccatgcgaaaattctcagaaattaagcattgcatatttgactgctgagtacagtgattcatatgtatcttaaagtcacatattcataaaattacacatggatcagattcaattgttaaaagtacaatttttctcaatatgaaattttaaagcatttgtgtactatggtctttttaaagccttgctactcattatagcaatcgaatcactgaagaaatgttcctttttgtttggttcaatgttattgagtcttatctttttgatataggactattttttattttgtaactgtgtcttttattttgtaataaatttgtttaaggtatattttaatattataagagtagaaccaatattttagttttaaaaagacaattctatatcatgtctaaatactattgggaaatatgcctattttttaattttttaaagctagtattgccattctactttttttactttgattaatgtagtctcagagaattattcattgaacatgctttaatattttttcctgatttcaaggagtgaaaaaagattatctaaaaatttctaaggttgtattttcttatgagaatgctatattatctacttatttattcttatatcattagttaaaagttaaatgagtatgtgttatcatttctgaatactatagtgtgtataaggaataccagaactttctagttatgatggccaaagtaatgtcagtagtttatgaaaaagtaatttaggtcttgaatttcttttgattagtcattgtaagcatttttaaactttcttcctcatagatttgtgcacttttagataatgtgtgatttgtacagtcattcttgagtagttgaaacttaaaagaattgcaaatttttgtgcctggtggagataaaataactctgaggcatggtagatacttggtttttgaatctcttgtataaaccaagcaaatgtttctgaaagagcacttttgtgtatgttttgaggtatccccatgttaagtatatgctatctttagaaatttgagtcttatttattgttatcatttgaacaggtgtctcaatgcttgtacctactgcaaaactaaacacgccagaggaaatttggccagttatccaattgatgaactagtagatagagccaaacaatcttttcaaggtaagagtttctagaattatatgtgaaattagtcttcttaataaattatgttagccttctaagtaatacttcagtttagagaccaacttctttagttttctgaagagttttacaaatatacgaacttaattaataaaagatgtgaccagagttaatcacttagttta

SEQ ID NO: 119933 - DNA, 1043 bp, Homo sapiens
agtgaatggatggtttcaaagtccaaaggtacttatttaagttaaaaggctcagctgtttttgttatcaaccaaggcatcacaaaaggatggctgacatttatggagtacttacagtgcatagataggaattacgatgaaaaccacatggtccctgtctttaaagatcccctcctagtttaggagagagagtagcaagttggactaatgaaaattgaagtatgcagaaacagacaccaaatttgggataacagaagtcattcttacaaatcagccaggtttcctcctcagaatccctctcactaagtttttgttagccactgccattgattatgctgagtattcaggatgagatctacttgctgttctgaatcccgaggcttctgttatgccgaagtctctgaaagaaagaaaccaaatggtgactctttaactaaggtaactattggaactatgtagctgttatttttccattcattcaacaaatatttattgagcattcattagaagcagttcttatttctgctaataggcacatgctttagaaaaggtatgataacagtacattatcacaatcaataattgattacttctgccagtaaggaggacagaaagagaggtttgctgataatggggcagacagcttatccttgccatcggaaacaaggatgtgatcccaagtttgttacatttgttcataattctgagttttcatagttcagagtatgtatagtccaacgcacagaaaatctgctgcttctggaaataccttgttaaatctatccttaatgaaaatcatagtgcagtcatccctcactgctattggtgagttttatttacgttttactcttttgtgctctataaaacagtttacaaacatgcagttaagtataaaagttatttaaaataatgaggctctgggaaaacagataagaatagaaagtccaaaacttggtggaaaattggaacacaggaaagttggccataatcacacatgtggtttttaaaatcaagcaacagttttgactcttagcttcttgaaca

SEQ ID NO: 119934 - DNA, 1021 bp, Homo sapiens
gagacgtttggtttgaatagggcaacagacttctgtgttctctatcaagatcctgaggtgcccatattctgctttgattgagtgcaaatccacctgcttttgagatcaaataagcaaataatgaagtttatgtcctttggaggaaaactgatgtatttaatgaagattcttgcctgcatctggtgagagccatgcgtctctgctcagaggtggagagaaatgctgcttactcaggagcacgtgtttcccattgcttcatctgtattttaggacatgggaagacttaaccaagaggggattggggtcaggcgtatgtggcagtgtgaatatgggtttagtaggtgcacaataaatgttgaatgagtggttaatctagaattgattatgcctgatgaaattccatgtatgacttggaacccataatgaaaaagtagtatggaaaaaccatactttttaagtgggcaagagatattgcttagtttcagctgctgttccagcacaattgaatgctgtgtcttatgacatgggcttgattttataacaccagatatgtagaggtggtggctttccaagatttacaacagagaaataatttactttgggaaatcatctgatagttaatgggtatctaacgttttaccaaaggggtatgtccacctagttccacacttacagttataagtaatatatatttgctttgatacctttactaaacaaaattctacaaatgattcttgtgaccaggtacaagagttaaccaaatgtttgcgtttaccatttgagctgaggctgatctgtctctgggatgatgttggagaactttaaaggctgcaagttggttttggaaggttgtttaatggaattttaatagccttggaaagatgtgaaagtgatactgctacctggtggtttgtaaacccgacctttgtgagatattttctgggcaaaagtactactttgtgatgccagcagcctttattgattccgcagagtctgcagttttctaacactggctgtcaat

SEQ ID NO: 119935 - DNA, 1259 bp, Homo sapiens
aaatggtgacatttaaaatagcttactttgagttaatacaagcaaattattgagtttttttctagcacattagccaaggttagtgtgcctgttaatcctaattgttattactattatttgtttatttaacaaacatttgtcaagtgcctattaagtggagagtttctgatagtgaaatgatgtttacattttacatattctactatgaattctggaacattagaagaagcaatttgtgatttctaactgtgactgatagcaagttatgaaacaaatatatttttctcttcataaaatataaaattgctaaaaaataaagtgctacttaatgatggttggcttgttcagaataaataaagagaaaactaaatggaaacttggaccagtgtattttaggtaaaatggtatttctcaaattgaatatcagctatttcttgacattttatgatgtagtcaaccactctattgctaagtattcttaaacatcgacttcagaaatcaaaattatcattcctaaataagtaaaagtttattgtacatgctgcatgatatttattatatcctaccatcgataaacataaatagcacatggctgattttatctctttatttttattcttttcttatttataatgattgttttctgtgagcacaggtgtgattataaatacaattcaggcattttgccgttttatggtccttatataaataaaattttctaaagtgtgtatcaaataattttccttgcacttttacatctagcttttcatttcatctttatattcacctcatgaattattgctgctggtgcttgttatctctgttttgctgaagcacagagaggttacgcttagagtctgaagaagagtagtaaaattgagatttcctgattgattggcctctgcactttgcactatagcatgctgttcctcagggaaaatgttgggcttaaatacttggtattgcaaatgcatttgttgctataggtgcaatttagtttattatgataactggggtcatttcatcagtttggatcattttgagagaagcccttagtggaattgccatcacaatgctcttgaatggtggccctgacaatatttccccagacctcagtttcgttgtccatagctgttgcaaaaagattaaatacctgttaaatacaacagaatactgaaaatcagagccaagcaaaacttctaggctctaggaaccttaatatactaagagaaaagtgttttaatatttgtattagtaaa

SEQ ID NO: 119936 - DNA, 3046 bp, Homo sapiens
aaataaaagtataatttaaagagtaaatagtaaaccacattgcattttccttggtcattttttaacgtgtgtgttttatttctacaggccgatgtagtttttgtctcaaatataacaaaaacttgtttattagtgaagcttcagaataagaaagtacagtgatggttgcccagcagtataaacatactaaactccactgaatgcacagttaagaatgggtaaaatggctaaaaacaaaaaaatagtatttgaggttatatattgtgtaaggaagtaaaattcttaaaacttgccaaattaattttatacgaatgctttcacataacattaaaaataagatttctagcataatattagtaggtcatatatggttgatttccttatcaatatgaatattaatatcatgaaacatttttaaagatccatagtatatattcatataacacaaatagtcacaatgaagtagcatctgatggctgattttttaatgctgtataatttataacggggtgcagtgtatcaaaataagacgatctagcatctgtgattgtaggtaactgacattagtgatttcacgatttctttaataagtacaaatataacatttatatggtctgagtgcttgaacacctttctataaataatagaaatgtccccattaaaatgttccacttagagaatccccgtgcattttgtcattttatttccatgaatgttccaaaaatggaaaacgagagaaaaacctattcgcttcttccaaacactacatgaatgctccctgtgatgcccttgaggtcagtgtttgtcagtgtagtgccacaaagatgtggagagctgttctgtcagtgacgctgctgccatctgaatttcccatcactcatttccaacctattgtccagatactgcaggcttcatgagaggatagatttataagctactttagtactttaaaatgcccaactaacttttttccccatttactttgaataaccctactataagaggttaacaaaatgtatcttatttttctcctattatatttctagaaactcattagggcagcaacaagagttggttgaaaactccttttaagttacatcttgggaatttacttgattattacttaatatacactgtgatgatagaaagcataccagcagtactttccttctttcctgacgtttacttgtttgttttcaaagcattaaaatatcagcatttttttcccctcatacattcagtagacatttgctctgtcatctgtttctttacaggctgtgagtataggaagagcctgggtagtgagattacactgttgaatcctggcttggccactagccaggtatatgactttgggcaaataatttaacctttgaaattgtcaattgaaattgaaagtgtcaattgtttcaacatgtaaataataattctttgccttgcataaattgtgagaaatcatcataatgattgagcatgagcactcagtagatggtcaggactgttatggtgcacatttaccaacaaaagatccatagcataaaaatgatcaagaacccataaactcatatttaaattatcttcaaagaaatcattacccaggaaaaatccaagagtaagttgttatatttactaatactgcgcattcctcaagggcaagggtggcctcatacccacacaattccaaggtacttattgcacacaagtaatgctaactgattgagtggcattaaccaattaggagaagtacctgtggatcccttctcatgatgatatttttaaatgtgtaaaataaaattcataggattaaaagaaagcaagttatattgaaatagcgttatcagtacatgaacattttcgtgatatatgtgcttctttatcaataagctgaataagatgcagctgtgtgtctaataattaccataatttcaaagtattgtatatttcaagatacctgaaataattgtaatatgatatgcaaatttttataatttctcatgggtgaaatcacagccactacaaatagctataacttgttgcctacattcacagttgtagaattggtaaattttggcaagaaataaatgaaaacgaagttatgattttttatttttattttttgcacccaagttcggtctcttcccactctcttagtctgttcagtctcaaatagctttcttaatgaagatataaacaacaacaacgacaaaaattaataaaagcgcttagcaacaccaagaaaataatccaaaaatgattaggccagaaggtttgtgctgtcttggcccttgaccaagacctctagttgatagatccttcaaggttacctctctcagcccccttctagaagattaaccatgtcttagaaattggtgctaagtagttccttcttatttgatgatgattttaaatgcatgtactattttgtctgaactagaatccaaactttccatgaaattaacatcattccctgttgaatctaggtgtcatagctctataaccttcaattagtttacaaacaatatatatgtctccttacctgtgaacaaggaatgcttaagaacacaataggcttggaatttgcaactaatttggcccaatcttgagtagatggccaaactaaaatcttgaagttattttgccccaacatagagcaacagaaaagactcaagcaagttccttagagattgtagctgcatagttctagatatctttaatatagaagggagtagccacacaaaaaatatcatgtttaaaaacataaccaacaacttgtattattgaacatattttaatttaaaaatgtatattttagaacagcaatatgaataaatgaaaacgtgtgtgaaaataattcattattactctgaataagcctacttttcctaattatccctaaaaagtttatttttctatttcctgattatctcttttaaaggttaatttattcttatagctttgattatcaaaattatactcagaactaagtaaacaacatcctagcaagggtcatcagtgtgtagagaaagattaatttgggctttcaaga

SEQ ID NO: 119937 - DNA, 1204 bp, Homo sapiens
tcctagaagcagaacctcttatcctgttttgacttggcccttgactgcttaaaatgtctgtagttggctttgtatggttataatcctagccccttaggctgggaattttggccatctgtggtctctatttctagccttagccctaaccaccccacttcctgctgctcctgtcaaatgcacttacttatacttttccgtatgtgtctcaagctttcctacaaagatgatgggtctttgctgaccctatttctttcgttcaggatgagctcaaaattaccacattagttttgaaacttgctctaatttctcctaccaggaggaatttcttccttcttggcaatactgtggtatttaatggtattttactgttttgcactttgtattatacttatttgtgttatgtcttgtcgcccctactagactgtaagatgattttatctgtataccattaagtgtctcatacatacagattctcagtaaaattttgctggtggaatggagtggagacccaggctttagatagtaactgggaacaacaagatcgaatttcttatctgttcgtacctaataagctcctctctcccctcgcccataggctttgcttacctgtcacagaacctaccctgccttttttcctacatgcggtattattgtcctgaactccttcaagtgttaagtaaatcagtaaatctttaaagccaaccttagcggccaggtgcagtggctcacgcctgtaatcccagcactttgaggggcggaggccggcggatcacttgagatcaggagttcaagaccagcctggccaacatggtgaaaccccgtgtctaccaaaaacataaaaaattagccgggtgtggtgatgcatgcctgtaatcccagctattcaggaggctgaggcgcttgaactcggggagtgggcggaggttgcagtgagctgagatcatgccactgcactccagcctgggtgacagagcaagactctgtctcataaataaataaatagctaaccatagcaactctatcagattttaaagaaatatcccccttcggcagggcatggtggctcacgcctgtaatcccagcactttgcgaggccaacgtgggcggatcacctgaggtcaggggttcaagaccagcctggccaacatggtgaaaccctctctatactaaaaatacaaaaattagtcaggcatggtggcgggcg

SEQ ID NO: 119938 - DNA, 1024 bp, Homo sapiens
taagagtctctagttagttttgaagtcttggtcttccctggtcaggaggagtagagtacacctgctggtttcagcactgctctcagatggttaaaaaaccactctcaatatataatatctcccgcctgttatgtaatagtcacttcaacagtttttatgttgtttaacttttcaatacaacctttttggattatcattatttccacttttatagatgaagaactagagattcaaagattcattcaggaagcaaatatgtgttgtatcctggggtcaggctgactgttgtctctgcctgctagtctggaatttaaaccttgttctcctttgtcacttgatattggcaatttctttcctgtccttgctggatttcctgcatttctcacttgtgctctcctctgacttttctgacctctttggttctaaaaattatccctgattcccacacttctggttcctattctgtgtggtgacccctgctgtttgctgcccacacctcggagtgatgctgagtgagggaatccaatctcccaaacaggaagcttaccaagttttgaaagcagagccttttcttgcagtcaattaaaggttcactctgactgtccatttttaaactatggtatgaattttgtctgtcattttcttgcccttgtcttcctgtgagaagactgtgttttatttatcaagatagtagttttaattctcttagaggttggggctttaataattgagtgatttaaaaactttttatgaacaaattctgtgtcttccatatcacacctagagaagcagtgagggacatattttactctttagaattatataagtaatttcctcatgcatcaatagaaagaaattagctacaggcttcggaatgcttagagtgggaatgcgagataatcgtaagtaagctctacatagctggtattactttttttattccatcaaagaaactacatttttttttgctttttttcgagatggaatctctctctgtttccaggctggagtgcagtggcacaat

SEQ ID NO: 119939 - DNA, 1107 bp, Homo sapiens
tgactggagtcagttagataatcatgattcattcaagttgctgcactgaatgcaggttacagcctagtgccatgaggtgttcgctggccttttgcttgcctcaaagcaaaagaacaatagcactcaacatgcttggtcccccactgtataactgaatggttcaatttatatctcatgcctgtagcaactgcttttcaataatcacaataaagagtaagggatatatgtgtagagatatatggctggattattcaggtggggagggcctgactatgggggaaggataatgtgaatttcaaagtgtaaatatgtcattgcataattttttgttctgggcatagttacatttatttatattgtttctaaggctttctatctgatagtatgtagaatatgcagtggttacatacttctgtagtcaaatgaagcaactattctactatttgctaaatctgtgtgccttgagataataaatttagcatctccatcctcaattgcctattctgcaaaatgaggataataacagaactaacttcatagagttgtgataaggataaaaatgaagaaatgtatgcagagagctaagcacagtcttgggcatggagtaagtgcacaagaactcacgatactgatgatgatgatgatgatcatgagtaattgtatagtagtatgtgaacaaaaagattgagttgtttcttactagagcaggaattaacattattttatgttaataatgcagtccttgtcgaagcattcaaatggtgtgattataaatggaattataaatacatagaaaagaaatatgtttcatatttttgacatgtaattgtgtgctgagtacattttaatcaaagacagaatgaaattgctgtcaaggatattggtagttcattagcttattgactgcacactaagtatctaaagtgttattttggtgacagcctgatgcattaatttctaggtcagcatattattgacctcaactatttaattctttaaaaaattaccttaactattttttggtcagatattgttttataaaatcagtatatattcaatgaaaattattttctccttaccataccattcagatggtcttcctaaatt

SEQ ID NO: 119940 - DNA, 1926 bp, Homo sapiens
aatgaggtgttattttcagggcataatttgtcttgttcttgctgcagtggatcttgtgaacagaatgatgctgctttttaaaaccacttactggtaaaataatatttacctggtacaatgctaagcaatttctatgtcattaattttgtttttattctctggttgggtgtggtggctcacgcctgtaatcccataactttgggagcccgaggcaggcagatcaccgaggtaaggagttcgagaccagcctggccaacatggtgaaaaaccatttctactgaaaaatacaaaattagctgggcatggtggcccatgcctataatcccagctacttgggagactgaggcaggagaatcacttgaacccaggaggcagaggttgcagtgagtcaagatcatgccactgtactccaacctgggcgacagagcgaaactccgtctcaaaaaaacatttaaaaaatttttattctcataactctgtgaagttgctactattatcctcattttactgatgaggaaactaaggcaaagaggatctaagcgatctgaccaaggtgacataaatgtttacttttatgaccatgctgtgtctgcttcaagcattgataaaatgctcaatgattagagatgctagcaccctctgttcttactattgtagggaaccattacaattctgcttcaccttctcagtattctagtcttcaactttttacccgtaataacttttattgagagagtttaaaattaaatagcctgtctcctttcgatttatactatatagaatttggcacatagatgctaccttagacattgtgtgtttggctcaatccttattaaaaaaaagggggcaaaaaacataaaattattctaaagctaatttctgaggccaatctgtaaagtgatggagtgaaaaccattttttgatggctcctaccatttaaaagatagtcttccaactgctgtagtgaaatatgtcagtgctaatgattctgctgctttagtaagctgtgagaagcacaaggcttctctcctgatcagtactgtcacatggccgtgttctgatgcagtatgcaaataacagcaccagcatcgtaagtagatattgctagtggcacatcatatatgggctacttgagagaaaaaggctgctgttaaacttaatgatgaggctgagtgtcattaactgtgtgcttattcaaagagtttccccctgaaacatctgttcccctgtcagatatgtcacttttaagcaacacctgtgcagtagtcatttccaagtttcttttcatgcaatcaccttgttttttgctaatggacttcttggtaaaggaggaaaatgcaaactttctttttcaacatcttactgtagtatccctgcctaagtaatgtgctgtagaagttaaaaaaatgaataacatttcttaagggaatgttttataaacacatggtagaatattttatcattggtgtaaatttgtgtcctgagagttaaatactaaaatgaaaaatcattatcctttagttattgcataatttgtaatagtttcagtagcagtcatatactgaaaatcaatgagacgtgtcgtctttcatattcatgacaaggtaatgtccattggagctcatgtattattatatgaacattggagttttctttgaagtctagcgatgattgtctcactggtgcttgctctgtgtgggtgagagagagagaggccaggagaggacaggagaacgggcatgtgtccgagagacagataaacatattaagtagccctttcggtgatgtacatatatgaagatagtatttctgcgactgttgcctccatttgcagagtctgtttttttcctcttggatttttatttaatatttttattcaactataacatatatacaagaaaatgaacaaatcttcagtgtatagtt

SEQ ID NO: 119941 - DNA, 1033 bp, Homo sapiens
gatgttagtctttgaaatactctctcctttaatcttcccaagcatcattatttggagatgtgttcttgaataaagtgctgctggaattggtaagcacatgttcattactttactcagccttagttcctttgagactttataattgaatattagtaatacatatcattttagaagtgttcagcgatctcgatgttcccttttttagctttgctgctttcacagtgctccttatatatttaccgaagaaggtgagatgattttctgctcctatatgctttagtttgatttctcaatcatgattgcattttctatatacttgaacacagtgcctgaggagaaaattctggtaacaaagatgctgcttctaaatagaaaatgagttttattcagaagtgcttataaccctccctctggaacaaatgaaactgaagcccatgtgcatttgtatcacggagcagagttgggcttgctttgttttttcataataaacataagtccttctgggattagaaattatagtctgaaaagtgactatgcagaagaggattctgggaagatggcagagtagaaagcaccaggaatctgtctccccaactagacaacaaatgcactgacagaacctgtttgatgtaactgttttggaactctgaatctactaaaggtgtacaatttccagtggaaggctaggatggtgaattgtggttatgtttggtccttagcatggtagcagctacacacccctatccctcagccttggggtaggcagccatacacttggtctaagagaagcttgcaggcagcttgcacaatgtagggtgcacaataaggatccagatattggagatgtgggtgctgattgctgcttttgatcaagagctgcaaacaaagtggtgggcaaccattgtttttgtgccctccctgcattgttgcaagcccctcctcctttaactgatgtgagtttcagggaatttaaaggtctagtccagggctgggcatggtggctcatacctataaccccaacactttgggaggc

SEQ ID NO: 119942 - DNA, 1025 bp, Homo sapiens
atttttgcttctaccgcatagaacataataacagttttctatagctgcacatagcctcccctaagaagctctgtagtaaacatttgaaattttcctgcctttttaacgtgtagattttttcatagctctggtgtcactttgacaaaatttgaatatcagttgtatcactaaggtattgctcacctctaaactcacgtaatatgcctgaacatatttttttacttagtttactatggtgggtataagattgaatatatggtagtttgtttttactccctcttatagaatttactttctgaaatactagcagactttaaaataagatgttcttatatcgtatttactgattctccattaaactcttaatccttagctatccaatatgtacatatctaaaagaaatatataaatttattgtaaattggtttatatgttaaaatcacagattatttatataatggcaaaaaaaaaaaggaagaaagaaaacaaaaagaaatgttgaaagcagatatccctgcctatttcccagtcttaggagatgtatcagtcagagatcttcagagcaacagaaccattgaaccacagttgtttacacacacacacccccacacacacagattttaagaaattgaggaactggctctcacgactgtgggaaccagcaagtctgcaggcttgggcaggctggaaatttcaccaggagtcattgttgcagtcttgagtttgaaggcagaattccttcctcttctctgaactttagtcttttatcttagatccttcagctgattgaaagaggcccacccacattttgggggataatctgctttactcaaactctacagatttagatgttaataacatacaaaaaatttttatgacatctggtctggtgtttgaccaaacaactgggtgccatagtctagccagcttggattaaccacttaaaaattaattatcccaggtaccgtgtgacccagcagtcttactcctggatatttacactagagaaatgaaaacttttgttc

SEQ ID NO: 119943 - DNA, 1054 bp, Homo sapiens
agatcaattctcagttagcactgtgaagcatctcttttggtctgactgtgttttgggtgagggcaaaggacagggtctgagctcaaaagttgaataatgtcatttctagaacgagacctgaaaatgtacgcctacaagtaagaagtgcagactgagttaaaaataaaggttttatgagaaataggagcccaccataggaaaaagtaactccaagatgagacgaggatagggatcaaagtcagtgaagtgaatagaataatcagactcatgcttgactgacaagttgaaatccgtgtgatttttgtcttggcattagaaaattttatattgcaatactattctttgattcccacttccctttgtcatatttccaagattgtaaatcttaaaatagtttcaaagaatcagattctttgttcactgtatacagaattaactaaatcaaaatcatgtttattgtttttaggattatatactgccatccacaattctatttagttagtattaaaataataatgctaattttctaattgtttgtgggctgtatgcccaagaaagcatttacaatgaaaaaaattcttccgggagctgtgaacctaagaaatcattattcaaatactcttagtttagtagactgattggcatattgaaacattcacttaccctttatatagagagatactggcccagtcattttggaatatggcagtcaggaagcagtgttaccttaacaatatggccctaactgctaaatgtgcatgtctttcttgagattcagatggttctgatggttaaagcccctctcctagatatgtaactgaaagttttctctttagatttttatattagataaaaaaagcttccatttatcaagggtcaactgggtgcagtcattgtttggatgctttacataatttatctttgagccgtacacaccccagccagccaggttgttacacctgtctttaaaaaaaataataaactggcaaggcacggtggctcatgcctgtaatctcagcactttgggaggccgaggtgggcggatcacgaggtc

SEQ ID NO: 119944 - DNA, 2186 bp, Homo sapiens
taaacagcgcctttcttatattaaatatttatggcagtctttgggaagaatacattaaaatagcagatgggggtcgttttaaacatttccttgattgaaggcaggggacccccttgtgaatttatagtctgctttcaaagaaagttcacaatgtctgataacccaaggaggcaagaattccaccaattcccagcactgtgatttcaaaaagcaatggctgcaaacagtcttcatgcttcagcacctcctattttgaaactgttagcaagagcagtgaagaacggtgaacaaaaccgtttacagttgtattgcctattaataatgcaataggagtacacctcttttgcattaatattactttttaatcgatttttaaccatagtagcaaaaataagtggaaagtcaaacctttgacctgcggtggacaggaagatgtatcctagactctggaattctgattctggaatttaaaagatgtttggggaattatgtcctaggaaacgttttctaaaacaggaatgtgcttttttgctttatattttctatttgccttggtaactaagaagtctgaatccaggaataatgtttttttttcccccaaagtagtctcttctcctggtttaagcttataaacactatacatctttaattatattattttctttagtagttatcttgacctttaggagtgttactgaatataaaaattattctatcagtttttattaaaatcttagattattagactgtataatttgacttcattatcatttgataattgagatgtttcttaaacagtcttactctgttttttctaagcaaacagcttgcatttgatgcaaaagggaaatgttttgtctctgaaaaatcttatgtagctttaaccaactatttcattaatgtttggtgagagctctgatagtttcaggccagggaaactatgactcttgtagtacttaagacacttgccaatcaatagtaaccatcctcagctgatggagtgatcgttttacaatcacatagaatgtaaaggtatcatggaagggggaaggtgccacgggcaggctggtaatatcagagtctctttaaacttatattttgcaagtaattgttcaatagttcttcatgggatgtgaagaaactagttttctagtggtaaaaattgtatacctttgtttttaaaaatgttttattatgtgcagtgattgtaatatcacatttaaacatagcccaggagtttttcacagatgtgctctcaaggatctgtgaatcacctgaaatatcaaacccatgttgtatgtagcttgtttttggaagggtatccttagcttccatcagtatcaaaggggatctctaatcccaaaaccttaagctgatctgatctaagatctttattttctagatgaagaatctgagatctgacaaaatcaagtgactaatttaaagtaagacagtattgaaagaactacaattaaaatcgtttattctactggagattgtccatgaggtttacaatattcttttttttttttttttttttcatttttgttagagacaggatcttgctatgttgcccaggctggccttgaactcctagcctcaaaccatcctcccaccttagcctcctgagctgctgggattatagacatgagccactgtgtccagttctccagtattcttttataagttagatgttaatactgtagaattgaaaaaaattatgaacctttttcatacacaaatctattcaactcaaaatacttacgaagtcgagtcctggattcataatatctcagcatattgttttgagttccatctgagcttgaggatgatatctataaagccagccaatattaattacatcttcaagtgaaagtacattacccgcctccctgcagttttaaccctatacagtggaagtgtagcctttccttcttccaggaattgttagcataaatcctgacagttccagacagtatggaaggatcccagtagatagggaaaagatccccactcgaaggtccaagcctagtgggatacctttcctgggcacatggtgccaagagatgacttaaatatctacaaccacttgtcagctcagtttttttggggactactccaggtcttccctggggaagggacacatattcttcctggtaataaagattaaccttgggggcaaggat

SEQ ID NO: 119945 - DNA, 1040 bp, Homo sapiens
gaaaccgcgtctctactaaaaatacaaaaaattagccaggcgtggtggtgggcgcctgtagtcccagctactcgggaggctgaggcagaatgctgtgaacccgggaggtggagcttgcagtgagccaagaatgcgccactgcactctagcctgggcgacagacggagcaagactccatctcaaaaagaaaaaaaaaaaaaagcacatcttagttcaaaccaactgcatttcaagtgctcatcagccacatatggcttgtggtttattggatagtacaggttttattactcttaatgcatctcatgttatttacacattgttttggttttcttcaatcatttcttatttctaatgctactaaagctggcttttgagatttttggttggtactactcatatcataattatagtcagcattttataggtcttctccttgagtcactaaattggcattaaaaacaattatgttggagttccttcttggaaattaagagattaattctaatccatgctgtgctgctgcttattgtatcactttgggcaagtctgttaacctttctgtcacagtctctatttataaaatgaagtggataaagagttttggcatttcaaactggataattcttattttaaaaaattgtctgtgtttgttattcaaatacattgattgattacactcatatgcattgtgttacccatagtgccaaaaaaggtttatctactaggatctatttttagtgaacgatggtgataagccatgaagagggagagaagtatccttaactgactttcaagcacagaattattaaaatcttacattatatctgggtacaaattggagagccctgaattggcactttggggcaaagaaaaggtgagatcattgaagttgttggtttattgttttcgtcagtgctagcaactaagtatgttttacctttttgtgaaaagttgaattattggcgataaggaattatcactttttttccatgaggtagttatttcaaaatgacattctgcttttccccttcggcaagagg

SEQ ID NO: 119946 - DNA, 1055 bp, Homo sapiens
tccactttttaaatagaaaaagatttattccgtgtacagagaatatttataaaattgtacacctctaaaaatagcctatggacatgccagactatttctttggaggataaagctttttattaaatgattaagattaagcaaaggtttattatttctggaagtaggtatttaatttaaactatgaaaacccatatatccataatactactaattttcagatgctaaaaatatcttcagcttttaaaatgtattgagctttttattttttaaaaagctttttaagtgctcttttttctatgtattctgttctcaatgctaagttattgattctttaatttgggaaaactaaaatcttatttctatccttgtattttccatgttgtgtgggtgtgggtgaggatgtgtatgtctcagaaagatagacaggcaggaaaaagtgaaaatgttttcatatggtttagttttttgctgaagtaattatatttcttatgctaaaggaaagaatagtgattggaaatctttttgctgtgtttttttctacctcatggaacatattaagaggagcgaagatctttattttatgcttttttattctgtgagttttaagtccacgttcacataaaagccatgtgttttatttgttgtctctcttggctaggaatatttaaatgtatttttgaaactcttctgttctgtcaactaaaggtaatttaaaattataattttaagacactttctagaaacttatactttggttcaggctaaagtcttcagtttgtgtgcctgtgtgtgtgtgttgaggttcttcagaagcaacaaaccacttgagcgtgagcaaatttcacaggctcccttcattgtttgttttagcctcgttaatcatttggcctttgaaaataggctgatcatttcattgaatatggattgagaaaagttctgtgtgccatgaaaggcctgaatggctcttgctgactctgttttattcattttaaataacatgagggggatcccaaagtatttcctctggacttttgaagcattatcattgcagggta

SEQ ID NO: 119947 - DNA, 1046 bp, Homo sapiens
agaaagtgggaggtgagattaggataggccaaacacaccacatagctccatgttcttaccaagatttatttgttttttaatgaacaccacccagattgctgcaaacctttagttaatttccagagttctgaaaaagttgactgacaatttttgtcagtgttctcattgtttttatgaaggagaggattttcagtctttactccaccattcctgctgaggtcaataaaaatttatgcctgaaaaggggctgccttgtatctatcagaccatcaatatgtgaagttgaatcacttttcttgcttaatttttgtgctgcatgtcaaaggtgcatcaatcacttatggtgctgtcttcctcataaagcttttgaggaagaactcatgtcattagcaggttattgacagcaaatgatcactattaattgagtcaccatcacagaaagcatggagacttacagactaaaatgtatacttctttagatacttctggctttggataccacacaagaaataatatggcatagatagactgaatcttgcctatgatggttaattgcttctttctgttttttgttttgttttgttttgttttttgagaccaagtctcgctctgtcacccaggctgagtgcaatggcatgatctcagctcactgcaacctctgcctcccagattcaaatgtttctcctgcctcagcctcccgagtagctgggactacaggcacgtgccaccacacccggctaatttttgcatttttagtagagacggggtttcactttgttggccaggctggtctctaactcctgacctcgtgatctgcctgccttggcctcccaaagtgctgggattacaggcatgagcccaccatgcacggcctctctccctgttaaaaactgatacttttattaagaaccaaatcaaatattatgttgttatttctattctgatagataattgagttccacaattactgtctttcatgatgtcaaagctgctgttggtctagattcactaaagaagctttgttttcttgatagatgatgtcccct

SEQ ID NO: 119948 - DNA, 1004 bp, Homo sapiens
tgtaatcccagctactggggaggctgaggcaggagaatcacttgaactcgggaggcaaaagttgcagtaagctgagatcgtgccactgcactccagcctgggtgacagagtgagactccatctcaaaaataaaaaaagaaagaaaaaagaaataaatgaaatattttaaatagttcttatgtttgacctaccttccgctataaaaactagtatagctttatgccaaatagattagtgctcattttggaaacaccaaagtttcagggctttctttagagccactagcctggataactgatccagcacaaaattgtcttgtccagcctttattaaaattcaacacagtattttcactcttggaggggcctaacactatcatgttgccctgatttgtgcctaacgctcattcataaaatgatcctgacttaaagtggtatgtttggtgctttctttttctgtttgctttttaaatcctttctaaatggcggcccatttcatttacatctctcatttcccctgaagtctttgaagccttttttgtaatgtgcctttaacaaataagtctctcttttttctccagcagtgtgaggcttctcaaatatttgtgttatgagttatggacaaggcatttcctgatctgtttccttaaaaaatccattttttaagacaacctatagcatttaagattgaaatccaaactgtgggagtttacctgaagctgcaagctttcaaactgctaattttgtggtattggtagagccatgaaagtggaagtgaaatctttttaattaattttctttgcagttgaaaatggcccatgttttagctggtagcaatgtaagtttacatatgagccaactaagctggttcattattctcttcagttgtttgaaagttggcagccatcatcacaacagcagctggatacaagataacctagcagtgttggcacatgttgaggcatatgggaatttattaaatcatgcaacctttgcaaagaagag

SEQ ID NO: 119949 - DNA, 1029 bp, Homo sapiens
gaaagaaagcttcattccaaacttctctgacagcttgctaattcatctgcttgcttcttgttggtttatattatcgacatggtacaaccttataggaaaaaaagaatacaatgcatgttaaattttaactacttaaattgttctctaaattcacaactgaacacctcttaatttgtattccatttctcccatcattgttttgaatgaacatttctatgattcagtctggtccatataatttatcattttttagaggttacataacattttattgacattcttttttttgcttactcatttctcgttgttaaacatttggattgttttcagtttctaactatcatgcaaggagtgtggttattagttctttttcctttatttgaggtggagatcatagaagcaagttaaaattaaataaatatatgtaatattgttgctgctaatatattaacattagataatacaaacctggtagagtctggttgtatttttctgttctgtatgttcactgtaagatattttgtatatctttatatattcaaaatattctgtaattttactcattttgtggaattcttctgaaacaggctgtgaaaacatttgatttggagtcaagaaataagtttcttgttgctgtcaattgggaaaacggattttatctctttagcttcactttgagtctcatcttttgaatgagaagactagattaaagaaactctgaggttcacctttgctctaaaatttcatcattttagtaacttgctacatagttttacaattttaaataattatacaggtttattattgcatttttgcttttatgatgttttcgtggctttatctgtaatttaatactgagtcacattcaggagggcaataatcagtgtttttattattatgaaaaaaggcagacttttatgatacattttccaggaattcattgtagagtgtaatggagactgcttgtgtatgaaaccagacacaactgcagtcttaactatgatgttatcagagaaaattgtttccctt

SEQ ID NO: 119950 - DNA, 1045 bp, Homo sapiens
caaaggagggactgtgaatgaattaagatgctgagagaaaatcaagaaaaatttcatcagagaggtggcccagggaatatcagtagtatggataggggattgtacagtaggattgctcagagaggaagtattctgatttcaatgagtagtttggataggggattgtacaatgggattgttcagagagaaagtattctgatttgaatcatatcaatcggaattgggtgataatggaaaggttgattagggctacattttggagagcattgtatgtacccactggccctcaactcaccctggagtgttcctgggagttcttatcaaaaattagagtcgtggacctggttggttagaatctcagcagatgataaataactttggctttgcagaccatgcagtttctgttgcaactgtcacaactacattcaactctgcttttgtagtgaaagcagccataaacagtatgaaatgaatgagtgtagctgtgttccaataaaactttatttacaaaatcagacaacagctggatttggcacatgggttgtagtttgccaacctctgacctgatcggggtaaactgaatgcagggaaaactgaatttaaaacaataaaacacaataagaaaatgttctcaactcataagaaataaagtaattataaatctgggttttgatttaaatgattttataatttctagtccataaatatagcttccggtttctttctcacttgcttgctctgtgtatgtgtgtgtatatatatatttttttccaatttgtatatatccctattcagtattatttatgatgatgctataccaattgcactttaggatgacataaaacttgaaatgtaatgtttctgagtgctattttttggtaacacttccattaaaagtaataatttgcctaatttcttaataatggactggatattagaggcaactgcattttgactgtataattttataaattattcttcccgagacctgatgtttagttaccttccagttatgttttcccattaaagaatgccatgatctggg

SEQ ID NO: 119951 - DNA, 1078 bp, Homo sapiens
agaaacagatcaggattttcaagaaacagtgaaacttgttgaagagtacaaattcccaagcctgtttattaaccaattttacccaagaccaggaactcctgctgcaaaaatggaacaagttccagcacaagtggtaagatctttttcttgtaaggtattgttttttgccagtagctatagaaatgcagctgtgttgcctaccttcacacaacttgctcatgttataacccttaaattacaaaatatggagagatttccaagttggggtcaggggccagggggccgtggatgagttaaatgaccttaggcaactaaaatataatcacctttttcttcttttgaacagtaaaattcagatgacttggggaaaaaaatttttaattagtatctagtatttacctgtgtgtagaagataaacttttggatgtttcaaaataaggcaatatttaaatatttgtgtataaatgaggcttcatttttaccccactttttaagagactcttttcatagtttgttattgattgggatccccctagttttgctgcttttctattggatagatttgatactatctttctacctttttttttttttcagttttttcacaacgagcctcaatttaattttatcctttcatgttcacagatacagtagaattagatgactcataatgaatgtgaataagtttggaatcaagtaaaggcaaaatgtttcccagaatgccccagaaattaagggtctcaaaacaaatatctactttctagattcattggctgaatacgggcaaatgtaaaataagcctgaagagcaagtagaaatttaagtgaaaattttctactttgtttctaataactattaggttggtgcaaaagtaattgcggtttttgcctttaattaccgcaattacttttgcactaacctaaattttaaaaaattatgccctgtcattaatttgcctcaaatgtttttatgaataaatatgcaaagaaataatccagagcttgttactgtttttctgttatagcgtaagtgaatatcaaacacaacatatatattctttcaatatttggttgaaaaa

SEQ ID NO: 119952 - DNA, 1750 bp, Homo sapiens
ctgttgatagcaaggctcgacaggttttgtagagtagttctcttaacattgcctacataggagaaactggctcactagtaataatggccgtgttttagttacttgtataagaaacttacttggctttagtgctagaacttagtaaaggatttcttctcagagcttctgtcatcagcagttacagtgtgaatacagacggctctgaaagccccatatctatttcagcatgctctagaaagccacttggaatattttttgcctgtacatagaagcactgaggaaatatcctgaaaacaagacagctaattgttattatgcttggtacgttcatcccaatgtttcagtatataggttatgattggctcttggaactgtccattgagcaaatagaaggagccaggaattttgcaggatagttagttgttcatgtggtttggagttaagggactactgccggaagtagacatagtcagggatagagtttctagatcggggtggttacctttctctataaagggccagatagtaaatactttaggatttgtggctgtatttcagtaaaactttatttaaaaaaaaaaaacaacaggcagtgggtcagattggctatggggccatagtttgccaacccctgttctggattccagaagatactccactggattgtgtgactgatctcagagggaagaatagcagtggttttcagttaactgggcagatacctataaccttcaatatgccaagacttcacagtatttgtatataataaatttgttgtcagaaaaggcattgtttctttactggttctttggggctaatatgaatagtgttacttagttatactccatttctttcccaaaatcgagataattaggataaaaagcacatataagtgttagctatcaaagtaaaatcaaaacctacattaagtcacacaaaacaacttctgaatattccttttccacctgccaatgcaagctggtcgctcagccatttctgataagcctcagttcttggggcatctcctaagtttaatactgatatgctacctattttattttatctagcataatttcctttctaaaaatattttccccagtgttttatatcaagactcctaacaaaggaagtgttagcatccgtcatttttcttctgattgaagtataagccaagaactgtttcaccgaataagtgggtatatgggaagaaaagaaaaaattataagctaatgaaattttgatgggcaaatgacctgttcaaagcagattccaaggctcacagagctaacatttcattagccacaggaactgtttccaatcatcttactgatacatctttgctctccaggggaagggagtgttaaattactttagaatttgatggtcagaagcactgctcagaggcggagagaggaggcaggaattttggctgatctgtaggagaggacttttcagtgggtgtcagaaggtagcaacaaggccaagtgatttgaaccactgccactggaattgtgacttcaaagacagctctgaaatagggaaactgatctacaaggaaacgatgagtgtgtacaaatgattttatttacaaggtccttattaatatcaggtccaactgcttaactaaggagatgcagaagattatgtagagctaggcgggggtatgcggcattggggaggtatgatagctgtgtccttgaggacactggaggaggtagaagatacttccctagaacacgggataccagtc

SEQ ID NO: 119953 - DNA, 1857 bp, Homo sapiens
atagaaagatacaaaaagtaaaataaactatggtctgctcctgggagtgaatgttgtgacggtttgcctctctagctatattcattttaatgttcattttccccttgacgtaagtttatgccaaaaaaagaatagtcagcattttagtggattcatcatgctgagtaaactcagaaatgcaactcctattctaaacttggcaaaatttccttcgggtttcatcccaaattatagtgggtcacttaaatgacagctttgcctactagaaactgttaaaacagttgtaattacaaagggtagttagtgcaaccattttgttctcagtgagtcagttgtatttgctcttctttccttcccccaaccaagattgctcctgcctgaccccagacacaggaaagtcaccaggttaaacaaacgtgttgtttgagtgagcccaggtgcatttcttaatcataccccaaagccattgtttaggttgtaaatggtcagttggttttctcttaaatgctgttgcaaaaagcaaataaagctaggagcaaaatgtgtacccagaataaggcttagaaaatactttatttcttgcactaagaaatgttgcttgagactagaagaatttcatttttgtttgttgcctctggttgcatgtccatttcttaaattgttttcaggaattcttataataaataaagactcatacaaaagggcttgacaaaagttaactcccatttatctgtccttctaaaagagaacattagtaaaggtaatccaaagtagcagataatctggttatattttatgcattatgttgtttcctttgtcattttaataaacaggtaatgaacataacttgtattatagtttctgaaacaccatactaagtaccaaggagggttacagggccagagagcttccaggtcacaaaaagtccaacctggagttgatttttttttttcttttgataaatcacgggtaagttagagtaggctataattagaacacttttattaaaaccatgcaaattagcatgtgctgtttgtccttggcctgaagaagacatttctctgcacataaaaatgttttcctgtttctttctctgttttttgttagattttatcagaattatgtgtttagggggaaatctaggtttattagccaaacacacatgtttataatctgctattgtgaaaagttattctaaaaaattgaaatgcttggaaggaaaaagttctatttacatctacagtggtttttaacatctgcaaacacagttaatctgcatgaattagtgcacactccaccactaaaagtgagtctttaacaggtagtcactatttttctgtattttgtgaagtgggcttcttgctttcttttagtggcttgttatattagtaatttttctgcatatacatgtcagtggacacacttgagaagaaacattgtcatctagctcctgtgttggtgaactgggcttttctttttcttttgataactatcattatttaattacttttctacatatatatgcatgtatcaactgaactagaagcaaattcatatatgtcattaaacatgtatgtatttatgcacttgataagttagcctatgagtagaaagaaaactaacattagtgctttactcaaccagagcatcttttgtgcagcaatcccacctttttaaaacagctcagaacctctaaaaaagcctatttgggcccagattgttaaaattattgtgtaattctcctcacccacctcattacttcttcggtccctcatccacaaacagttcaatctttttttaaaacaaatcagttcaaactgatgcctggtttcccaaaacacagtcaacactaatagc

SEQ ID NO: 119954 - DNA, 1782 bp, Homo sapiens
gtgaaaactcagtactaggttcaatccaaggttcatccattctcccttgtaagagtcttacactatagagctggaaaggcccttagagctcatggagtcccaccgccctcctccatccctcctctgttgttcagggaagagaggcttttttgtcctgttgatttaatactcatccttcaagacccagtttaatttcaccttctttgcctcttttctgatagacacagaggattgctctcacctcttgctaccactctgacttgtatatacctttattatttgacattgtgtgctcatataattcacttccatttaacaaacatttgaggtttttcctaggaggcaggcagaataactagagtaagatgcttacaatccattggggcaggggccccgtctccccgaagaccttgaattatggactagaattgaatgtgttatatatatgaagtgtattttaccattctttgaatctggatactataactgtacaaggcacttacccatcatcccacagcaaattcagggctaaaatccagtcttttaattcccagttttgtgctctgtctttgcaaaaattaatacagttggaatgttccagtagtaataaccacagctgtgggagaatgtcctaagtaagtttatgcttggttttaattataaattaagtaatacatgcacttaataccctattcaaggaaattctccctttgtaaccttatcctagagacccctgttttcttctccagaggcaaccactgttgctggttttgtatatatgcttctggagttattttatgcatacacaaatacataccttcatgtaaatgtcagtatgtgtttttatatagatatgtgctttttaaaaatttaaatattatcatactagaaagtcttctgtttcttttttcactttacagtatatcttggagataatttcaaacagtacctaaagagctgcctcattcttttttaaaaaaatagctgtatatattatataccagttattcaccatatttatttaactagactcttactggtggatctttgagtggcatctgatgtttttggtcttacaaacagtgctgtgcagtgtataatctcacaaacatgtcatcttatcaatgtataactgtcacctgtaggataaattcctagaagtgaatatctagatattagatgtgtacatattaaatcatgatagatattggccgagacccactcagcaagatgttccagtgtacatgcccatcaacaatgtaagacagcgcttgtttccccacacccctgctatacaccatgtcaactaacttttaaaatctttccctattagggaaacaaagataacttcttatagttttaatttatatttctcttatgaatggtgtcactcagttattagaaatagccacaaaaacagagtgatttggtctttgattttaaacttttaaaatccacgttttagaatttctgactcttccacttgcaagctagatgatgtcggcaagatacttaagttttctttgccttggttttctcctctgtaaaatgagaatactgcgttccatagactctaagccattattaagtcttattaattgtaagactcaccattaattcacataacgctaaggaaaaaatgcccattacaatggtgtcttaaattgagaaatgctaaaatataaaataatgtgcatcttagaatcgatgaaatttgctaatacttgccttagaagtttgtcatagggattaaatgggaagcatctagaatagcatctagca

SEQ ID NO: 119955 - DNA, 1093 bp, Homo sapiens
actgtgcaacactggtaatttatttagcttctctgaggctcagcttttttgtctctaaaatgggaataaaaacaatagtacctccccaatggggttattataaggattaaacaagagaatgtatgttgaagagattggcacagtgctctgaatgtagtaagcacttaataaatgttagttgttaaataataattataaattctatccataagtatttattactgtaactagatatctggaaaaaaacatattagcagtgagataattttattgtgattaaagaaagcatgtgattgaatactgaaaaatatgaccagggtccttcaactagataaaaaagaaacctaaccagctggaaatctaaaggagaaaaatgaaaatattgttctggttctctctgagccaattaaaattttctgttgtttttaaaacaagtccattttggactagaactgaaagtctccaacctactgtgagtagaaaaaaagcctatggtaagaaggctcaaaaagctaactgacatatgtgaacccagggtagacctcataatttacaatttcccaacagttcctgcaccttagaattttgcttcgatgtgtgtagactcagcagcatgttgtaggcacgttgatgtgttccagccatccacttatataaacactattgtcttataggagactatacattctgactgcagtttaccaaaaaaaaaaaaaaaaaaaaaaaggaaaaaatggagtaattgtactaactctagatataatacaaaataaaaatacctagagtatttcacacatactaatgcattgatggtagatagctttttaagtttgtcccttaaataatcaaagtaatagaatatttggaattattaaatgttagcactgaaaggagtcaggaatttataaggatcagcttaatacagtcccttttttttctactttttttaaaaatttaggtatggaaacgaaggcccacatgcaattggctagttaataataaaatgaaaccttgaaattatatttgctgactcctagtctgatatgtctttcacctcaccacagggtgtttgttttttgttgttgttggtttt

SEQ ID NO: 119956 - DNA, 1002 bp, Homo sapiens
tctgatagatttagttgtagatataaatatattttttaatcatgtcttctggtttaaatatagacactgaatttcagaaatcccagtttatgataagtactgcctttcagggtgtttgtctccattacatctagttctaaaaagatatgtagttctgtatcagtttaatttcagttttcttgttaggccattttggcgatcattccccacatattgtgatgacaactacttttatatcatgtggtgtggtcggtattgttatgtatataacagaaaagtcaccatagacaagtcaaaagcaatttgatgcaaactacccattatccaagttttggtagcagtgaaacagacatgtttcatgagagaggattactgagaagacagctgtcatttaacattcctaacactagaaaaaaaccataaagctagatggctactctaaaatgttattgatcagttcagagcattcagttaattatgttaagttttcatcgatttgaagtagtttcaggggagatctctgcattagtgaaatgtttttattttaaaaatatttttttaaaggaatatagtttacttctttcaaataatcccacaaatttagtattccaaagagaccactttgtgattctttaaattaataaataagaaatattttctaaggcatcagtaagactttaaaatgaaaacatcattgtttaaccataggaaaaaaatttaacctatctggtagttaaagcaatacaaatttaaattccaatcaagtgttattttcacctataaaattactaaaaatttttgatttgagaatacagagagttggataagcatataaattttagaaagaggctaatagttcatatcgtttagctcagcaaatcagcttctggaaatctattttgaggaaataatcttagagacagaaagatctctttgcacaaaaatgttcactgcattattatcaataatagaagaaaaagcttgaatatccatcattaagga

SEQ ID NO: 119957 - DNA, 1039 bp, Homo sapiens
taacactaaagcatttggggttatttataataaagcctgtgcaaaagaaacaagatgccaattcacgtgtcaggcagacagtggcagctgctttgttactatgtggcactgtcccatcctaaatcaaatgggaaatgggtactgtttgacagatactgtcatcagtacaaacattattaaaataattaaacagcttcttcttcttttttttaatcttagggacaggctgttggtttgttcgggctttcccagccctggtgctcaggactccatgcatattcctacaccagatttttgatccagccaagcctgagctatgatttttttatcccagtgggacagtgtagctatgttcttggcgttttctgcctattaccagttagggtctgtgaacagaatctccatttgtgagaacctcattgtggatagcacgcagtggtcttttcattttgattgatggttctggttctgcaccatctggcttctgataggctgcattaatcatatcctgaactaagaaagtgtagacatgtctgcttaatatgtacccatacataatgtagcattagttattcattcatcttgcaaaacagtcataatgtatgcaaggtctttatatagtaaaacataaatattaatatgcgacccattaatgctgtttttacttgtactaacctcccactagtacatttgtttatgaagattgaagaattaagagaaagaaggccatgtgcacatttacatgaacacatatagttttgctgatgtctcctataaatttagagtgatgtatgtctgaaatacttatttgctcatatttactttatatatatgtatctttaattgcctcttgaaatacaggttaaatgcaagctgcaatacagattaatttttctcatgtgaactgcttgcatcaaatgtaggtcatccatttgccggggtcgtgggggcgtatgtggccgtgctcttttgtgctgcctctggctgggcccactctgtcccctgctgtgtgataatgtcgagaaaaaaaagaggggcc

SEQ ID NO: 119958 - DNA, 1049 bp, Homo sapiens
atcaagccagtctggcaggagactgggacaccatagaatctggggtgcccagtttttacccaaacagtagagtttatggtaacataactaaggctagcacctacctcctggtggactggtggccaccaatgtaccctccattctgatgatgatgagctcaagaactaaatgagactggctggattcataggataaggaccctcattggcagcaactcagcaggttatgggaggcagtggccaacatgcctaggataagaggagcatagtgccaggtattatgaagattcagacatgagcagtgttgttgacaatttgaaccaaaagcatggaccaaagtacgaatagaatgctttaggagaaaaagagaagtacaaaatgtaatactgcagccttaaagagtaaatatgaactagtttgtgtgcaaattcaagcaaggcaacgttacttttacaacattattggaagaagttgaagatggtaatggtagtggtacatttattgactgttaagtaagaagcagtatgaccctcataaagattgtttatgtgtagcagggttgaagtgccatgtgataaaactcataagctttacttacaagagttctaactagtgtagaaaaaaatcctgccagacagcgtgtctgctttgtttggaatagaagcataaatatctaatttgccttgttacagagaaaaatgcatgatctatgcagcatgtagccaaataatcattctatcaggctcaaaatgtagggaacgtagttaatttgcttctttgccctaatccttctctctgaatttgtacttcatttagtcatatttcacctcttagaagctaaaaacacaattttgccagaagatcaaaaataaaagcagcaatagcataagtcagtataccctaaattaggaaagttagaaacacacacagtaacaaatctctcaaagtttgtttttctctcaacgtttctctagtctgtaggttttttttcttttccatgtaagtgttgtgtcatgaaagcaagtgtatctcaggagtgtaaggtaggac

SEQ ID NO: 119959 - DNA, 1033 bp, Homo sapiens
ctttttaggggaccaagttaatgtcaacaaagaatggtaaatcagatttgcaatctgtgatgttagggaatagagtgatatcaagtaattagaaagaatcacacagatcactttaaccacttcacagtccaaagaagcaaagtctctgtctaaaattgcacggctgccaacctggataacgtagcaggatcccatctctacaaaatatcaaaaattcaccgggcctggtggcatacacttgtagtcccagctactcaggaggcagacatggcagtatcacttgaacccaagagttcaaggctgcagcaaactatgatcacgccactgcattcagcctgggctgcagagtgagaccctgcctcaaaaataaaataaaattacatggctggtttatggctgattccatagttcagtactgttgacaataggcaacacaaagagtggtatttcctaaaggttctagtggactagaatgtaacattttttaataaaattaattcatgtgaaaactggcttggagattgtacccttctaaactgctaatatccaatgttacatcctcctcctctccttaatgggtctggactgcatgcactacagttgcccagtaaaataaaacatcgtcaaatactgcattaggtatcagggaccaggcatttgtctgagctccaacacgtgctttctgggtcttggatttttctctgctcttaaattagaatgattaatttaatcattaaattagatggctgacatgaacgactaatgtcttcgtggagtaccattcttcataaaaattgaccaaaaaaaatcacagttcacgtcccagagcccaggaggaaagggtgtttttgatttctgaccctaacctttctaatctatccttcaaattcaggtaggttcggctcagaataaaggtggaaagagccaattggaccttaaggttaaacattggagagaggaggaaaactctttttgacagcctctagtgttatttgtgggatagactggtccctctaagatactcttaaatttg

SEQ ID NO: 119960 - DNA, 2524 bp, Homo sapiens
tttggcaaaataaaatctgtggaggcaacactggtgtttttactaccttatgaagcaacgtgaggaagaaggaaaaaatcatgtataatcttttgcaacaagctataaaatgatttttttttgtctttaattaaacaaaagcatttttattcacagaatgttatgatcatattgctagtacagcttaatgcttactttttaactaattcattttctcatttgtggcagtctagaaaggtttattaaatctaatgactgttttaggattaagtaggcggaaagcatgttctaattacggggatggataaaagcaaactaattaaccaaaaaagtgtatttccttcctcatagatgtctggtcagccatatctgagatgaacttggcttacctagctcctgagttttttaatcatgtttttagattgcattttttacaccatctgtaccattaacatgactgtaatttctgtcacagttggaagcttcagttaataaatgttttgtttcggagcgggatgggaaggcagacaggaaggtgggagtgtttatgaatgaaccaaaagggaagggactgtgatctgaggagccatgaagtgaaaatcctggactgacttagaactgtgaatttggggttgtccttttctgccccaccttataaatactcttaattaatccttctaaaaaaatccaacctagtagaaagtattaatcacctattaatcaccagctagtcaaaaaatctaaataacttaattcatagacaacagagcatatacagaagaatgtgtggttgttttatgaaattcagaaggatttgtttctcagtgttgtgtatatcctgaacaaagcacagaatcacagtgttgtagttgagagttccaaataaataggtattttatcctatttttttaattacagatttttctggatatatttttcttttttttactagtaactactgcttcaggcttttaaaaaacactgattatgttttcaaagttgaagaaaatggtaagttttaaagcatctgtaatttcaaagagtgatagtatattgattaaaaagtttatagaaataaataataaaattttgtttcagggagaggaataggcaagacacaaggcaaactgtagactaattcaccaaaaataagtacacatacttttcaattttaaaagattaccattcatgactaaaaaagaataaactgtatgaagtgaagactgaatttttagttaaaagtcttattatactaggatgaagttttacatcttgtagcataagggacattagctttagtattataaaggagatatcagtatatattgtgtgcctgctgggtgcttagggatacaaaccattaagatagaagcctacctcaagaagcttactgtcagtaaacatttggaggacaaggagttacagtagaacaggaaatgtaatttacttcaaaaaacttttttttttttgagacagtgtctcactctgttgcccaggctggagtgcagtggcacaatctcagctcaccacaacttccacctctcaggttcaagcgtttctcctgcctcagcctcccaagtagctgggattacaggcatgccccacctccaggcctggctaatttttttgtattttttagtagagacagggtttcgccatgttagccaggctggtctcaaactcctgacttcaagtaatttgcccgcctcggcctcccaaagtgctgggattacaggcatgaaccaccacgcctggccccaaaaaacattcttaaatgatgatttatgtaataaaagtacttcagtgatagacaatggaaatagtacttatctggttgcaatgatttgtaggtagtggtcttgcaacatttgctggtgatacatcctaaagcctcacgattcctcacattcccaaaaagccttggaatgtatcactgcatccttaagttatgctaataaaagtaattgaacgtttggagtgatgctggcaggcctttctgaaagtgactgcgttcactgagagacagtaaagaagccacacatagatgcaaacactgggaagttggctaaggtgactcattaagtgagtccatcgtatctatcaatcttgagtaattcgggaattccaaaatgtgcagcagccaaataacaaatgaatgtcccgaacatttatttatttatttattttgagatagagtcttgctctggcacccaggctggagtgcagtggcgctgtctcggctcagtgcaagctccgcctcctgggttcacgccattctcctgcctcagcctcccaagtagctgggactacaggcgcccaccaccacacccggctaattttttgtatttttagtagagatggggtttcaccattgttagccaggttggtctcgatctcctgaccttgtgatccgcccgcctcggcctcccaaagtgctgggattacaggcgggagccaccgcacctggcctgtcctgaacgtttctgttccaactagtgatggtgaggatctaaaaatttcccac

SEQ ID NO: 119961 - DNA, 1047 bp, Homo sapiens
tacttaactgacatagctacacatgagaaaaatttcttttttatataattgcacatttccttggactcaaagctattgtcttacaaatcagaaagtaatacaccacaattgggaaaagtggaagggtaatttcaaaataaaaagcataccatctgtttctaagggctaaaggaatgttctaaaaatcagtgtagtttcaaagagctataaatacaatttgtaatgtactgtcatacccatacccacataaatagcaggcttttaccagttttcttttaggtaatgtatttagtaaccaacagagccttgatcaacagagctttgatatttttctgtatttttgtcttgcttttaattcgcatctatctctgtttctctctctccctcatatacccttttctcctctcctcttctttataaatatccttcttcgccaaaacataaatatgtaagtgtattgttttctgcccaagacaggagctaatttaaggtagatacacctcctgggctgcaagacaaagttccagattagtcaagacttgtgagaaattcatgtgaggggcaaagaagagattatttatgtggagaaagtgggaacctacataggattatttttatccagatgaaagaaatacgggcagaagcaaactaaaatggtctacaagttgggcattaaaaaaaatacaactggaatattttacaaagtctgccccatggtgataaatacacacgagcagatattacaatgccatgcatctgtgtccccaccaaaaacctgtgtgatttaaaaagtgatgttaatccgactagcataacccttggtgggttcatctgttttctgacaagatgaaaaagtgatagaaaagtcatcagatctctggctgacacagtggcttatgcttataatcccagcactttgggaggctgaggcaggcagatcacttgaagccaggagttcaggaccagcctggccaacatggcgaaaccctgtctctaccaaaacatacaaaaattagccaggcttggtggtgcatacctgtaatccca

SEQ ID NO: 119962 - DNA, 1052 bp, Homo sapiens
tctgccattggatgatgcagcaagaaggccctcacgaggcactggcaccttgatctttgacttcctggcctttagaaccatgagaaaataaatacattttctttataaattatccagtctcaggtattctgttatagcagcacaaaacagactaaggcagagatctaatcacaaattttacatgttgatgttaaagatagttttcttagtcagtattttgatattaacaggtctgtattttatatgttgtaacctactacaaagcagagaacttttatatggccattttgagaaaatattttaattatttctcttccttctctactggtaagtgaatggtaataatgaaaatttctctttcatttgccatttctttctgctttactgtactgatagactacctgttattaatggtcattacagtacctcttattttctcttaaagaacttgttttatgttttcttcaagacacgtaataagtagcaaagagatggtccagcattgtttactgcagaaaacagtgcactaggaagtttggcacctaagacctatatctaacttacacagtatcctgaaccaaggtacttaaattctctgtgcttctgtaagttggcaaccacaaaagtctatgtgaaagtgaaaaataagaaactagatgaaataagattattatagctgctctttgttatgaagatgataacaaaaaatacagctattctaaggccttcagaataaattatagaattaaatttttgagaaaaatgccattgatttatttcagtttagcaatttttcaaaaggtttcagtgcttgacagtataactgtaagaatatcactatttattaaaagagctgcttcattcatttacatttattgagaacctattgtgagtcaggcatttaggtgctagggataaagttacaaatgaacaaaatctctactcgtggaatttagaatcttgtgagcattcttctaggttatttcccttaaaatttaaggtaactagtttgctgaaattaaaaggagtattttaccctgctgtagtgctat

SEQ ID NO: 119963 - DNA, 1108 bp, Homo sapiens
aaaagtacataggattgcttaaagcttttatctttgttagtaatcaccctggaagaatttttaaattattgatttaagtagaatcttttattcttggtttaaatgtatacaaaaactacctacatgctcacctacaatctcgattttctttgaaattcatctattttctcacttgtctacatcaaggggaaatagggagcgaggataggtctgaaccaaagtactcccacttaaatggcatgatgtgtctacgtatctatgtgtgtgtgcgtgcctgtgtgtgcacatagcaaattactggttgcaataaaatttgttagaatttcaatttggcttcattaagtctgagacagtgaagtaatactaagggagaaatagaataggtgaagagaaataaatactagatcaattttctttcaagaaagacgttttagaagaagtagtattcattttttaggtcatcattgacatttctcaatattatattcctataaactgcatatcaggacttgtatgtgcttgaggaagctacattttcacagcaggagaggaaatcagaataaagcattgagatgcaggtgcacagtaatacaagtgggctctttcccctgcagcctgaatgcctggccaataatgcagaagctcttggagccgggctctcagggtctcccggagctaagccaagaagtatgggggtggggcagggggggtcaggagagaataattgttattcagtcttctttaatgagatgtattgcccactgctgaaagattgtggcagtgccttttgttatgctaattagacaccattagagcttggctctctttgatttctgcttaatcttttctgcttcctcagcctcaatcctgactggcaaatggttgaaagatggtggggtgtactgcacgtgttatttattgctcacatctatgctgagttctttggggaatgggggggaatgtaagatttatcttaccaaaggcagttcctattttggacgttcatttttggcttatttttaaaaaatgaattttttgataatgattactttctgccttttaagtccaaatgccactgttttttatatggttgcttttgcagccacac

SEQ ID NO: 119964 - DNA, 1085 bp, Homo sapiens
taagttaaaacacttgaaagtgggtctaatttcagacaggtcagctaaccgtgctagaagcaaatgagggcgtgtttcttcctatttttccttccacccccaagataactggctcccaagcagttttttctgttccttttttttcttactaaactttatgtgagactaaattcttcatcgctgctaagttcacgtcacaaacaattaaaaccatagtacgtttaatattttatgcatttttctttcattttgtatcttgttagtttcttttacagactggttaggacgtatttgagtttcacagtctagatacatagcttttattctatgctgctgagctatattttattgaccgttgcagctgaattagtatgactgtcacttcacactgtgtttagtgtgtttacaataccttccgtgtaccaatttgagtaccatccaaagtatcatcagagcaagctgatgctaaacaattagctttcatttcacttgcatcactaattgtgcaatcactgatgataattctcttcctcctgagggttgtagctggagcatcgtgagggaaattgcatgcatcagggaactaattgtgccttgataataataatagctaccatttagtgaaccactactatgtgcttggtattgaggctctttactcgtattacttcagtttattattctagcctggcctagggcagctagaacacgatgaagttctttatacagctgtacacacccacatagaggcatcataggatgggactgagcaggcattttccccacctctccatcctttgtccacgttcaagataggaggcagaaggagcagtgagcctgggacaaagacgtggaccgacttccctagctaagcgctaaggaaaagaaccaggcccccgagcctgaattacttacatatgcaacatgcaggtagcacctggcctcttataatatgtttcaatgtttattatccaggaacggaatgaaatcttagagatggaaataatgaatatgggcttggtcttcgagaagtttttggtcttggctgttcctctggtaatactgctaatcaattgtgaccctgg

SEQ ID NO: 119965 - DNA, 1036 bp, Homo sapiens
ggtgcctgtaatcccagctacttgggaggctaaggtgggagaatcacttgaacccaggaggcggaggttgcagtgggccaagatcataccactgcactctagcctgggtgacagagtgagattctgtctcaaaaaaacaacaaacaaacaaacaaaaaaacaagccctctcccctccatctccctaaaacaataaagagattttgttcattggaagaaaacaaaacaaaacaaacactccttggcagccaaaggaactcggaggaacacaaaactttactcggtacaggaaggtaacataccatcagattctcaattacttagtcaaccttggtttacaacaattgacattaagacagcactcagaaataacaataacgaaaacaaactcaaacacttgccacctcctcttatggaaagacagcaaggggtgggcggtgggcaccagtcagtaccttccaagggaacatttcctttacctggaaaaggaattctaatacatgaaatttgctctaaaaattatcagatgaggaaaagtaaagcctgcacgtgaattttctctaatgcctacagccaaaaagcaatgtcccagactggtaatatttttctaagaaattatatttagccctttctctttcctttttgaccttcaggagagggaaaacaattaatttcagaacccacttaatactggtcagaacttcctctgttttcagacagtgacaggtaccaggtcctcccttctgcagacaatctttcctgtctctctaaatgttttgtaatcagatgtggtagttccaaattctctttattccaaacagagccaggaagtaatttctcaggcagtttaactttgatagcaggtaattttaatctatcgcaaacatcagcctgacatggacttgttatcttcattattttaattactcttttgggccacttttttccctcattccttccaggaaggagtgaatagaaattggcagctttaatcttatcatgccatggaccagattttttttttttttttttttttt

SEQ ID NO: 119966 - DNA, 1042 bp, Homo sapiens
cattgcttaacagagaagttcactctgttaagcagacagctccaggtcatctagaacctccctccaaaacagttttccagcctcatttaccatcattccttacaaaaaaaacctccaaccagggcaaataagtgactgttttccaagtttccattttccaggttgttctgtctccctggaataacgctgtttatccccatccttcttcagcctcccctccccatctcccacccaatgcataaacacaaaactggagtttcaagttccagctcaaaacacactgcccctgaccttccaaaaagaaacaattccactggtttcttcggaaggcatgacacatctcatctgaccgtattttccattgtgttcttaattatctgcatggtaagactgtagttctcctctccccagagcctaactcatggcctgaaatagaagggagtgctcaattcagggtttaatgaaggggtaaatgaatgaatggaagtgaataatgataggaaatatccaaaacatcagataatccaaaaataatctatatgtgactttggaatgtattttatacacattttcaaagaacatcaaacacaaaacttcaaacgaagtaatgaagccagcctgtgcagatcccagttgggtggggtgtcctggaaaaagggtgggaatcctaacaggaaaggaggaacctctcatcagccaactacccttccccagcctcgtggcttatctagaaatcagagtgaatccaaatggcttagagctcaagggtacagtgttgggtaattcataaatgattgaaatgcctttagaaatataagtgctacataaatgctaaattataataacacaaaaataatcattttccattattttctttagatatgtaaatggcatactcttttaaatctaaagtgggttcaagaaacagcaataagtttaacacaaatgcaccaaacgatcatggaaacccattcagtgttctaaatgcaattatcgtgctgaccatcagcccagaaaacaaattacggtagctaatgacagg

SEQ ID NO: 119967 - DNA, 1085 bp, Homo sapiens
gaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaag

SEQ ID NO: 119968 - DNA, 1050 bp, Homo sapiens
ctagaaaactaactcgccttcttgctgggggtgcagacaagtccggaagctcgttggaagggggagggggtctcttcaagcaaaggggagcaaactcgaagtcgcttttttttttttgccatcaacaacaacatcaataacaacaatcacaggtcgcccctgtctaccctcttcctcctccgcgtccctccggctgggcagagtgggtccccggcccgggaaggtgggggatgggagcgcgggtccaaaacgccgccgcgctccttgatccgacgacgagaacgcgggcgaagccagccctgcttactttttctttcttttttcccttttctctttaaactcttcgtctgtccttttcgtttctttttttcactttttttttctcctctcctaccccccccggcccttctccctgcctgcgcgcccttcagtaggtgaaaaccaggttggagatgctggactcgagccagtctcccgagatcatctcgctcacctcgggcgtgcagtagtccgggaactcgaagtgcgagccggagccgggctcgaagttaaaatccaggtcccggtcgagcgccgacgacgaactgaagctgcccagggacatgctctcaaagtttgagctggggttcaggtcgagcaggtcgtcttcgaactcgtcgtcggaggacgaggagcccgaggaggaggaagaggaggagtgggacgaggccgaggaggacgcgtgcgagggcgcgctggacggggcgggcgaggcggcgcgcaggctggcgtagccgcggtggtcggcgggcgagcggccggcggcgggggacgaggcggcgctgctgcggccgctcaggctgggcgcgtcgggcgagcagcccgcgccctcctcctcgtacaggcccagggggtcgctggggtcggctcccgcgcccacgccgcccacgggcgacgacgacgtgcccaggccgccgaacaggtagacgcgcttcaccttcttctccgccaggtgcttgcccggggccgcgagcgctgcggaggccgaggctgccgaggaggcggaggccg

SEQ ID NO: 119969 - DNA, 1794 bp, Homo sapiens
gaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaatcttgacttttgtcgttattatgcccaatgcctaagattggaaag

SEQ ID NO: 119970 - DNA, 1053 bp, Homo sapiens
gtgttagcagaacttatgttgtttgcattactattatttttcttcattttgacacttcattttggtaaacaaaatccaaaaatggcccaaaataaatgtctaatgactgggagtctatataaaatacagtaagttctctcagagtgaaaaccttgagtttgtaataacagagcccgtacatttgtttaacctttatggcatacatcaagtttttatagtggtcataagagtcttctattccttcttttaagtcttacaattagtttttgttcacctctgtgagaaagtagttaaaaattcacataactactgttggtaatataaaaagttaattttgatatatttacaatccttgtttaagtgattgtttgccatggaaagtaagaactttctttctgtggtctggtcaaataaattaactgggaattggaaacatttttatcttgttatgaggaaaaaaggaacattacaacttgcttctttctagctgtataaacataaacaagctacttaaccttcctgggcttctgtttgttaccaataaaatgaaggttaagttaaataacttaaaacatttttgaaatcttttaacattaagattctatgatttgttacttgcttctataaataagatacatcctctcttgtaaagtttgtttttacatcattgaacaatagagttaacagcatcatcaagttttttttttttttttttttttttgtgtgacggagtcttgcccttgttgcccaggctggagtgctgtggcgcgatcttggctcactgcaacctctgcctcccagattcaagcaattctcccacctcagcctcctgagtagctgggattataggtgcctgccaccatgcctggctaatttttgtacttttagtagagaccgggtttccccatgttggccaggctggtctcaactcctgacctcaggtgatctgcctgcctcgtcctcccaaagtgctaggattacaggtgtgagccaccgtgccccgccttggcatgataaacttaatgtgatttaattacaattattttgtttgaa

SEQ ID NO: 119971 - DNA, 1191 bp, Homo sapiens
gtttggcattttaattgttcagaatattgactttgtttcctgagtctatcaagcatgattcagaataaagcatgacttcactctgtaaggatgtgtcacccctctattttagatgtcattttaacacttctgaggggaagaacacgtttttattttaaggtttatttttataacaaatgacccaactgtagtatttttgaacctggtggcattttaatattagctgtttccttcctattgatgcaagaaaagcattcacttaaatctgaagtgaaatctgcagtgtaatttgaaacctgaaatgcttattgattatggtaaagaatggaaaattaatgactttgggaatctatgccacagtcaaattgagcagagaatgttctcctggtagggtgctttggatgctaacttctattagctgctgctcatttctaccactaaatatctaacaacactgttctcagaagtaactgaacttgcagaaatagctcatgaagtcattttctatttaaatagtctgcactttttagaataaatactctttaactaggatgatattaacgtatgtcttcgacagcaactgcattgagaagacagcctttgcaaaacactcttgtcccccatccaagtatgggtcttttatgacagattgttgtgtatctgaggaagctattgtgtcaacaatgagcatcataatgagtctaaaaatctgactcaatggaacaaatgcattttaatggcatgcattttactttaaaaggatgtaccaaaatagagcaagagtctgaaagcagggcattattttataatgaaagactaatatatgggtagttcaaactaaaggaagagtgtgactgggaatgaaaattgacttagggtggataagatcactcccatcagcaaaccacaaatgctgggggagagttagctgaagtggtacaggagcgaaaattaaagtggttaccaacacccaggaatgtcctttactgagatgctgacctaagtgggcagatggcttcctatggcactcttcacaggctggcattgcaatatcacatttactcactttaccaaaatgccatgaagttaatgctggaataacctgtttcttttcatgtttaaattctacttattaagtgtggtgtaatattgaggggaaaggagtaagtttagagactgagataaatttct

SEQ ID NO: 119972 - DNA, 1050 bp, Homo sapiens
cagtgtgggggctgccctgggaggtcatgtctagttccacgtaaagccccagaagtgaccttctgggtctttacccatggaattccagactatactgcagtgagaagaaagacgtcttttgttctttggctaactgtgcattccagactctaatttggaaaggccagatctgtgagtgataacagggtccatttaaggaaaaggcatctttgttgaaaatggaatagggcaagggtgaaaaggtggggcgaggcagatgtcagttttgtgtattgcagtattccattatctaaaacagtgcaggcagatagtaagtgcttaatacctagttgttgaatgaatgcttgatgacgatctttgaggtattatttgctataggagtttcagtacaggagtattttaaggagatttcagagtgcccttggaagctgctggtaaagaggaactctctagcaaggtgaccaggttagacacagaaaaaaatgcttctggtcatggtcaccccttcccaggctaaaagtactcattggcaccaggaacccttccctatattttaaaaaatattatagcccataattttgcacactaaatttggctttgttgacattggcatcaggtaactcaatctcttttcctttattttattttattttattttatttttttttgagacagagtctcactctgtcgcccaggctggagtgcaatggtgcgatctcggctcactgcaacctcctcctaccaggttcaaacaattctcctgcctcaacctcctgagtagctggggttacaggcatgtgccaccatgcctggctaattttgtatttttagtagagacggggtttcaccatgttggtcagcgtggtctcaatctcctgaccttgtgatccgcctgccttggcactctcaaattgctgggattataggtgtgagccactgcacccggcttgaagctgggaggcagaggctgcagtgagctgagatcaatctctttttctaaggcattgcacacctacacatgtgtaacccaggagggtggcacgggaaata

SEQ ID NO: 119973 - DNA, 1359 bp, Homo sapiens
tcttcactactctacagatacctctttctaaaaaaatttattttacagtggtaagaacactttacatgaaatctatctttaacaaatttttaagtggacaatatggtattgttgactatatgtacagtgtcgtctagcagatccctagaacttacttatcttgttgaactgaaactttatacctactgattagtaactcctcattctcccttcctcccagtcctaccattctagtctttgattctatgaatttgaatatttttggatacctcatataagtgcatttatgcaatatttgtctttgcgtaactgggtatttcattgatgttggctcatattgcagaatttccttctttttaaaggctgaataatcctgtatgtgtgtgtgtacaccacattttaaaaatctattgatcttttgatacacatttaagttgtttccatatcttagctattgtgaataattttgcagtgaaaatgggagttctggtatctctttgagaccttgatttcaattcttctggataaatacccaaaagtaaagctgggtatggtggcttatgcctgtgattacagcactttgggaggccaagacaggagtatggcttgagaccagggattttagaccaatctaggtaatgtagtaagaccctccctctacccgcccccccagaaataaaaattagctgagagtggtgatgtgtacctgtagtcctagctactccggaggctaaggcaggaggatcactggagcccaggaaatcaagggatggtgccgctgccctccagctagagtgacagagcaagaacctatcttaaaaagcacaaaaaacaagcagcaaaaaatacccaaaagtggcattactgaatcatatggtagttgtatttttaattttttcaggaacttactgttttctatagtggctgtaccattttgcgttcccaccaacagcgggttccaatttctctacatcctcgccaacacttgtgttttgtatttttgataatagccatcctcacatgtataaggtgatatctcattgtgattttgatttgtgtttccttgatgattagtgatgtcaaactaaaaagcttctgtcctgtaaaggaaacaatcaacagtgttaaaaggcaacccatggaatttggagaaaatatttgcaaaccatatgtctgataagatgtgaatcccaaaaacatataaagaacccttacaatgaaatagcaaaaagactaataacctgattaaaaaatgggctaaggacttgtataggtatgtctctagagaagacatacaggctgggtgtggtagctcacacctgtaatcccagcacattgggaggctgaggcaggcggatc

SEQ ID NO: 119974 - DNA, 1214 bp, Homo sapiens
tttcactcttgttgcccaggctggagtgcaatggcacgatctcggctcactgcaacctctgcctcctgggtttaagtgattctcctgcctcagcctcccaagtagctgggattacaggagcctgccacaatgcccggctaattttttgtatttttagtagagatggggtttcaacatgttggccaggtgggtcttgaactgctgacctcaggtgatccacgcgcctcggcctcccaaagtgctgggattgcaggcgtgagacaccacacctggcatcattcccttttaaaatgtcagctaggtaataatcttttcttttcgaatcaagtgggggtttcactaagaagggtagagtattatttctatgtgaggccaggaggctattgttgggtccaagaacaaatgcttagagataagcttgttggcctctcacggtgttgtgagagggttcagagtagacagacatgtgtcttcccccttttctgtcaccttcctttctgcctacaatgcccgtttttgatatccagctggtgagagtggataaataatttgtatcatagtgtcagcctcctcagaaacccataaagatttctttaaggatttggatccgatatctttctgaattaggccctaaattattatgaatgtgaacctaggttatatgtcttgcctgtggtatgtgtgctgcgatactttgaagcagaatgatttgtggatcattttaccagtcctttctcttttttggtcaaatgcagatggcatggaggaaatggaaagttctaggcatttttgcaaccactactatataactcttatggaccggataaatttagtagacaaagtaagtggttagtttcttggacctcggttttctggtctgtaaaatcaagagatgcatcaaagtttctttctagctttaaattctgtaattctttctttgagaattgtgtagcatgtataatgtttatgggaagtaaagtttaagtcactaaaaagaggcagaaatcaggttatcactcacagggctgttttttcagcctagtctctgccaatcctaaccttgttaaaactacaatgtggcaagagatgatgtcccattattatttctttcactcgagaatgcttcagctatatagatctatcaaagcagttgttacactggtgagtttccccatatccatcagaagaagaaaatccatcacacttttgactac

SEQ ID NO: 119975 - DNA, 1018 bp, Homo sapiens
gtgcttccagctgagttcttaatgctaccaccttcgtcatctgtctggtgccctcaccttgaggatcaaaggatccccaaggattgcctttccccgcatttccttctcggatggacttatttccgttctttttagttttgttcaccctaggatattatgctcaaaactaatttacatgctcagctaatcttaattaaaatgtaaaggcagatcagggcacgatcaaattaagttctgaatatacttggatagttgggcatcagtttaatggattaaacagttcttggaattgcttctctttcttgacagtaagtcttagttttgctgtcatttcttaatagtcccttttacttctactttcaagctgtgactgaacattctcttttaacttacagactcttttgctatctggaaacccatgtccacctctgacttccactcaaaattgctttcctcacagtctgactgcgagagttgtgaaaaattgggatgtgcttctgaggtgggctgtggaatgccatgtaagttgctacttttttttttctgaatgcagtgggtattcatgcgcagtagggatgttggcatatctctgatgtttccttctaaggctggtgaatctgggttgttgctgttggggtttgtaatgtagtccatgtctattagtgaagacacagagggcaaaataagcagtttctttcttctttctttctttcttttttttttttttttgagatggagtttcactcttgttgcccacccaggctagagtgcaatggtgcaatctcggctcaccgagatctcctcagcctcccacgttcaagcgattctcctgcctcctgcctcagcctcccgagtagctggaattacaggcgcacagcaccacacccggctgatttttgtatttttagtagagacgaggtttcaccatgttggccaggctggtctcaaactcctgaccgcaggtgatccgctgcctgcctcagcttcccaaagtggtggaattacaggcgtgagccac

SEQ ID NO: 119976 - DNA, 1049 bp, Homo sapiens
aggacactggaaatctggaatccttacactgtgttttagtaaaggtatgagcctggaactcctgaaggccttaaaaaatagcactgtagtaaatagagcttagttggggtaaacagagcaccccggaaagtagtatattttggtgattcaaaatttatttcacttctctgatctgtgtaagtatttatgtgatctgtaaatacttcccagccataaaaattctaatttcatctctcaagatacatagtgggcacttgtgcaactgtattcagggagctgtctgttggttggagagggagatgaagtagattgaggtgcaaatggcatatttaatgccgaagctgttgctttaattggtgatgttgaaagtcacttgaaaccacccccctagtcctcaagggagttctcaggttacgtgtgggtgtactgtgaatgccttttattttattgactcactaaattcttagattactctttaccatttgatattgacagaccataaaattcttatggaacctgctcagtagtgacttataaagaattatcttgttaataaactcagcatcatttggaattcaagtttaattaaaatggaaaagtaaatgatgatgtaaagatttttcctcatttaaacttgtatccttttattgcctctctgtcttttctctaaattcaaagatagattttatttgacacccatttttgcaaggtgcatttttacagaatctgttgtaggacttcttctcattagcttttaaattattattatttttaaattagagaaggagttgtgagatagagtctgagagaggtaaaaatgaaaaatctatgttatccagggattttagtttttgggatgctgtttaaagataatgattgtttatggactctttaaagatgttttctcataagagttgccaagtaacagattagttatctgagggtggtttgaaagaccttttgaaattgcctgggtgacaatactaccttatggtacttataaagctcctttgaagttggccttttatattagaaaaccagaaaatatt

SEQ ID NO: 119977 - DNA, 1003 bp, Homo sapiens
cttgaggggagatgtatgcttacaaaaaccacctccacctggctttatttttggcgcgatcacacaaacatgtgttttaattttaaagattatatttattgtcacatttagattttttttaaaaaaacactaagaaatctgagtgttgtgtgtgtgtgtgtgtggttcaggatgcactggaggtgtgtgctgccacaacaaatttcaggccacgtgttctgcagattccaattagcaaggccctcctgctgtggtgtgggagaaaagtttggagtggggttagggctggctgagtgtaggaggctttttaatgcaatctttgcagaactccctcattagcacctcgaggtcagtgggaactggtatacagagcacagttggcattttctgctatgcatggtgtgtgtcagccattttatttatccatgcttattttctccgtttcataaaattaattgtacttaatgggggaggggttgataatgctgaattattttaagcctggagggagctcagcagctgtgtcctagatcagaccaccgatctatctaataggttgtcttgctaccggatccactggacgaatgtgtttcgccaattagacgaatccctatatggagagaaaaatgaccttgagccccagaaagccagacagttgcttcgtgccatgtcttcacctactgaagctgcttcaccgccttggcctgataggagtgtagtatatatctaacctctagacaattaaatttctcctttaaaaaaatagccactcttatgtgaaatagtcaaatctttcatgacttgccaagatacttgcttttggaatcaggtgctttcgggtgtagcctctaaaaattttaaaggagagcaaatcttccaagcttccttcttgtatcaaggcataacctgctgaggtccaggctgcagtgatccatgatcatgccactgccctccagcctgggtgacaggctgagaccctgtcgcaaaaaaaaaaaaaaaaaaa

SEQ ID NO: 119978 - DNA, 1058 bp, Homo sapiens
tccatgggtgaatcagaaaggaccgtggtcagttatgtgggagtgcagaaagccagccagccagcacgattcgccttggaggaatgacttctcatgctgccacctcctgcttctctgctgggggtgtggaagaaacagtatgggatgtgggcggttttctgctgcagtttattgaacaaacagctgccctcctccatttctctccctcccttacccccatcccgccacatccttcttcctggggcagggtataaccatgctgtaaactttggtagtgggagaatcttgccaatactttctgaaacagcaacttttttttttttttttggcttggaactgttagttcaaagctggaaacagagtaaataaaatttgatctagtcattctagaaatgatttgtatcagtccagaaaatggccagagtccagtagtttgaatctaaaagagctgaactaagataaggtaaggagccagttttttaacctggcaaccacatgccccaacttgaaagcctgtttgctgctcttcttttgttatcataacctcttgaacagaatacgccatttgaaacaacagtaaacgcttctcagtggataagtttatgacctagtttttgaccaagagcacttacgggattgaacggcgcggggaagagcaaaggaccttggacaccattcgccaggaagttctgtgcaaaccgggagctcggggctcattagaagccggagacattaagcagcagctgttttatggtgtgaacttttgcacagaggatttcaagaggctcattctcctcggaagtctgtttgcaaagtggttctttcttggctgttgcttcatccttcttcagaggcctattttcactccgagtgtgagcatttcatgccaaacccagccatgaccttgtggctgctgagctgcccgcatggcctgaccccacaggtcttgggatggtgtgcgcagcagagctaaaccaggaggggtgtctatctcagctctgctggctctggggctggtcgcaccctgcagacttggagttgaggaccagaaacgcagg

SEQ ID NO: 119979 - DNA, 1087 bp, Homo sapiens
ggttttctttaaacaaaaaaaaaagccagaagtttcccacgtgtgtgtgtgtgtgtgtgtgtgtgtgtgtgtgtgtgtgtgtgtgtgtatttgcagggagtttgattccgtcttctcattagtgccgcattaatacatttttctgcctcacatttgtttaagcttcacctgaaaaaacaaagtaatgtcgtacttaaaatagagtataactgtacctcatgtagtaaacgtaatttataaagaaccgaactagatgaattttgatggggaaaagggaatgttgtttccaatgaaggtaaccaaagatgagagctttgttatcccaagcacagaggctggacctggataaatcttgaaagcaagcaactaggcacaaaccaggtgcctatcgaaagaggtccctttaccaccattagtgttatcagggcttttatgtcaaacttctgtctgtactgtgctgggtgaatttttaactgaacaggctttacaattggagcaatggggctaaaaccacttcagaattccagaggccttactcagccccacctctcagttggctctttccatgcactcatctctctgcggggctttctcgaggtgtggtcctgggaccaccggcatccgatcacttgtggcacttgttaaagctgctaattcctggtttcgacggtagacctgctgaatcagaaactgttggggaagagtcttgaaatcttcatttttaacaagcacctatcaggtgattcttaggcacattaaaatttgagagcctgtgatatattcccagattagtactgtcacatctcttaaggtggcactttattttacttttattttttaacttttatttttatttatttatttatttttttgagaccgatcatactctgtctccaaggctggagtgcagtggcgcgatcttggctcactgtatcctgaggcgattctcctgcctcagctccttgagtagctcgaactacaggcaggcgccaccatgcctggctaatttttgtatatttagagagacagggtttcgccatattggccaagcttgtctcaaactactgacctcaggtgatctgcctgc

SEQ ID NO: 119980 - DNA, 1648 bp, Homo sapiens
tgatattgttctaatatgcatatttccatatgcatacttttatttttttcttttcttttcttttctttttttgagatggaaccttgctctgttgcccagactggaatgcagtggtgtaatctcggctcactgcaatctccgactcttaggttcaagtttttctcctgcctcagcctcctgagtagctgggattacaggtgtgcaccaccatgcccagctaatttttgtatttttagtagagacggggtttcaccatgttggccaggttggtcgcgaactcttaacctcaagtgatcagcccgcctcaacctttcaaagtgctgagattacaagcgtgagccaccacgcctggccatactttcctttcctaaattttccttcatgaatttcagaggtatacaggattcttctgcattcttcacaagagattacatgaaaagaaaacataacattggattgatctgaatgaaaaaacaaaagcctgagatgaaaaagagtaaaaaagacactatgcaagatagcttacataccaactccttggtattacaggtttagcatcccaaagtggaaaatctaaaatgtaaaatgcttccaaaatccaaaactttttgagccctgacgtgatgctcaaaggaaatgctcatgggagcgttggtttttgtttgtttgtttgtttgtttttttgagatggaattttactcttatcgcccaggctgggttgcaatggcatgatcttggctcactgcaacctctgtctcctgggttcaagtgattctcctgcctcagcctcctgagtagctgagattacaggttcccgccaccacgcctggctaaatttttttgtttttttagtagatatggggttttgccatgttggccaggctggtctcgacctccggacctcaggtgatccacccgcctcggcctcccaaagtggtgggaggccactgcaccctgcctcgtgggagcattttggatttcaaattttctgacttgggatcctcatctagtaaatatataatgcaaatatccccaaatctgaaaaaatccaaaatctgaaacacttctagtcccaagcatttcagataagggatactcaacctgtgttgaagaaaaagagaatccataataaagatggcaaaggaagcagatcctatgatacctaaacagagacaatgagagatttctgtactttttctaaataatagaatcttagccctgattcacgtctactgggtccaatcactaggcagttagtctccaaatagccttgtgatttatgatatagtctaagtggaatcaaaattggagcctggattctccatgccatttctgacttttctgagtgtgggtgtgttgtaaatatgtaggttggatgggagttgaagatcctaagaaatgtaaacaacagccctgtctttgaagaactggaggaaggctcagggttatgaggatggaacatggagtaaggggtgtgattataatgagtgaaagacatctctttgatggatggtattccacccagtgggtctcacacctggccatacctcatcacacctttgtttgcacatacctgacatcattggcaaatctaggtctctggatgcttcccaacactggcaccctgagctgaagctaattctgtcac

SEQ ID NO: 119981 - DNA, 1626 bp, Homo sapiens
ataagggacaaaagaaactctttttttttttcctcccctcttgtgcctttttaaaataagctatctaacaaagacacaattttttccctccctctcctaagccccagatgacctaaggatttagaggtctgaggtcagatttctttcttctttgcttcacagacaactgtctcttctttatattgtgatctttctgatttgtatagggactcggcaggtagaagaatgtgtgtgtgtgggttgtgtgtaaaatatgtacgctttcacatgcggcgggggcatctttatgctttggctcagatggcgcatatgaaagaaattaggtgattctaattatatagcccccaaatagtgaggatcccaattcttctccttccctctttgaatctatttaatagtttacctttgaaccaagttaattaggaaaagggacaggctacagtcatttcatttggctgtttttggcatccaggaaagtgtggggtggggagctcatcagagggaaaccaagggaagctcgtagacattgaacttgctctgatcagattattaattttcttctccttgtacgttgttaaatctgtagaaaaggaacatcagctcaagatctgtcgctctggctccgggccagcatgccaaattctgtcatctttgcagcatggccaagcatctttattacatgttataattctggtttttgagcttgatccagtgatcctgctacagcatcagatggtttgggatgtggaaaaagaagagggctatattcatctgtagatgaggtttggggagaattgtaagagccagaaaggtggagtggttgtctagggcagggacttttcatggatgctacagacacctcctttgtgctgcctcgaatttgaaatgcattattaatttctgttcaatacagatcgttgatgtcaaaccaaaaataaatgtgggccctactcctgctctggccattacatctctcagcagcccagcaattagcaccaaccttgagaacagagtgccatcattgatgtgacagtttcgtccctattgtcctgttcctgggtgcatgggtgacccttgacctccattggtctcggagtgggaaactgaacttatgaactgttcgggctgcgctggcctcagattaacctgggcaaggttaactttctcactctcttcttcaaaagtgctttagagggtgaggaagtactaggagtaaataataattttaaaaaatggttgggaggggaaaaacaattgcatcaatttcctgagtacagacacccctaacctgccttttgcaaataatctcccttttgtctgctcttaggggttttgcagatgaagccttggctttggcttgtcaatgaggacttttcagaagctccagaatgcctttagcggctttgcaggaagcggtgacacaaagttccagccagtctccccctccttccacttattgtttcagaattgtcagaaaacaggctgggatgaggaggaagagctactgtgagggctttttttttgttgttagtttggctgctgaatgaaagcaagcactttatttagaagtgagtagggagggaaatgcagcttagggttgacacccttctggtgcttatccataaa

SEQ ID NO: 119982 - DNA, 1037 bp, Homo sapiens
tcaaggggctttggtgcctaagagaccaagctatggtggggatttgagtctttagacaagcagcccaggaagagattgttttgagagcagttcggcttcttggtgctcctgaacgtcttgtaggtatatatgcttcatgaggcaaaattgtgactctggacttactaaaatacgttccgtagtaagaattttttaaaaaatgcagttttctatgactcaactttagaggttttcattaaatattagagctggaaaggaccaatactggtcacactctaaagaagttttttcatgaattgatacatatctaatttgttgatacctcttaaagtgagagaaggcaaagaaagctcctgagattgtgcttgtcttgatcaatacaagcacaatgagttgctgagatgaatgagtttggcaattggctataatctgagaatgttccgaacttagtagattggggatgtgtttgtgttcccaggttaattgcttatttagctggcattcatttggggctgctagtccatttgttaattctgaaagttgttggacatttgtttaataaaaacaaatatatttggagaaatccagcatcccaagtagccacattagtaggaattaagtaggtacaaagtaatggtttaagaaatgatagtcttttgtatggcaaggtaaaagcaaaatgtcttttagaaggaaaatttcaaattgattaatttttaaagtctgttatcctgtttaatacttgtgtatctctgagaatataaatgaggtaaagaggtaattaagacatttaatatttgtatcacaactgtggaagatatgaaattgttattttccaattgatcattacgtaagagagatttgagaacattttgattagaatcacttagacttttctgtccctatatgaagcgtaccagattgaggcattttcctagtaattacaggaagtcttatttaattaaataaaactgtttctcatggtgtttctggccttcagtaactgaaggtttttattttgattatgtgttttttgt

SEQ ID NO: 119983 - DNA, 1042 bp, Homo sapiens
atttcgctgcttgtcttaaaagtaatttttctggttttatgtaatgtgtgtattagaaatgggaatattggaatacttacttcattgtattgtcaagcattattggtagccctaatttatatatccattgtgctgcagtttcagttgcagaactgccatctgcagggattattatagcacttgaggggatggaattactgcactctgttttggatacttttttcactaagaagtatgggcaccatgagatggtacttacccatctgtctgttgaagcatttgtatgtatattacctgagcacttaggcacaccaccgaggggggatttcaaatggaagggaaaaaggaaaaattgaaaataaaataacacgatggaaataacagaagcctctttgcaaagaatacctaaactattcttaaaagcagacttaacagccagtacaaaaccattcactattgtctttaagagacgaagctcaatccacaaagttgaaagtgaagtgtgaatctggaagttttccaggaaagtcaagcattacagacttctagggctcaaattcaagggagaaaaaaaagtccattttacaaagtaacttcttacattgattgtgagctgtcaatgtttgatgggtagatcctgaaacattaactgattaaattcttcaatgctatgcggtcatattggtggcctccgctgttctgagcttctaaatttgtgtatcgacacatgggaattcactaaatgtgcagcagagagcagagtggaacattgtggcatcagcttgaaatttcctaaagagaaccagtggaatgatgttgaaatcaattgaaatattatttattgattgcctatgttttatagcacctaataaattgtccaatcccttaaaaacactccatctgcctaattctccatttccagttgcagcagatacaaggatacaaagatactctgtactggtagagagggatgatttcaggttttcttcacagcaccgggctccctgacagctattcttcgtgcttgtgcacactcacagtt

SEQ ID NO: 119984 - DNA, 1180 bp, Homo sapiens
gcgaccatctgggcttaggatcacctaggatcacatttggctgccgtggtattgaggagaaaacacaggttgcaaggagagaggacgggctgttcctggccccatggcctcaactcttgggatcctccaggatttctgtaatcacggtggggaagcacgcacaaaagtgctctgaagtggttgaagtgagggaggggttcgccctaggtaccgatgcttggattatgaagaactgggtttgggttctagctcttccagctcctagccctgtgccctcaggcaggtcagctgccctgagcctcagtttctctgatgggcagtcttgcccctaacatttgtggtgcccggggctagaatgtgaatgcaggaccacatactctgtatgtaaatatttaaaagttacaaatcaaacaaaaaagtgtcaaaacatgtttggaaatttttctgttctgacaaatacacctttataaccatcttgaagggcaggtttgaattttgagttttcagattcttagccaacttccatgcctgaccaggtagtgtgggtgggagcaggaatctagtcgtcatgcttgtggacagcgtggtctgtatgtctgctggacccacccttcaccctgtgggcctcgggattctatattgaggattgtctatcttgggggagtgtgtggagggaacatctgcacaggccttataaatgagcatgggctgttgggataaggaactctggggcccgagcacctggcacatgatccagaacaggatttttgggttccgatgggcaggtgactttagtcctcactctgtgggcaggggcattacagcataggggtcccttttgtcagggatttatgatggcatcacacgcaggattcagagagcattaattgaaaaatacatatgattggctgggcgtggaggcttatgcctgtaatcccagcactttgggaggctgaggtgggtggatcacctgaggtcgggagttcgagaccagtctgaccaacatggagaaaccctttctctactaaaaatacaaaattagccgggcgtggtggcacatgcctgtaatcccagctactagggaggctgaggcaggagaattgcttgaacctgggaggcggaggttgcagcgagccgagattgtgccactgcactccagcctggacaataagagcgaaac

SEQ ID NO: 119985 - DNA, 1042 bp, Homo sapiens
cttctgatgtacagtaagaattgagagtgactaatttgctatcagtgattcttaaatggagagaacatgagtcccagagaatttaggaaacctctgggatttttccagagtaaactgtgtatttgcacaaattttgaaactgtaacttaaagatgtgcatgccctcctataattaataaatcttgggttaagagtctctgatccaggaatcccttccaggattctgtttttatgaacttctactaatcaaatttattatgtcaagtaggataggattataatgaccactatggccactgatgtgtctggtagaaaattccattgagagccagagacacagacatttatgttgaaactaggaaataatggaaataggggatttttgtgttttttttttggctttggccttgtttactgagatttgacctttccgataggtttcttgacatctttggaatgcaaaattggggatactaatatttgccaccaggtaatatttatttaatgatgtgagaacccagggtgttagttgactgtaactgtgattattaacaggaaaatgcgatcagaaataatggcacctttgttatcactgtgattttttttttccaatggcactgaaggaaaagtgatatttgttatcaaatcaggcagggaatttacaaatgataacgagttagagaggctgcattctttctagtatctcactctacttgtcacaagtatctttctcttatggaaagataaaaacacttgatttgggccataaattcactctgtcttctatcaccagggccctaggaatccttgaacaatcttgacctcttcctattcttctttgattgaaaggatgcttattatgtggtgatagctttaggagggcaaaggaaaaacagcaaatatatcagtacaatttcctaagaaaggaagcttctgtggccttttggagggcagaaatgcatactttttattgtgatggtgttgtggtggtggtgatgatgatggtgatggtgagggtggcggtgatggaggtgatggcagt

SEQ ID NO: 119986 - DNA, 1054 bp, Homo sapiens
gatgatggtgtggtggtggtggtgatgatgaatggtgatagtgatgatggtgatggtgattttcctccctccacccaacaacttacacaagagctttgtggatagacctaagtgttaattggtttggctaagagtaagcattaaaagcaaacactcccaattccccaatttttcaatgttagattctaatggatttcttctgtttgcagttgattatccttgccttgattacaagtcaatgttctagcagagtgaagtcattactggccttaattttcacagcctggcacggttggagactgcagtgatagaaatggagtggctaaaaagaatttaactttttttattttgaaagtgctgtgggaccctctcagctatagaatacttgacagaccagatatttccgtgtatatacacagcctagcttttgaaatagcagaattggatatacaaattactatctcactatccatagtggaaagtgttctttctgtaggttgggagcaagtctggcgattggtttaggggcgggtccagtgggctgggtcctgcttgtcttcagtcccaagcttcctgttgtactgtatttgacctgaaactagctgctgatatgacatcatcttgggtgttgctggcacattttttttttcttttctcagtagatgtacacttaattatttttccttttcaaaacataatataggatgggtgcacagtggctcatgcctgtaatcctagcactttgggaggccacctctggaaaattgcttgagcccaggagtttgagaccagcctgggcaatatggtcaaaccctgcctctacaaaaataaaaaataataaaaatagccagatgtggtggcacatacctatagtctcagctactaggaggctgaggtggaaggatctcttgagcctgctgtgagccgtgattatgccactgcagtccagcgtgggccacagagcaagaccctgtctcaaaaaatccgccccccccaaaaccacacaaaggagttttggcttgctttgcataccctataggtatgtctggctctt

SEQ ID NO: 119987 - DNA, 1423 bp, Homo sapiens
gagaaagagccttactctgttgcccaggctggagtgcagtggtgtgatctcaggtcactgcaacctccatctcctgagttcaagcaattctccctgcctcagcctcttgagtagctggaattagaagcacttgccaccatgcctggctaatttttgtatttttagcagagacagggtttcgccatgttggccaggctggtctcgaactcctgacctcaggtgatgcacccgcctcggcctcccaaagtgctggaattacaggcatgagccaccgcgcccggcctcgtacttttcattttagatgcttggtagcattggtttttctggattctggcagtggtcaaatatttttctagagccctggctaggtgcctgtcataccttattttgtctgctgagcagctaaaatttggcggaatcctcctgtactttcccgctcttcacctcaatcctcctgccaggagttttacacacttgggtgtccaactctaatccaaagcaaggaaactatttgcttggatcttgtaattcctgccgtctttgttagttctaactcttctgttgccttctcacagatatcaaaaagcaatagaatttgtccttgccatatttactttttaactaatgtactgtattttacctttgcaccacccactctaagaagacttggtagcctatttgtggcatgcagatatattcacagaaaaacataggggaaggaagaggatgtgagtaggaaacaggagagaattgcatgtggttttgatgagaacttcacctgagaagagcctgctatctttgggctctgtttcatcagttgttggaatccttttcaggccggagcgggcaggaggcaggcctgtttctcatcctcccttccagaagtgaagttaaacgttgatggcagagcattgcatgagagccattgcatggctttcatgatgatcgctttagaacagttgtggacaaactttctgaaataagggaagctatgcatagttaaactttaagtcaatttccaatcagtgctccttgccagtgaagcatttcttataagatgacaagaatggtaagaatatgttttctatgtttgatttcttttatccccaggaacttcaacaactcttataaatcactgattcctatacctttaccttcagtctctttggtctcctaaaatccatgttgctgtttccaaaatttaatactgctttaagtctccatctagctgcctaggaggtatatcacattaaacatgaatgtgttcagagagaatctgttatttttactcaactttttaatcttgtcttctctacctttaaactgctgtctaagtgggaggatgggatccacccttgactcttcctcacagctaattggatcacagagtcttttttattgtatctaaatatccctagaattt

SEQ ID NO: 119988 - DNA, 1002 bp, Homo sapiens
tcagcattttattactgtcctcaggaagtaggaataggaaaaaagaagtaggttggagcaaggaaagttaattatgtgaggttatttgacaggaaattactaaatacaaacagacagaagaaacacattttaaagcaggataggaaatctcaagttactccactctgtgcattcaaaacccccaaagcaaattctgaaaatagcagtttaaacaaaagctatcttatctgataaaagtatttcaaacacaaagggaaatttatatattgggcaggcaatcttaaaataaaccgattttgttgatagcactgcaaatgtaattgtgggaaacccccttctgatgtctgaatttatcttgtagatgttttgaatttggcatttcagttctataaaggtatatgtgtgtgtgtatttcaccttggaaaattatatatatgtgaaataaaatgaaaagtttattatgtttgtgttttttttcagtattacaaaattttgggggagttaggtattattaatagttccagaagactgttacatcagtacagccagagaactgaggtgttctctaaaatctttatttctggaggtcatatattttaaatgttttaattgatgtatttgattaacataatttttttttattgcttttcagccattggcaaaattcgtagaatctttgtaaattatccaaacatatttggtgttgttttaaagactaagtgattaaggagtaggaccttttcctaccctgaatgatttctggttctttaatggcctatgctaaatagtcagtgttgcagacatagaaaggagggtcagaagtggctgttcagtaatctgacccttttaattaaggttgtcatcctaagaaaaaagacccaaataacaaaaaacaccaacaaaatacatacatatatgcataaaggggcacacacacacacacacccatatttatatgtagcttttccaaagaaaaaaggaagaaactttattttctagatc

SEQ ID NO: 119989 - DNA, 1060 bp, Homo sapiens
aagaagtgatattatagtagtcatgtcccagaaaaccaagtcagatggagtggttgttgtctgatgttttttttaaagcttgaattacaaacttaacatagtaaaatgagactaaggaggtgagacctccaatgtccagaccattgcaatgaatctcttttcttgctaaaaacagcatgtagtaaaacctggacttgctattcaaacagttttatctcccgaagtttaagtagataacccagaaagtagagcacaaagtttaattttaacaaagaaaatttagaactggttgggaagtggcaggaacctgggcaaaagtagcattatttcaaaaatcagaatgaaaggaaagaagagtaggcataggatgatgtagacctcagatgccgaatgactaagagattttctattgagtaccatttctcatcgggtgtagctttgccttcagtgctcttttgagaagtcttttgagaccacgtccaaactgcataggtaaagttagtttctatgggtgtttgaataaaaaaatggctttatgtgagctaattctgttctaagccattagaagtgagattcaacctaaagaacctaaagaatacatttgagggccaggtgcggtgggtcacgcctgtaatccctgcactttgagaggccgagatgggtggatcacctgaggtcaggagttcgagaccagcctggccaacatgataaaaccccgctctactaaaaatacaaaaaattagccggatgtggtggcaggcgcctgtaatcccagctacttgggaggctgaggcaggagaattgcttgaacctgggaggcggaggttgcagggcgccgagatcgtgccactgcactccagcctgggcgacagagcgagactccgtctcaaaaaaaaaaaaaaaaaaaaaaaaatatatatatatatatatatatatatatatgaaatatattgagctttttagctgaaatgttgaggtattttttttttctttatcacaagccagagctttcccatccgatgcttatgtcattcatttttttttgatactgggtctcact

SEQ ID NO: 119990 - DNA, 1049 bp, Homo sapiens
aagattattcatatgccacacaatgtatcattttcacatgtagaattcagtggtttttagtatattcacaaaattgcatgactcttcatgatctaaaattccatgatctaatttcagaattttgtcatcacctcagtgagaaaccccatacccattagtaggtgctccccattttcctcttcttcttagtccctggaaaccactaatctactttctgtatctaaggatttgcctgttttgggcattttatgtaaatggaatcatacaatttgtaaccttttgtatctgacttttttcacttagtataaattttcaaggtttgtccatgttcatacatgtggtagcatgaattgccatttcattctcttttatgactgaataatactccattttggaatgcagcatattttgttcattgattcatcagttgagagacatttgaattgtttctactttttgactgtttagaataatgctgctatgaacattcatgtccaagtttttgtgtggatgtatgttttcggtcctcttggttatatatttaggagtgacatttctgggtcatagggtaattctatgcctaacattctgaggaactgccaaactgtcttccaaagtggctgtgcccttttaccttctcaccagcaatgtacgaggtttccaattcctctatatccttcccattactgattattgtcagtcttttaaaatatagccatcctagtggatgcaaagtggttacttatttcctagtctctcttggacatcacttcctttggggaattgttctgaacaccctgaaatcctttctcttcaggctgtgttaaatgtccctgtattagtccattttcacactgttgataaagacatacctgagactgggtaatttataaagaaaaagaggtttgatggactcacagttccatatggctggggaggcctcacaatcatggtggaaggcgaaaggcacttcttacatggcggtgtcaagagagaatgagagaaccaaacaaaaggggtttccctgtataaaaaaccatcaggtcttc

SEQ ID NO: 119991 - DNA, 1048 bp, Homo sapiens
tcagaagtgtgtagtcctgtttaaatacttaaaatttgctatgttctgtattggccaagaaatgttttctggtaagagcttctggtaggaagaggacctaaagctgccctcacaagacgatatttggttcatttgaaatagaaagttttgtttgcttttaatttttatttactgaactgaaaattggaaacagcccattgacttttctatcttatacagcatctcctcctacacatatttagtttcctgctcccttgaaatctgggcgacctactcctgttttcaagttttttctattttattattttggtccttagcatttctgccttttttgtatcttccaactttccatttcaaaagagaaggatcatatttttatatatttacatcccgtttgaatgtgtttaaggaacgcttagaaatgttcctttatgttttaaaatatcccttctgctaaagcaagtagcatatcatttcctgctttagttgcggcctcagtctgacaggccagggctaagtaagggtgaaaagttcaccgtccggaagtgctgttgaggtcagaatcacgtgatgaggagccgacccagactcccggtaattccctgagaatgtgaatctttgggagaaggagcacaagagagagctttttctcaagtcggctgcctgtgctcgggctcttgcttacaattcttagttttatggcactattcttcttcttcttcaaggaactcactgtaatgcctttattattgtctacatcagtgttttaaaaagtaaagttgtaacgcattgctaggttatgcaatcaattgtgtggacagagatcagccttaaaaaataaaaaaggaaacaggaaatgtaaacagagtgcattatatggaataagaatatgtgtattttgtaaaactcttgtttgatacatagatccgtacacatagacacacacaatctcataggtctctattgatttgcgtatgggtacacgctggcaggcgtacattctccttcatcctcattcctagtcatttgaaaactcagtcattcaaaa

SEQ ID NO: 119992 - DNA, 1044 bp, Homo sapiens
agcccattaaatacaatttttagtttgcctggttaatatgggcatgaaaaaaataatataatttaaaataatatatccttaaggttttattctaaacaataatactaataaaaattgctatttagtgaagagctattgtattctatgctgtatatcagacattttacatttattaccttatgtagtacaattactctgcaagggtaagggtttgcacattttggatatgagaaaactgaggctcagacagctttagtacagtgcttaataagtgccaaactggaatttgaatttagatcacctgactgcagagcctcagattttccattatagcacagtgtagctttaaatgatgttttccatttgactttaaaatttttaacttatttagcattatgataaccatgctgagtgacctttaacttgggccatgtcagtgggaattgcttaaataaagctgtgttttattaataagtagagtgatgattgaattggactgctttaaaaatttctaaattaaaaaaaattaccaatgaaaaaagagctgcttttatcaattggtggtcttaagtggagattttgctttatttatctgtttttttacaaatccattaatggtccttttctttaacaccccatcaatcaactcagactctcccattgataagcatacctcactgaaagaaatcaattctcctttgtcattttgacaggaattaactaaaaaggtgggttaatccagaagcaacaggaaaatacctgcaggctacgactaaaacctaattttgtaaaatcaaaattgtcataatatttcacagttggccaggcacggtggctcatgcctgtaatcccagcactttgagaggctgaggcaggtggatccgttgaggtcaggagctcgagatgagcctggccaacatggcgaaaccctgtctccatgaaaaatacaaaaattagccaggcgtggtggtgtgcacctgtaatcccagccactcggaaagctgaggcagaagaatcgcttgagcctgggaggtggaggttgca

SEQ ID NO: 119993 - DNA, 1019 bp, Homo sapiens
agaggtgattacattaaaatgaggccattggggtaagccctcatctaatcatatgaggatgaagaaaagacatcagggatgcttgtgcccaggaggaccaccatgtcaagaggcagtaagagggtggccgtctacagggcaaggagaaagacttcaggagaaactcaccctgctggcactgtgatcttggacttccagcctccagagctgtgggacaatttctgttgtttaagtcctgcagtccgtggtcttttgttacggcagccttagtagactaatacattattcatattttaaaaagttctttatctttacacctgtcataaacatttttgtatctattcactataagtcaattgcaaatgaataataaatggataatgtcatactgagcctgaaagttgcccttttgtgtcagagcgtgctaatgacatttttcaggactccagttttaatgtttaaactatgggagtagctatgtgtaaatatttaaaatgtgacagatagtactatcacttgcagtgattttatacctcctagttgggaggttaaatgagaaaaacctcggtaaagtccttataatgtgtgcctggcataatacttgttagctgtgattattactagtactgtgtttcttatgcttatttcattgcagtttcattttcttaagaggtataggctctaaaatgaatctcatatagtagaccttgggaaaaaggtggcgagttaaatttgtagagaatatagctgtttccactggcctgaggttcaaacagtttagagtgagattgtgagcaccctcttagggacagacacatctctgttctgcctccagctccaacacagttctctgccttttgggattgggcagcagcagcaacagataatgagagacgaatttgtcattccagagctacttttgcctttaggatcacgtctgtgctttttccaggagaaggtagaaaagaaagagaagggagggtttggtggttttgagctatggagacctaactttatgg

SEQ ID NO: 119994 - DNA, 1061 bp, Homo sapiens
tttgtacaaattttgaaaacataatacaataatttaagtcaatagtgggagtaaacttttatagaccacttaggtttaagaaatgatggtcgggtgtgtagcagagcctgccaagcctgggtgagtgctgcaaggagggatcccgggaagggatgggaaaggtggaggaggtcaggatgaaagcgatggatgcttgagaatgaaaaggatggtcattttataggtggctggaatgaataaaggggagctagaaaaggatttcagaaagccctcccaaaatttaaccaacttcacaatttggcctgtagctggctatcttgttaggttattaaataattgaaggtaaacctgacatctctcttctggattacttaaaaaaatgcatttctaaagcaattcattttgaaaattggggtcagtgacctctacaaatcaaggtaaaatggtgccagaccctttttatttagccattggtcagtctgtcgcttgcacaaaaagcaaatggagtgaacaacagttagacggggaggtggaggggggacaggcaggtagtcagagagccgaccctcctgcctcatatattttggtggcgcctcatgctaatgctgagtttgtgtgcttaaatggtactgagataaaactattttttgtatcctttatagttcttcattcacaaatcctacttttagatggattcaaagatgaaccagttttacatgaaattcagggaaagggagttgtatcccctagtttcttctgcggttgacagagcgggaaaggaacttgagctaaatgaccttaaaatctgttaagagattttagtttaatggaagtataaccctccctaaatctgaataaaaatgccagaatcttttcaaagtgaacataggttggaaagttaacatattggtgattatctcaatgaaatattactacatagaaataatgacagcatgaactaaagcatgggatgttatgatttctgggcccttgggcacgttagtagacagttgtcagtcttcactgaacattggtaatagttgcttgtaaactctgacctt

SEQ ID NO: 119995 - DNA, 1517 bp, Homo sapiens
acaggtcattagaccagaccagaagcgagctgtgatgataacacaggctgtgggcaggcaggcaccatgaggcacagtgagagcaccaagactgtgggctttgggtttgaatcctggctccactactaatcagccctgtgcaagtgactcagcctctcttaacctcatttattttctgtaaaaatgggaattgtagatttatatttatggagattattaagataatctgtgtaaaatacttagtccacagtacctgacaaatattaaattctgaggaaatattaattgctattattactacttcagctctgaaaatgctgttttcttgacagtaaatggctgttttgtttatttctgccagtagcaaagtaatatattgattgtttaatgccttcttggcctctttgaaaatgtttaaaattatgtttaccttttctttatatcattgcaggttttgtgtgtgtgtgtgtgtgtgtgtgtatgtgtgtgtgtgtgtgtgtgagagtgagtgcgttttgggaggccagtaattaccctgtgcagatggagctgcccaaacagtctttcccatggcaactgaaaaaataaaaaataaaagcaaaaactttgaggttacataattgccttcaatagactaggaggagtgtagagatcatgactttttttgtgggttttggtgttcttttggtgtaaggtgttgggtgaaggtacagaggtcctactgagtaactgaacaggatgctgttgcttgctttgaagtgaataaattggtcaaaagtacaagtgggaggggaagttgaggtttaatgaaggagggccattattaatgtttccatggttttagcagtttaaaagttgggagtttaaataatgttgttagttgtggggaaaacagcccacagacattcagacatagttgaagtttagtctttcagtcttcattttaatctgaaggtagggagccgagccttctgaatcacacagcaaagggattgcttcgtaattttaacagtctgaattattgcatgctcataatggcataagatttgcatagctccaccactctcatcaaatcccaattatctgaagattgtttctcttgggaggcaaaagaatattataatttttgggtttcttttaatcttccaaaatgatttatattcatccccttaaaacctgggtgtaaccaaaggcactagggcccaaagaacaggtgttgtctttccagaacatccataaaaggatccctgtatacattctctttgcacctcttgtgtaggggttaacatggaaggcttcattatttgactggaaagtaggtttgactttcccactggagatttgatactcttagctccagaaccaagaaagagaagactattagactttccttgcccaccaccccctccccaaccctgccaaatgtatgctaagcctatatttgttttatttccaaccaatttgttggaaataaattggttatttatttccttattggtttttctctccagagaccc

SEQ ID NO: 119996 - DNA, 1721 bp, Homo sapiens
tacttaaaaatgcttccagccaggcatggtggctcatgcctgtaatcccagcactgaggcaggaggatggcttgagcccaggagtttgagaccaggctgaccaccatggtaaaaccctgtctctacaaaaaatacagaaattagccaggcatggtggcatgtacctgtagtctcagctactcaggaggctgaggtgagagaattgcttgagcccagggaggttgaggctgcagtgagctgtgctcaaaacaaaacaaaacaaaacaaaacagctcccgttctaccactcctaaaatccatatcatatatcaaaaaaggaagtttgatacctgaaatgactcttggcagggcttctcaacctctgttccctggtatttggggctgtatcattcagtgttgtggggagctgtccagtgcattgcagaatatatagtagcacccctggcctctacccagtagattccagtagcatgattcctctccccagctgtggcaaccagaaatgttctgtgggggaccaatttgcccccagttgaaaaccattgttttggggattgattcaacaaaggaaaagaaggtaaagaaaatggtaaagatgtcacgtatggagctttgtttttgttgtttgttaattttgtcatattaccctgtgaatttccaaagaaagtaaatcgtaagacaatgaggtctgccactagaactcccatttagccaccagttctctctccattgttgactggaatttagtttggattaatacaacaattgcaactcacaacaagtattgactttgatgctgtcattatcaactgaggaactccaggttttatattaaacacgcagaactttctatgaagtggccattttgatcactgggtgttttcacagggctggcttattgggggaaaaagagggagtggttggagaaaaagactcaaataaggctaatgcaagactttaataactgaatgtatgagttgaatgaagaaacacgcctactctacactgtaattcagcagttttatgaatgggaggtcagatacatgatttaaatacaggtttcattgaatgcagtatcttttacggtactaaaaaaggtctggaatcctgcattcttcctgtataggattgtaattcattctctctgctctcactctccttccaaatttacttctacctctgtcatagaatgtttgagctgccagacaagtaggatcatgtcactgctgtgacttaacattaaatgtcctggtgtctttatttcagatgttctgtttttcctctattttctgctcacatgaacatacacacttgccaggcacattctggcttttcttatttctctttctgattttgcctccttcctgcccctgttttcttcccttttctctggctatagaaactgtcaggtggccttgctggcatcatcctacctcttttgaactgtgttacccaggaacttccatttattatgcctcgagcactctctttctttaatactgtatctctctgagggatagttaatgatctttgcagcaaatgaaggtgaactgtagccacattattgttagaatacagccaactatatggaacagattgggctgagctttgaacagctggggctggcagagtgagtcttgacttctctcggaagagttccagaactgccaaatcatcaaacttgaaggggaaagagggacgagaaaggttatggggatagt

SEQ ID NO: 119997 - DNA, 1130 bp, Homo sapiens
tttttcagcctttccttgttttaatgagcttaacagttttgaggcgtgctggtcagatattttgtagaatgtccttcaactgaaattcatctcatgattggacttggttatgggttttttcagaggaagaccacagaggtgaagcaccattctccaccatcatatcaagagtacctatgatcaccatgacgtatcactatagatgttgatcttgataacctggctgaggtcatggtgccaagtctcttcactgcaaatttgccttcccccgactttttcccatactgcactctttggaatgaaattactaagcacatgtcatagggttattttaaggtttaagtgagatgatgaagcttgtggtataaaacccagtgctttagaaaacactcatgaatgtcagttgctactgtagttgctgcctttacactagtccctttcaatacatgaaagctagtattctttagagctgctttctcataattatacagttctcagccatttgctgatattgatcagaaagtaaaaataacaaaaaagagtgctcacacacctttcaaacgagatgcctgtatacaaagtcactctaggatggaaggatacgaattctctcaaagtttaccatggagagactctactaaactgggattatcagcctctggtcctgtttcatgtgatggagtcagtcattgatgacagagctggtgggttctggttggtcttgggcatgagagggagaaagaaagtttaatttaggagctgagcctgaaaaattggtgaggtttttttttttcttcctctggtgatagcttttgggtagaattttgagttcttactggaataaacgatcttcagcacttctctgtgaaatgaagggcttgttctgggacctgaaatgcttcaaaccctgtgcagttgttgccagagtggctgtctgagcctggataatagagcctggagtcctatgtaaccatgtctgttggaataaataagaacagctggtcgcttgtacagatactgttggcatgaattttttatttaagtctctccatgtatctagtaaacagtaagcagtattctaacattactaaaagcctcctaagtctcccaccaataaatttccttcactc

SEQ ID NO: 119998 - DNA, 1164 bp, Homo sapiens
tattccttttaatttaaagccacctgaaggcttcagctgaataataaagtaattcccatatggtttccgttctttcagtgttagaacctctgaaatgcagtctacttttagccttggcttctgcatgcctctttgtcaggctgaaatgcttcccgtctgcttgctctggtaggaaatggaaccaaagccgactgctctgggggacgagttcccaggctttgctttctatttggcaaacgtggctcatgtgatgggaggcacttctcctccagggcactcttgactctctgacagacaggaccagctctgaaggtggctgcaagttttcattaatgccagagctcgctataggcacttttctccctcccttacaattctgtttacaataaactttccctcaaaggaaaaacccaggattcatatgagtttcgttgttttccctggaaagaagtttttgtaaccctcagactctttagaagggaaaacatccagtaaatcctgaaatctgactgcagagttatttttcattatttgtactttcattaattcaaattccaccaaaaaacttttctctttttcctgccctgtgtaagtttactttcccccctgtgttcatatgagttcatgaaatacttaggaagtatatgaaaaatgtttcagaaacacagttgtgttatatgatgcttacccaaatcctgctgaagtaagtgaaaagacattccctctccctaccccttctttttctccccttctctctcctaactttctgtgttcagagtcaatgcaaagggccttcatttttaatgttaattttaaaaataactagttttcttttgaggtaaacttagggaaagcatatgtgtttggagatatatatctccatatataaatatttacatttacatttacatttggagctcaagtttttcattttatttttcaaacatgttgaattaaactagctaaggactggaaacccaccatgactatttgctgtgggttgtatgatcactattctggcttgaatttttgaacttctacagcaacatctttaaagtgccatgagataactttgctgttgctcaaaaagaagctctttaggaagtcggaaaacaggaattctggtgctactttatggtgataatgtcactaactttgtacctt

SEQ ID NO: 119999 - DNA, 1035 bp, Homo sapiens
atcaagtcgtattaagcacctaatgggtttaaaacataatgcgatcccctagtgagtccttgtggcatcagtgggacattattagcttaaaattcagcagttttaaaaatgtagattttaaaaaatcagattcacctaaaacggagatcatttatagaaagaaaaaaacacaaaggtcttctgttgaactgttcagtaagtgtgtactgatacaataatatggcaggatattgggtttccaactcagagttgatagttcagaattaaattttggcctatgtcttgctttttagctttttaagccattctgacgctaccatagacatgcccatctggtagatgagaaattcaggtgtagaaagacttgcagaaatcttatgagatgctctttctttgttcctgttctctttctctgaaccagctcctaacttacatctttgtagtcccaccattaatcctacctttgaccttccgggctcaatttttacagttagtcttaccagtgtttcacacttagttttccctaagtaactcttgctgtctgggtaggacagcatgagtcctgtcccataagacccaacctgcatctgctttctcggacatgtttttttaaaagcaaatatgctagtggagtgtgttatttacaatgcctttttcttagagatttctctggaggtttatatgggctaatggctccccacccacttgactttttgcccattacattatatgtttcttccaaggaacaaaaatataactctctttctctgacagcatgagggacattctcttgctgttgctctccaggaaaaatctcataatctaactagacaaacccttgctgaaaaattagaccaaatggcatttgtaaactccaaggaaagcatttttcttctgtgaagtgttccctagctggaagtgttagaaactttacatatactgataccaattaggtttatggaaaaaatgaaaagctataaacagctggatacactgtcaaaactgaaccctgtcaacttaattttttccctagct

SEQ ID NO: 120000 - DNA, 1050 bp, Homo sapiens
actgccttttgtctagggtatatatttgctttgcaaaagttgcttttgctatggaaacacaacatacacttagctttagctcaagaatttactattccctttatgtcttaaggcttttgtttaatacatgagctgacttatcctagtttcctgtttatgtaaagtatgcttctgatgaaaatatacactactagaaacttataaagggttgctgttttattagtttaataacattgttaaaatttactgatgtgtcattgagaaaaaacaacttcaagtgaggacaacacacacacacacacacacatctttaactgatttttttcttcgagagtatattgtacttagcacactatatacttagtgcatggaatataaacatcactttgcttatttttattgttggcaaaagatacaatatctgttttacacaattaaaagaccttgaaattatgcatgatttttattactactgggatttccatgttggatcaaaggtcatcattccaatcgtctcaggctccctttttttcttctaattgatcattgcagtgcccatctgtctgtggctcacggtataaccttttttgataggggcagggtggcagatggacagcagatgggagttttgccctgcctcgtggttcagatcttggcccaggcacgaactgtcagagactgtcagtttgtcgtctcggcttgtgggctccagtgctgtgtttggcacctcagccatgggtctgaattgatgccaagctggaccagctatttgtcattgtgactagttaatgaccaacattaagggtgggagcacctagtgagtgtgtaagataacctagtagaattgtgctttctactgtgagctggatccccaggacccgagagtcagctcattctcgggatagaagttacagaattagaaacatgtaggtgtcttataggtatttacccactttaaaaagaacacaatttccccaaagatttcctttctatacaaaaccacatgaggacatgagtgaaaagtagaggtagatagacagtggcttgtgt

SEQ ID NO: 120001 - DNA, 1059 bp, Homo sapiens
aaaaactaatgtgtcttcagacttctgcttgtatgtggctcatgttatatctgagcgtatgctactggacaaagtgagtcacatagccaaggcttacaatgggatggggaagcatacttcatttctgtgaaggcactctaagtcacatggcatcagtggggtcatcttgttcttttatagtgaagaggggagtaaataatagaggacaataatacagtccaccaaagatactgaggccaattatatccaaaaagcaagatcagtttggtggaatgacttactaatgcactgagatgcccatatgcccatattccctgccaaacagtctaaatggaaaactagaatcctaattaaaatgagaaaaggcgtgtcacaaagcttcctttattgtagagcagttgagttgtgatgttcgttactagattttttttattagcctgttgttagttgtatgtatgccttctatttattaagcacttattatgagccaagcatagtagtaaacctttttctgaccttatttaaacctatcaacagtctcaagttggaactaggtctctttccatttacagataaaaatattaaaggacagaataactaagcaacttgcccaaagtcacaggtccctgctcttatctgctatattttctttctctatttttctttttcgtgtaatacagaaagcccatgatcatcctgatgcctcctctgtgtggatatcgcaggaatggcaacttacgaccttatgaagtagtttattctaatttagggtagctcaaattactagaacaaatatttaatgggcctttaatcttctacccctaaaattttttccagttggttctagttttatcttatggagctaaatgtatggaaaatgattcaaagaaccttccttcaagtagtagaaatcatcttctagattttatctttcccaatctaaaaatacattgttgtttcaacaattccatgaataacatggattgtggatttttatcatcctggttacttttctcttggactgccaaacatttaagtgcggaacaagaactgtctgca

SEQ ID NO: 120002 - DNA, 1053 bp, Homo sapiens
tcaaaaatggaggatgaaagcgaaatcagagagtaaaaataattttataaatgtatgtttattctctgtggaggcccttgatttattaaagcactaatctattgtctgctccttgattgacctagaagagttaacctatgatttccaaaataggttattcagaaatagagtacatatttctgaaaaagaaaagaaagggaggaaggaaggaaggaggggaggaaggaagggaggagggaaggagggaaggaaggaaggaaggaaggaaggaaggaaggaaggaaggaaggagggaaggaaggaaaaaaggaaggaaggaaggaaagaaggaaggaaggagggaacaagggagggagggaggggaagcaaggaaggaaggaaggggaatggaagggaagggaagaaggaaggaaggagggaaggaaggaaggaaggaagggaggaaaagaaagaaaaaagcactggtttccaattctaaactagccctttattgtaattataaacccatatactgaaatctcagagaaatgatttctagcattttggggtttttgaaaagttattatttgtatattttccccaccatggattcagctcagtttaattctattcaatccacccaatttgctgcagtgcagttcttcattattggatatctattccgtgctaagtaaagaatgcctgtggagtctgacctctacattcaagaacaagaaatcaacactcttccttctcctcagccccacctaaacatgctttaggtcaggtgtttaaatttttttatttttaaaaaataaagtgaattaaagaaaaaatttaagtcattacattctttgagaatctttgagatttcatggcactgtccctttcttcttgttccacatcttatgagctggtgtcttctttcacatgttaaaatgtatcgtttgaaatttggctcgggaggttttctaggttaacatgtagcagagcccagtagttcatgtgaaggctccttcagggaggaagccagaagcatggtacttacgaattcgctgaacatttctgaggaga

SEQ ID NO: 120003 - DNA, 1037 bp, Homo sapiens
cctttatattactgtgtgtggtctcctgcactcatcaacagatatgtatacatggtgactgaacaaaaacataccctttcccacccccacctctctctaccacacaaaacaattctaactgaggggatattgctggagtagtacagcagctaagagggaagattcaatgtgttacaaaaacatcacaaggattggcattttctacttccaaaaggtgtttttacctaaaaactttccttctgtgttgtcaaaataccttaattagaagttgactatcagaaaatgaccttgcagcttttcttttttttttttttttttttaacattccttcaatcagccttttcaacattcagtgattaaccaaaaagtattttaaacaaatgggaatagttagatcagtgctaaatatgccaccaacacaaatattactaattgtatgaatatctctacagcttagggactgtggtaaactgaaaaagatcagatcatcttaatgattctgcattgaagcaatgggaaaggaaaatagggttgatgttttgactgtaagttaccattcactagaacacagaagtaattcccagtgtatctagttataagaatgaatcttactgcagaggaggttgaaatgtatcatatccatctgtttctttggacagaaagacttcttgttatacaacaagtgatctgacagcagcaagaacattgagaaactagccactgtggaaaaaaagaaccatcattaaaaaaaaataaggccaaattatctcccaaatttattgggggaaaaaaaaatctttggttaaagaaaacagatttgccatggggaagtgttagtctatatttggaataaaatattagtaaaatatgaatttaaacatttgccagactgtgtaaatggagagttgaagaaattctcagggcctggagaattttaagggtgcagaacaatctttatcggttgtccacaaagattaccttctgcatatgaaaatgcaagactccacttcattagtctatagagatgctttttcttt

SEQ ID NO: 120004 - DNA, 1052 bp, Homo sapiens
aagatctttgctctcagggcgtgaacattctcctgagggagacacacagcaaacctggacatagatgcagaaataaggaaaggtctgacaacagcgatgctgagaagggaatgtgggaggaaagggacctggcacccagcaacatctcttctcatcgctcccatttctgcatttggaattctgcctggatggaaggcaggccatggggcagacaacgtgggccttccataagcctccttttctgtgcatttttgcccttcagtagtgactctttccagtttctcttaggactctgctttgtcccttattgttattgagtggagcatggcctatgcagactctttggtgatttaaatgggctaggtagagccttaagacagaaaatgaagatagtggtagaagataatttttaaaaggataaggagctagtacttttgcatttaaatgaattccaggactagttcttttagtgaaaaagctataaatccctaatacttagtaatttttctgtgtttgcttctacctcagggcctttgcactggcattccctctgtctggaacagtctcccctctgatatccaatcctcaagcttttcgagtttttgttatgttttgttttgttttgttttgagacagagtattgctttattgcccaggctggagtacagtggcacaatcctagctcactgcagcctcgaactcccgggctcaagcaatccttgcacctcagcctatcaagtagctgggaccagaggtgtgcgccaccacactcagctaattatatttatttttttgtagtggcggggtctcactgtgttgcccaggctggtcttgaactcctgcgctcaagtgattcacccacctcagcctcccaaaatgctgggattataggcttgagccaccacacctggctctcgagtctttatttaagggttgttgttttcaattactactgtattgagaattagaccctctttctagcacttcatggcacttacatgataataatcctgttccttgtcactctccattggccgcctccttcccaaatg

SEQ ID NO: 120005 - DNA, 1002 bp, Homo sapiens
agggtcagcagtaaatacattttttttttttttttttagacagagtctcttttgagcaatctctgttcactgcaacctcccctcccaagttcaagcagttcttatgcctcagcctcctgagtagctgggactacaagtgtgtgccaccacgcctggctaatttttgtattattagttgagatggggtttcaccatgttggccaggctggtctcaaactcctgacctcaagagatccacctgctcggcctcccaaagtgctgggattacaggtgtgagccaccatgcccagtcttgcagtaaagataatttttactctcttttccacatttatatttaaaaaatttagtagtctgttttgggtttcctcttcttttatcagttcttcctcatctgctattgatatccatcaataactctcaataaccagtcacaagagaaatataagcaagaagagagagcagaaggtcaagctcacctaattcaaagggatctatcagtgaataagtgtgctatctgtacttcagagaaatgctgcctcaaaagtaagaccacagtgaaaatcttcccagagagtagcagccttcttcttggataagccatccttctgaatcctcttgaatacattgagataggtatattctctcagggagaacgtggatcaaccttgtttcttcttagtggggtggagaattttagaagtaccaggagaggaagagagaaaggaagagagtgaaactgcaaaactttgccttgctgaaaagtttgtgggaacccgggttgtacttcaggtcagttactcaggtgaatgtccttaagattttgaatatcattattaaaatttcacatttcagtttaatcattaggcataatctctaatgaaacatactataggatttcctacttaaaggctttggttgggaacgggattctagacattaaatggattctagatattaattgggattccaggcattaattattaaccttattgcaggaaggca

SEQ ID NO: 120006 - DNA, 1046 bp, Homo sapiens
ggtttaatgaagacagttttcttagcttctgaccgtggtaactcatctccttgtatttatgacttcccaatcctctctttgcttcctcgtgtcccacctctcagtccagtttcacatctcattatatcttctaagtcctaagttgatttaccagctcctttctttcctctttaccttaagcagcctgtgggagtcctctgtcctcatgcagttggagacctctgattctgcatgtgtgatgcctttaccagcacttactcttgcccctacccttctgctttactgaatgtgatttctgcttcctctcttcttgttttcctaccttgtcctctctgcttccatgttattgaatgcctatacaatgcagtgggcagagtaagcaaaatgattaagacatgcatgacctctcacatccaggaatttatagtcttgctgaaaagacagatgagcatctctagtactacatcataagtgattcgatttagtaaatatagtttgcattgagccatttagttcaagtgcttctggctttatcatgttgcagcaaagccatttgtggacccttcaaatggaagcgtccttctgctttgacctggcattgtagatctcactcttcattcctgcacctcatgtctcatccatgtagtacatccttcaaataatgacattcttttttttccataaccattcaaggtggaattaatgacattcttaaatagatatttagagtacaaatctgttttactgtgtaaggggctttggtacatgttatatagagaggggaagagcaggcagcttgactttggagcacttagatgggctgggaactgtgctaggcactaggcataaaatggatacttcactgctcttgctctttgggagttcagcgtgtaggagaagagacagagaagtaaactagctatgattatctagtggcaggtggctgtgctagaggtgtgctcagaggactgaggaagtgcagattggattagggttgtgggtcagccagtttgaaatggtttaaaatataatagacccttttgttt

SEQ ID NO: 120007 - DNA, 1051 bp, Homo sapiens
ataagataatgtatcacacgtatttttagagaaagaaggctgttggggcaaaatgttaacaaaggtgactctaggtgaaagctctatgggaattggttgtaatattcttgcaacttctttgtaggctttttttttttttccaaaaaaaaaaaaagtcttgataaaaaggtgtgccggccgggcgtggtggctcacgcctgtaattccaacactttgggaggccgaggtgggcagatcatgaggtcaggagattgagaccatcctggctaacacagtgaaaccccatctctactaaaaatacaaaaaattagccaggcctggtggtgggcgcctgtagtcccagctacttgggaggctgaggcaggagaatggcatgaacccaggaggcggagcttgcagtgagcctggatcatgccactgcactccagcctggcagacagagtgagactccatctcaaaaaaaaaaaaaaaaaggtgtgcctattctgagccagacttcctaaattccaatctcactctgcctcttattgactaggtggccttggacaagttacaataacatctttgtgccttagttttctcatctgaaaactgagcataacctaccatatagaattgttatgaggattaaattaactcatatatagaaagcccttaaactagtgcctcacatatagtaagcctcaaatatatttcattaggattatttaggcttgttaacataagagcttttctttataaactatataaaattaaataacccccagaattgcgtttaaaagttaccactgttattcattgttctggaagagttggccaatttagttaagaatacaaaatcagggccaggcacggtggctcacgcctgtaatcccaacactttgggaggctgaggtgggcatatcatttgaggtcaggagttttagaccagcctgaccaacatggtgaaaccccgtctctactaaaaaacaaaaaaattagccaggcgtggtggtgcacgcctgtagtcccagctactcaggaggctgaggcaggagaatcgcttgaacct

SEQ ID NO: 120008 - DNA, 1098 bp, Homo sapiens
tgggaacatggccacaagagccaccacaatcaggaaagggcaaagagagctattgcttttcacctgataactgtaatttgttcgtcttcccagtccagtgcagtctaccagtcaatggtcatttttaccataaggattgttacctagtaacaacacaactgatactcctttatcaactttctagaggaaccaagatagaaagttaaacccaggtctgatttttcctatcaaaggaaaaaaggattttaaaaaaacccttaactcataactggatttaatctaaagaaggtcagtaatggtttatatttgcatttcaacattttggggatattacttacaataccataaattcttaactaaattagcaataccataagtagcattctaatttgaaagaaaatcataatttgttttattctctattttcagacaaaatttgacaaacagggaaacgttacttcttttggtgagtgattagcattctaaatcattttttaaacatttaatgagtgaatctgatagaaatcaagaaattgtagtattttgagtaaaatattctttgcatatacaggtgtgttgaaagagatctttcttcagcatttgtccatcagtcttaattggagctggcaatactcagactgtgtgtattctcccagaattgttttcttctagcaggagccactttttgctctaacaggctattgaaggaatatttgggagagcagaggctggtgtagaactggagcccagagacacactctttttctcttttgtctctcttgttggcgtccctttcactgccctcattcattctcctgaagcatgtttaaggcagagtcacataataccactgacattgcagtgggtgacaaaagatgaacagggccatgtcactgcatggcagccacatggaactctgctgctgatggctctctgtggacagctactttaaaaagtgagactaggcattactttacagtgtgacttcagatgtgagtttcacatctcccttgagaatgaatcagtctcaggtaataaattcagcttttctcatttttgtattagtctaagaacaaagaaaatcaagcttatctgttc

SEQ ID NO: 120009 - DNA, 1058 bp, Homo sapiens
ggttttttgtgggtgtttttgagacggggtttcactccgttgcccaggctggagtgcagtggtgcagtctcagctcactgcagccttaaccttcagcaatcctcccacctccaccacccaagtagctgggactgcaggcacatgccaccatgcccagctaattttctaaatttttttgtagagacaagatctcactgttgtccaggagggtctcaaactcctgagctcaagcaatcctcctgccttggcctcctaaagtgctaggattacaggcgtgacaccatgcctggccaaattgattcttaatttgcctggtaaatactcaactttttttttttttttaaataagtcattgtttagcatgaatgtataagataatatatttgataagatactctaaaaacactattatgaaatgttcttataagtttattctattgatcatttttgtgtatctatttcttatagtctatcagagttagaaacagatattaaaattttcaaagagtcaattttggagatcttggatgaggaagagttgctagaagagctctgtgtatcaaaatggagtgacccacaagtcttgtaagtatataattatactttgttatttatttccttagagtaaatcttttgccttttccacttcaaggtgatttttcatacagaatgtaacatttttctggactacagaatatagagatttttcatccccagtttcccttttttcctgtgcagtatcgtatctaattcaatgtaattctatgagtatgcatactgcatacccaacactgctgacatgtggtgaatataaacacacagttacctttatattcaagggactgaccaccagattggcatatacatctaccaaaataacttacctaggaagcagagtgggagagaaatttacatgggggagggaaaagatggggtaaatacacgagtaacacattaacatggattatgtaagttcagtctaatgaaaatgttaatcttataaaccttttatcttttatgaatttagaaattgtttatgcttcttgtgcacactccag

SEQ ID NO: 120010 - DNA, 1452 bp, Homo sapiens
ctatataacatttggtagatagccgataggtatggtagcagaaactgtttgctttgcttaggccaatctgtcaatctgtctctaatatgctttatgatacaggtacctcttcagagtacttcattcccccttacccttcttggtagggtaggggagcaaagttattactgatatcattcaaaaacattttctttatatgaaatcacattatgtacacacctcaaaaggaaatggtcttgacatttttagttgtggattttgttttacctgatagtggtattggctttgcactaattcatctgcattcacatatctggattttcctgtaactggcagcatgtatctgcataaaaatctcttggattggggccatgtaatacagtgacaccaactggtctacataaggatggaacctctgtcctcaactcatctgtaaagtgttttggatcagttgacataggtactcacagattggccacaacaatagaaaagacaaaggcagccaggcgctgtggctcatgcctgtaatcccagcactttgggaagccgaggcaggcagatcacaaggtcaggagttcgagaccagcctgtccaatatggtgaaaccccatctctactaaaaatacaaaaattagctgggcgtggtggcgggcacctgtagtcccagctactggggaggctgaagcaggagaacagcttgaacctgggaggcagaggttgcagtgagccgagatcgcgccactacactccagcctgggagcagagtgaaactccatctcaaaaaaaaaaaaagacaagacaagacaaaggctagcttttccactggtagctgaatgctatatactaatttaggaagtttttgtcactaagtatatgatacacatgttgggagtatgttaattattttctcttttaattgaagtgaaaagagcagtgctgggattgaccatgcagaagagatggagttgctgttggaaaactactaccgattggctgacgatctctccaatgcagctcgtgagcttagggtgctgattgatgattcacaaagtattattttcattaatctggacaggtaagaaagcattatataaaactaagtttttttaataaaataattataagaaagtttttaaggaaatattttgtgaggaattacgccatcattatcatctatactacattattattattttttttgttgtgtaggtttcatccatgtggtctgtatagatttgatgaatgtgctgtatatagttagtgggcccttctaatctgaataggtgttctcctctccagccaccgaaacgtgatgatgaggttgaatctacagctgaccatgggaaccttctctctttcgctctttggactaatgggagttgcttttggaatgaatttggaatcttcccttgaagaggtgagaatgtattattatttctaaaacttgggggt

SEQ ID NO: 120011 - DNA, 1093 bp, Homo sapiens
aaaatagcctcagactggatggacttggatcaggaaggagcatcctaacaaaccgttaggaacagccccgtggatactgaagttttttttatggtagttacaggaaacttctgatactctttttattattttcttgtatagagtcagacacttgaaaaaaactaatgtttgaagacaaaaatattttggcagtcacaataccagaactggattgcatttccagaattctgagttaaagaaacaaagtatttgctttgtaaaaggccaaaattctatttcctacaaactttaaatgctgtttttatagatgtgatatgaggcaacacaagcacagacagttgcatagattttaatttatacatatcaagaaaagtgcaatttcatgctgaatgaagcgtaggaacttgacaagcccataggtagctatagttctttgtcagtatagggaattatgttcatgtgaatttcctgattctcaggtgactaaaaagctagcattctatgtattaaccttacaacagactctgtaagtttgagctttaaaaaccaaactttgacataaccttatttcttgtatttgcccccttttttttataaaaggtgaataaaaagaaataatttaatatcaccattgtatggattcctaatcaagatttcacgttctcagcccctgagactagttttctttgctctctgtaattagagcctttggaagcaaagttgaaaggaagtatttccattctgttactgttttgtagcactttgtccatttattgatttttaaagtagatatttagataccacccctgccctgccccaaaaagaaaaatgtttattgtcctgctaatctatatgcctacacctcagaagctgacagatgagcttcctaaaacatgaggatgaataaatgttagaactgtgatatcttctcatttccacagagatttgggtttaaaacaaatggctaatatttgtaagcctgaaagctgccatcctctttaacatcctacctaccttttaaaatattttctggaggttaagtacagttaggcactagaacatttgttaagcctcccaaagtagtgtgcatgga

SEQ ID NO: 120012 - DNA, 2096 bp, Homo sapiens
tgggaagccattagagggaagctgcagaacagaatggaacaggacaggctgggctagactcgagcacgcagtggcccctgtgccaccacactgtgggtcaggaacacgcgtcatggtgttcttgtcggaatgtgaacatacagcaccctctagcattacgaatctcttaggatttttaagattgtatttgataatacttatatttcacagggcacacttttggcacacctcagagcacactgctgctattttgggtcgtatcactgtaaaatacataataagtactacttaactgtgacatgaagaattggaatcccagagggcaacatttgatttgactaagatcaggcataagatagaatttttgtcatttttccttgcagttttattgacttagtttatgagcttggataaaataattttttgatgaatcatgtcaataaaaggaaaaataatgtaactacctcataagtctgataaaaggaagttgctagtgttttatagaatttctgaaggtggttaaatcaagtatgatttcaaaatatcaactagttccacttttgtgattgcaggatgcttcttatactaaagttctcataaataataaatcagcttatgccaaaaatatatgaagttccttggttttaaattttgaactaaaatggactgagcacattaattactgtttgaaagtaggtaccaaacactgggttatgtgagtgagtaagcaatcatatcgcctgtcaaacacatcaagtgtcgaacacgtcaaggtgtgatactgtctttggaaggctcctaaacaaatgtgagcacaattattaacaccttattcttcatgaacacagactgttaagcagcactaaccaattttatattaaaaagctatttattttggtgagttattccaagagttgtatacagctttattttttggaattgcaatattaaagttgcacgttggatttaactctcatgactttagtaatacctacagaggtgagctaatggatggtacatggagtagggactgcagagaccctagttttgtccccactccatcttcaaataattttggtctcttaggtctgtgatacaaaggcataaaacaattcctatcttgaagccttgagaaaagctgttacatatacgcagatagtagcaagacagaaaatgcaaatatgtaaatgtcttctgatatcttgaaataaagataaatttcagttaaacttgtataagttcagatttctgttaatgagaaattacaaccctacaaggtaaggtctttacattttagttattaagcagaatcaatgcttaaaactatagttaatacttagtggaaagaaaatttaatccatgtatcaggataatatattagactgtcatgcattaattttttcctgtatgccaggttttttacatacgtgccatatcagttgaccttttacagtaggagtataatttacattgtttttgacattggggttagtatggttaaatgtcctataaacttgaagcttgcttccatttttgtgggtcttaacctccacctggtgcttgctattgggtgtattcaggcattgagaaaaatataaatcgtgaggtaaataatggtcatgtttaaacagaggccttatcatttagtgaagcataaaaactgacactatataaatgcatccgtctaatgaaaagacccagtactgagaaaaacatccctttactcaagtgtcagatgtcagagtgctctaactgctcaactcataagtgaatacaactaagtaatttctggtcccctaaaaataaccatccttttaattaaaagtaattcttcagataggttgggctaccaataattgtccctaaacaaaaccaaatggcgcttccttgtgcttttgctgtgccataggttactatgcagctagcacatgtacctcttccagaaaaatgaggtcatcctgggagtgacccagagatgctctctagggatgtacctcttgatgttcttgttaactttccactcttcagctggattcctcttcctgtccccttttcaccagtctctactcttgagagaagctgagaagagaagggct

SEQ ID NO: 120013 - DNA, 1706 bp, Homo sapiens
ccatagcaaagtaccacagactgggtggcctgaacaacagacatttctcattttaccgctctggagggtagaaatcccagatcgaggtgttgtcagagttggtttcttctaaggcctctcattggcttgcagagagctcagcttttgtctttgtatctcatcagacctcaattttagactcatggagtctgagatgtctgttcacgcccaagtgaggatgtaaagtaagcagttggttatatgaatgaatcttccctgtgtgtctccacatggtctttcctctgtgtgtatatgtgtcctaatctcttcttcttttaaaaacaggagtcagattggattggggcccaccagaatgacctcatcataacttaattccctttttaaagaccctatttccaaatgcactcacattctgagatactggggggttaggacttcgacatgtcaattttgccaggagcaccattcagcccgtaacatcagggtaggtctcattgaggacatgagatacaaagaccaaaggaggtaagtgtgtccggagttggttcctgccggtaggtttgtggcctcgctgacttcaaaaatggagccgcggacctttgcagtgagtgttacagctcttaaagatggcatggacccaaagaatgagtggtagcaacatttattgtgaagagcaaaagaagaaagcttccacagcgcggaaggggacccgagtgggttgtcgctgctgggtgggtggggcgtggtggccagctttttattcccttatttatcccttccagtgttccgtttctgtcccatcagaatgcctttttttcaatcctccctgcgattggctacttttaggatcctgctgattggtgcgttttacagagcgctgattggtgcattttacagagcgttgattggtgtattttacaatcctcttgctagctacagagcgctgattggtgtgttttttacagagcactgattggtgcattttacaatctccttggtagctccagatcgctgattggtgcattttacaatcctcttgctagctacagggtgctgattggtgtgttttacagggcgctggttggtgcattttacaatcctcttgtaagacagaaaagttctccaagtccccactcgacccaggaagtccagctggcttcacctctcataaggacattcagctagagccaaagtagaagcatggctgacacatttgcagaacagcaaggaggcccgtgtggactgagcaaaggggaagagttgtatcagaggaggtcatagggagaaggggaagagtgggtggaacatgtaggacctgtgagttattctaaggacttggtttttactttgagtaaagagggggctgtgtcagggttttaagcagagatatgatctgatttacattttgaaaggccactctaaccacagtgctgagaatagatgaagagtggtggaagcagagagacaggttaggaggttgttgcacggatttaggtgggaggccacggtggcttgaaccagggtggtagcagtggacaaggtgaagagttatcccataaaggatgtattttgaaggtagagcccactggattttctgatggatcattatatagaaagtaggtgaaggagaggggttagtgatgactccagggcttttggcctgagcaattggaaggatgaggatagctgaattgaacagcattagg

SEQ ID NO: 120014 - DNA, 1011 bp, Homo sapiens
acagagcgagaccctgtgtcagcaaaacaaaagactataagttggtgttggaccacattcctcttagcctctgctgttgctgcagcatcacagtctcctaggagaattgcactctttccccaccccccagggaaacaaaataaaagccatttgaaaaaaacatggattgggtggcttttttttcttttctttcgtgtgtgtgtgtgtgtgtgtgtgtgtacaggtgcttattgccaactaatcactgatgcatagcagctgtgtagcatagcagctgtggagggaactggaggggaacatgcactgactcagtgcttttatctttggggccaagcccacgtgaggaggaaaatggcagtttgagcacatgacaaccaccgagggaagtgttttcacagagaggcggtagcagccacacgttcactggtcaggtctgcagcttctgacagactgtgtgggtttgtttttgtctcctgtccagacttgtgtttgctcaaaccaattcttggtgcaaaggggcatccatgatgcctttgtaaaagcattcgccgaggccatgaagaagaacctgcgcgtaggtaatggatttgaggaaggaactactcagggcccattaattaatgaaaaagcggtagaaaaggtaagtatattgtattatttgtgaaagtaaatttcatggtttcaatatgaaaagcttaatcagcaaaaaacactttggctggaggggtggggatagagaggggtgggttgacagaatattacagctagacagaaggaataagctctggtgttctacagcactgtagaatgactgtaattagcaacaatgtattgtatattttcaaatagctattattagaagagtagattttgaacgttcccagtataaagaaatgatcaatgtttgaggcgatagatgtgctaactatcctgattagagtatagagtatgagagatctacatctatacatggaatcgaatggaattttcaatgatgttttcatacaaaaa

SEQ ID NO: 120015 - DNA, 1282 bp, Homo sapiens
atcaggagtcatcgaaaggcttgggcaaaaatgtcgtgtggaaatctaacaggtgtgcaggtggattgaatagtagaaaacaggaagagggtctcgataggagatagtgagagtagaattgaagcaagaggtgactttcaaaggttttgagatgaaaaagtggacaagaccaacctgggactttatctgggagcagggaagactccaggcccaagtggctggacaaaaagtcatcaatggtgccctcatctttaggcatgatgtctttaatgactcttctaaatgccatatatgtccttttatcctgtgacaggttatttttactctcaagacccagcccagatctggagagtggcagagcagctggaagtgggcatggttggcgtcaacgaaggattaatttcctctgtggagtgcccttttggtggagtgaagcagtccggccttgggcgagaggggtccaagtatggcattgatgagtatctggaactcaagtatgtgtgttacgggggcttgtaggattctttggttctttaaaaaaatttaaaaggagacttatctacatatataggtacatgccatccattattttaaataaactaataggttttcagaattatgaatttttcagaactcatccagtccttgtaatcttaaacagatgcaaatcctacccctgcccttaatgtaactagggaccaatatgtgccacgtgcctgtggctgcagactcccagagaaccagcactgggtttacagaatgaggccctggctccccaccacagccccagctgcctcagagcaggcacagcacaaggcaggcccagccccatgggccgtcacaaaggcttgatcactgcctgggcagtggcacaaccatcccccatgtcgctacagaacatgggcccagagcaccttgaaggagacccttgactgtgactggcaggcaggtgaggggcacagcacccctccccggcatctgccagctcagcacagaagacaccgaatgtgcatctggaggtgttgcggcagaggtttgagtgaaccctctttcaaagacaataaatagcacagaattgtccgtgcttctgtgaggcacgaaggagcacctctccctattcctgaaccatattttaattgatgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggca

SEQ ID NO: 120016 - DNA, 1262 bp, Homo sapiens
ttatataacattttaattacttgtgatttagatgtatccatcctttttctattaagaatacaaatgctgggctgggcacagtggctcacgcctgtaatcccaacaccttgggaggccaaggcaggcagatcacgacatcaggagatcgagaccatcctggctaacacggtgaaaccccgtctctactaaaaatacaaaaaaaattagtcggatgtggtggcaggtgcctgtagtcccagctactctggaggctgaggcaggagaatggcgtgaacccaggaggcggagcttgcagtgagcagagatcacgccactgcactccagcctggatgacagagcgagactccgcctcaaaaaaagaatacaaatgctccaacattattttttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcccttggttgtgggaagaaagagaattatttttaactgaacgtttttgttgttttttaaataaagtagccatatgtaacgggattttaaaaatatatacattttacaacatggactagaaaaggaccattagatcaggggttggcaaactatggcccacgaatcaaacctggcctgccacctgtttttatacaacctgtgagctaagaatggtttatatgttttcaaatgattgggcagaaaatcaaaagaagaacaatatttcatgacacctgaaaattctatgaaattcagatttcagtgtccataaacaaaatgttattagagcatagccacacccattcatttatggtattgtctgggactgctttcttggcagagttgaatagttgggacagggacagtatagcctgcaaagcctaaaagatttactacttgtctccttaaagaaaaagtttgccagctcctgatctagaccaagagggagatattgaccttacttgcatttatccggcattatttcaacacctcctgtgaagaaagtacttttctggcatagctaccgtgagttctcagcaggaacttcccagcgatgataatgtacatgaaattagccacgtaacaagagtctatttgccttgaaaaaacaattatccttgaactt

SEQ ID NO: 120017 - DNA, 2034 bp, Homo sapiens
ttcagtttttgaaaacagataacagcagtaacaggccatgtatattcagccttctaagttttatctgaaacccaaagttaggaacctatttatggcagaagagaaggggcaaattccaaacccctctggctgtcttgatatttttatattacataccactatgcagcatagtactttttataatgtatctcattgttttgcatttctgcattaataatttcttgcacggtaatagcaaaaacacctttttttttttttttttaagttagtgggcaaaaggctatgtgtatcttagagagtattcttcttcttttcaggttaccagatgtggtggtttacccaacaacattgtggatgtctgggagtttttgggcaaacctaaacattgccagtatacatgggatacacaaatgaactctaatcttggaataactgctgcttgtaaacttcgttttgatcgaatatttttcagagcagcagcagaagagggacacattattccccgaagtttggaccttcttggattagaaaaactggactgtggtagatttcctagtgatcactggggtcttctgtgcaacttagatataatattgtaaaatgcttttcaagtgtgggttttgccctgattgttgcaaatacaatttccaccttctggaaaggtaggtttgctgtggaggaaataatgtactagatcattgtcacagaaaaaccaactatgatttatggttgtgttttcagaattcaacattaaagattaatgtttatttaaacgaacacattcctgcattcaggatgtgaggccatttaataaaaagggcacaaagcctgtcagagttttcaacggtgcttatagctgccagctggattccaaacaggtaccacattgtctctgagctaatgtttatatttttccattcaggcaccgaaatagttaatatttgaaataagtcttcaaaagaaaacataagagattattgagttcttgggactggatcctttatttcataagttcagatcatcttaaatgaaaatgccatgattatctgcagttaagtagatgacagctattctacatcagacttgatttttgtcagctaattacataattggtaagctataattgaaaccttatggcttaaaattccttaactcctttttgattcatgtttgtagtcatgttgtcaacagaggcaaagttaagcttgatgatggttaaaatcggtttgatagcaccatgggacatttttctaacaaaaataaatgcatgaagagacatagccttttagttttgctaattgtgaaatggaaatgctttacaggaagtaaatgcaaattacttttaagtgtgctttaaagaaaaatattttccccacaagagaaatttaaataaagaattttatttgtttatggtttgttttagtatgtttttgtgtccatgatgagattaaattttttatctgcttcctgcttctggctctactgctgcttcttcctctttgtgtagaagaaaacagatttccatttgcttctcactccaccaagaattaccaagaatatatctgcttcctttgtctgaaaaaaagccagcgagaataattagaagtaatagaatcttatttatatcaggagtgccaaaatttaaacacctaaaaaaagatatttatatataatattccctttgtagtgacaacgaaaaagtttaaatgttaatcataattttaatcattaaaaataaaaaatgagggccgggtgcagtggctcacacctgtaatcccagcactttgggaggctgaggcgggtggatcacgaggtcaggagatcgagaccatcctggctaacacggtgaaaccctgtctctactaaaaatacaaaaaattagccggacgtgatggcgagtgcttgtagtcccagctactcaggaggctgaggcaggagaatggcacgaacccaggaagcagaacttgcagtgagccaagatcgtgccactgcactccagcctgggcaacagagtgagactccatctcaaaaata

SEQ ID NO: 120018 - DNA, 1050 bp, Homo sapiens
tatagaggagatggtatttgaaatgaaccctgaaaaatatgtaagacatacatattaaaaagagtccaagtagagaaaccaccatgagcaaacttttgcaagttgcaagaggtgtacatgtatgagtatgaatgagcattctattcagttgagtgtaggggccatggagaggcaaatgtgacaggttgagaagtaggtaggctcctgattatagaagagcatgaatgaccaatatgaaagaattagacttgattctgcagacacttagtataatgatagattgtacattgttggtgtcttaattgcaaatggtaaatgattctcattcattcagttaactgacttttttggaatacctgtatgccaggcccttaataatacagcaataaataagaatcatctctgctttgcaaatgacttatggctttgtaggagggaaataattgtccttttaatttagcctagggggctttgaaacagtctgttcagcatgcctttggtgtattgaggagggagccgctgatggcctggggacactggggaaaggttcacagtggaggtgacatctgggggtaggtcgtgcttgctaaaccgtcgtctttggggacagggttactgctttaatacttcttttgatccggagggataggcatagtgctgattttacagtttcagtttagtaaatatataccatttgacagaacaatctgctgattttattattaaagttcagtattaatagtcagtggacagttttaatgactgtttgtcctgctgcaggtgaacgtgtcaggaaatgagctttgccttatgacatcccatttggagagcaccagagggcatgctgcggaacgaatgaatcagttaaaaatggttttaaagaaaatgcaagaggctccagagtcagctacagttatatttgcaggagatacaaatctaagggatcgagaggtgagtgacaaagtcagtttgatgtttgaggacagattattgctatggagactaatttaggttcctttgaccaaagctgttaaaactaggacctttagt

SEQ ID NO: 120019 - DNA, 1265 bp, Homo sapiens
agcacccagatcatggcctttaaatacaattcttcactgaaaggaacaagggcttttcagaaatgactgatttcatagaatgaaaggggcttaatgtaaaaattaaaaaagaagttaaaaagaaatgactgattccagagcaggggcaaaaaaagtacaagatgagccaatggtatctgtggtgttagaaagtaaggaggtgcccagaaaatgttggggacatgccagaagggcacaagacctagcttaaaagctgcctaccctttccccgtgaaatctggtataacccaagcaacaggatgcttggtaggaatagattacaatccataaaaaaagaacccatactgatataaataccattgtccaagagagaagggaacatttttccttacagtagaactccatctattaaatgtggaagacatgaggaattagaaaaaaatcttcatttgggaactgccgtattgataattatttcaggtagatatcaacagatactaaaactagtaggaaagttcagtgaacaacagcatatttacataatcacaaagtactttcccacaaaatacttactatgatggggaaaattataacttcgtactagagaaatctggttaacaacactttaaccaagtgatcaaagctaacatcaccaggaatgggaaagctccatatcagatgcttgatatggtgcattgcggaggacatactatcacttctgtgacattcctgccaaaaaatgcataatctgaatcaaataataggaaaacataagcccaatctgaaggacattctgtaagataaatggcctgtactcttcaaaaatgtcagagtcatgagagacaaagactgaaaaacttttctggattgaagaaaattaaaagagacatgccatctaaatataacatgtgatcctagattaggacactagtagcacaattggcaagattggtctaggtctttagatattaaatctagccataggaggcaataagaaaaagaaaaacttatatcaatgataatcttctgacttgttgatcatactagagtatactgttatgcaccacataaccacatctctattgacaacaaactgcataaatgaagatgatcccataagattatattactgtatttttgctataccttttctatattaggtatttttagaacacaagtaagtgccattgtgttacagttgcctacagtatccagtatagtagcatgctgtacaggtttgtagcctaggagcagtaggctagacc

SEQ ID NO: 120020 - DNA, 2036 bp, Homo sapiens
tatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttgaaaaaaaaagaaaaaaagaaaaagaaaacctaaataaaataggtgaaagttccctgactattcaggtgaatacacaaagtttgaagtgttaactttttctttccatttcactgatgttactggtcaccttagagaattatttcatagtctgtggctaaatagtaaattcagaagaaaaatacctggcaattgagtgtgtaacttcaacaagaacaggaatcaagaacatactgtcagctttcaacagttagcaacctggccttatgccttgcttcatgggaaagggccattcttaaatttcaaaatgctttcatgtgtcctcttatttaaaaattagaatctatttgaaataacattttgaatgtttattataaccaggtactcttctaagctcttgtcttaacctctcaacctttggtggaaatagatgcagaggttaagtaacttgctcaagctcagatcataagtagtggaggatttaaaaccaggctggctggctcttaaggcctatgctct

SEQ ID NO: 120021 - DNA, 1005 bp, Homo sapiens
gtgttctgacttaattgataacagtctttcataacttcacaaatttttgagaatgacccaaggctaactgtgggaaaaattcacataaaaacatagcctatctatgaggagcaaaactatatttcagttgtgggctttacatttcatttaaccctcttaactgtcctgtgaaatgggttacagccttattttatagatgaggaagctgaagtttaagggatttgcatacggtcacgtaactagtgagttgtgcagctagggttagaataaacagatttattttttttttttcttagaaacagcaattaacaatgtgactcctaatcaaaagaaaagagatgtccttggggcttaaagtactatggtgggagtcttggactgagtaggtttgaaaatacaattttatgatcgtggagtactaggatttagtcattttgatgcagagcatttcctgatcaactgctgttgtggagtgtactgtccaatagaattctctacaattaaggaaatgttctgtatctcaagagattgttcttaatggtggccagtagtcatgtgaccgttgagcatttgaaatgtggctagtgctactgaagaatggaattgtaaattgcttttaatctaaattttgcctgtgatattattggctgtgggtttgccaaaatttgtttttttaaagaggaaaagataacggactgttggctgctttattggacagcacagctagcatatagatgcagataggtagtataacttgtttgtagtttaatataaatgttgtattttgtaattaggccaaatttgagtttcatcatggtgactatgaaaaacagtttctgcatgtactgagccgcaaggacaagactggaatcgttgtcaacaatcctaaccagtcagtgtttctcttcattgacagacagcacttgcaggtaagcagcttttttgaaaaccacttacaggctcattcaaaaacttattggttagtaaacgttttatatacaagtt

SEQ ID NO: 120022 - DNA, 1058 bp, Homo sapiens
gagaaaaggaatggtaaatgttaacttgcaggcctcttttttttgttttttgttttttgactcttaaagcactttacttatttttaaaatttaattaattttttgtagagatggggtctcactttgttgcccaggctggtcttgaactcctaggttcaagtgatcctcttgcctcagcctcccaaagtgctgagattacaggtgtgagtcaccgtgcctggccttttgaagcactgtaaaacctgaatatatgggtagtgaggatataatcggaaccagaataaggattgtttttaaatactgagttcttcagtgtactgtgaagtgctgggaggtactactaaaatgtatctcttcttttctcttcattattaatgctactgccaaggttagctcctcccctgactgttagaatatttcgttacttctgtgggaattacttctttcatgctgcttatgagaagttgtgtgtgtgtgtttgtgtgtgtgtgtgtgtaccatttcttttcagataagtggatattcaatatgatagaattgaaatgctaaagaactataaggaaggcctttttcagtctcactcaaaccttttttcagtgtggttaccggttcttgcacccaccctggttgcttaccatattgcagctttgttacttgaatagtatttcagtttttaacacatttgtttttgtgttggttctgtttcctagtatggctgttttttttgttttgttttgagatggtgagatggggtattactctgtcatccaggctggagtgcagtggcatagtcatggctcactgcagccttgaactcccaggcccaagtgatcctcccacctcaacctcatgagtagctgggaccacaggtgtgcaccccatgcccaactaattatttttgtagagataggatctcactgtgttgcccgggctggtctcaaactcctggcctctagtgatcctcccgctttggactcccaaagtgctgggattataggtctgagccaccatgcccagtcagcgtttatcagattacttaccattactactttgtcctg

SEQ ID NO: 120023 - DNA, 2891 bp, Homo sapiens
acccaggaggcagaggttgcaagtgagccaagatggtgccactgccctctagcctgggcaacacagtgagactccatctcaaaaaaaaaaaagaaaaaccagaaatattgatggttttgataatgtaatattgagaaagtaatggaaattggcccatataaggaataaaactattcatttgtctgaatagcgttgttttaaaactggtgagatttttaattttaagaagtattgtccaaaatagtgctatggataccattatgctataaaactcaagcattaaacattctaatgacagtttgtacatgtatggttggagggggaggtaggggaagaacagaaggaattacctatctgaaaatgtgttttcagtgtataagttactgcagacagttaagaattttgtggagttaatgttacatgacattgtaatatgaactgagtgttaaaaggctgtgctccctgtgggttaatacaccattttcttttcttctagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggtaagttctgccttaagtcttgacttgataaagtttctgtggattaaccttgcatttccccgccccccgaaccccccttaaagtggatagttatgatagtgaccagtctcttcaggtaaatttgtctttgtgccatgttgataactgggatcatgactttaaagcattgtgtttataggattagaaaaacacgtttttttacgccagaccattcttatgtggatgaagtatataaagggatttctttaatctgtgttaggtgttgatgatctcggacttttttttttttttttttttttgagacaaagtcttgctctttcgctgaggctagagtgcagtggcatgatcttggctcactgcaacctctgccctcgcgcattcaaatgattctcctgccttagcctcccgagtagctgggactacagttgtgcgccaccatgcctggctaattttttgtgtttttagtagagatggggttttgccatgttggctaggctggtctggaactcctgacctcaagtgatcctcctgccttggcctcccaaagtgctgagattacaggtgtgagccactgcaccctgccagtagccaactgtttttaataatttaagtgttatgcagaaagtttaaaaatttttgaagtaggtttgtttttgaaaacttgaccttgagtaaaacatggacaactttgttgtattaggctcataatattgtgtattattattgtggataaatgtcttatgtctccgtttattgtatttccttttttggggggaatatgaatataaggaagtgcttccagctttgtaaacttctgcaacatgttaaaagttaatctgggcatacctgaaccaagagatccccacagttacttggggagaatgctggagataaccagatactggtctggaagaaattatggaccttcaaaaattaatatgctggctacaataatgaagcagaagtcaggaatggagaaaagtagttttctatcaaaataaaaatagcatttcagctataataggatagtgattcatattaggagttctaagacatctttttaaatagattgatttttaaaggtggaaataaaggttcagggtctgacaatacaacagatatcagagattttgttggagttttcaccatgcactgataagtctaggtcttggtgttaggagcattggactgagtgtatgtgactctctgtaagataaaaattaaaattagagccaggcacagtgacttagcctgtaatcccagcacttcgggaggctgaggtgggtggatcacctgaggtcaggagttcgagaccagcctggctgacgtggtgaaaccccgtctctattaaaaatacaaaaaatattagcggggcatggtggcacacacttgtaatcccagccattcgggaggctaagtcacgagaatcgcttgaacctggtaggcggaatttgcagtaagcggagattgcaccattgcactccagtgtgggccacagagagggactctgtctccaaaaataaaaaattacatcatgagctattcagattataaactattatgtttacttcctaagatataaaatgatatatggtagatcttttgtacttataaaatgtttttataggggaaccctataatttgtgacatggcttgatgtagctgtttctttaaaagtaaacttttttttttttaatcattttataggatgtaattggctgtactcaggagatggatttcattctttggcctcggaatgatattgaaaaaatcgtctgtctcctgttttctaggtggaaagaatctgatgagccttttaggcctgttcaggtattttggtctaaagtgtgatgagtatttcaatatgtgaaaactactagaatataatagggtctaacttgagaaattctttgggaaaatggtttctgatagttttatttcacgagtctcccctatttagaatattgtgatgcaagagaagaaagcgtttggattatagaatctcttgacagtgtggtggttccacctgcccagtgtggctttgaaattatgactagagaaaatcttttaaagtggacatttactgatttatagaggggcccacagatgagcttctgagatctgtaactcttgaagccttcaccacacatccttctaaaaccgtatatttaactgctgcttcccaaaggaatgtgatctgaaatgggtgaagaaatca

SEQ ID NO: 120024 - DNA, 3862 bp, Homo sapiens
tgcttttatgacgacatcggggcggggcgaagagccaactcaggagactgggacttcctgaagaaggggggcggaaggagtggcggggagcccccccctttccacgccccttggatactccatactggaggagagaggagtctcaactctcaaactccccttttgaggggcgattactgaaatggagaggttaaattcaaaggctccacttttaaaagacctgtccctattccgtactcttgatctgttttcctctttttcggtaaccttgaaaactttcccacctccaatcctttctccccctttgattctgcgcaaatggtggggtcccgcagggcgcgcagtcgcagtcacaccggggcggtgccggtgagaggcgggtgacgcagcggccgtcgctgccattttaagttgtttgttctcgcttcttttctcaaacgcgactctgccccggacccgcgaggcgcccgaggccttcgccgcttctgcagccaccggcgggggggggaacgaggcagtactgccgcggacgctcaccaaccgcttcggcttttcccccctccgggtctcctcgacctttcctgagagccggaatccgactgtagggggaagaaagactcaagagcagatgcttgaactgaaataactttattttggggggttactttgctgacccttagcgcagggcttcctttcccttccccctccgccgccagtaccaatccaactccccatctttctctttgtttttcctctttttctttttctctccctgttgccgctgtctccgcgtccttcccctccgttgccgcccagggcgccgagccagactatgggtcccaggtgggggctgagcggcggcagcagcgcgggcggtccagtcacggtgcgcactgcagcggggatggaggggctcagttggctggtggttttctcttgacatggctcctgcccgtgctaccagcagcgcccccgccgccgccgcctcttccgccgccgccaccgctccgcccgcaggctgcggctagagggcccaaaccccgccctagagtcggtccgtgagtcccgggctccgcggggacagggaggggatttccccgtcacccaccccgccctagctgcctcaattccaccccctgcccctcgggaaacaactaacgaccccaccctaaacaatccaaactctggaaacatggtctgttcaacgtgagagagagctaatccgggaacttaattttttggggggagggtgggtgggcttactttagaagtaatattaacacaattattttctttttttcccccactgaaccttcccatttaccctctcccgcccactccacccgggcgggaattgtttccacgatgaaatgagtgaaaacctgagtgatcctgtgtctcccgtggtgcgagtgagtcgctgccgctgaaggcaaggggtgggggtgggacctgcgggggtggaaggcaggtggtctccgggcaccgcctgggatttgggagaagaacccgccacctttgcctcggcaatgctcacaagaagataaatcgcactccccaccattttgaacgggggcagatccacagggaagtctcccttggggaatgtaggactagttgcaggctgggggtgttgggaacccgggcattaatcaggtctaaccacagagccggaataattaataccgtattatataccccttttccttctgccgtcatgattctccttggcagcagcgttagcagccgcctgagggtgaaaatgtgggtgatggggaagttggtaatgactccgctgttttttctcatggctcctttgggccacagctgcccgcccccggtatacactgtagttgattgcagggaaaccctgtacctctccctttccttctctaccgattttgcacttttctctatgctcaccaccaagtgtaatcaataacaagcactgacaatacatagcaatagtgaaatctgaaataactaagaattaggtactacagccatggagctggctgggtaaaatctaattggatatttcagtttcattcacctaccctgttttggtgtttggttttggttttggttttggtgagttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaaggtaatttaaagttcttaatggtgaattagcacaagtaatttttgtaagtgtatattatttgttactcttaaattattatgaatattaggttaaagagtggttgaaaaaaagtctgctttgtatgctctgttttttcacccttaggggtgattctgtgaattgagcagttgcagcatgcgaaaagacccttgagcgttctttggtttggaaataaatttgagtctgaagcttagtagtagtatacactgagttgacatggggtgggcaagattacaaaattttatatggagttaacatgggaaaccttatgatggaatttaaagattatctaatgtagagtataaataagatggttgaaagtgtgaaattgtaatcagactgtttatatgctaaagtttatcctgtttcttaaactgcgtaatgtaggtaaccttttctcttacatttaatgaagtagaatacaccttttaggagcaattaaatactgaaatggttaatttgtgtttagaagtgtgattttcttttttacttagagttcattttgccttgtatagaagtacagtttttaaaaactcaaaatgacctagaggaagtttcatttttaggggcggtggaggtcttaatcagaattagttccgcagttaaatagcaaacagtaagttgtgagtagtcaaggatgggatgataagagcagtattttttgcaacttaaaatgaacattttcttaaattatcagcaaggcttatttgaccaaagatgaggttatgaatgtaaggaagtgctacttggattttggtgcttaaattgttagctaatttcagatcagaaatacaatcttagtgtggtatctattaagtatctggaagttttccaggtttccccctactgtttaactcttattatttttgttgctgagacaggcctcactgtattgcccaggctagtcttgaactcctgggctaaagtgatcctcctgtcatggcattttaaagtgctgggattacaggcaggagctgccacgcacagccccaactcttaactcctaaaaggttatttgtatttaagaacattcttagctgctgaagtatagcattgtgaagtgatttttaagtaatttttgaagtgactgt

SEQ ID NO: 120025 - DNA, 1037 bp, Homo sapiens
cccactgtgctttgtgtgtgattatttaaaatttttgttatgaaatttttgaaatatttaaaagtattttaataatttacttccccagcttcagcaattaccgctatatggccaatctggtttcatctatgtccttatttactccacttttccttcagtggattaatttgaagcaaatcacagccaaataatttatatatttccagcagattacattttaaagaaagtcttgtgtttactagctacagtgaaactatcttgaatataaaggatactaggttctgtttggttttggttctacctccaaaactgagaccttgggtgggttagttagcatttcagccttagtttactcatctgtaaattgggagaactggactagaactagatccttgtgagttgcatgcaaaattctgtgtgaatgtgcttttatgtgaatttttttggggagaggattcacagagtattaaatagttttccaaaaaggttaagacccattaatatacaagaaactttctggctttaagagtctattattccaatgcatactctatatacagaaaataataatagtaatgttacattgttttaggcaaaagtctatatagcttatataaataaaagttaaatcttggaaatggtctttttttttggtgacagttacttagctggcttctttgaccattattaacagaaagcatttaaataacacctcttgttagtaaggttccaacgttacattttcttttatttgtctggagactgttgactaatctataatctaaattatatctgaaatgttgatgtaatatttgtcctcacagtagctggcatttgtccttcagttaaatggtgagataataatcagcagtagaaactttaccgtgggaaaggtgaactcttatcatgtgaagtacagtgtggaatcagtaactttctcacgctggtatggtatcatgttcttgctaaccttgtttgagtattcaccattgtttgctatcccatggtggcagtataactaatgatattttgcaaaa

SEQ ID NO: 120026 - DNA, 1110 bp, Homo sapiens
tgcagtggctcacacctgtaatcccagtagcttaggaggttgaagcaggaggatggcttgagtctagaagtttgagactagcctggacaacacagtgaggctctctctgtatgaaaaaattagctgagcatggtggcttgtgcctgtattcccagctactcaggaggctgagtcaggaggatcacttgagcctaggagtttgtggccgcaataagctatgtatgatagcaccactgcactccagcctgggatacagggcaagacccggtctctgaaggaaaaaaaaagggtagggggaaaggatagttattaatatgacagctctgataattggattgccttgtaggggtttacaagacttggaaataggctttttagaagaaaaatgtttagataatgagttcgaggtatgaaaggaatttgaatattccaggagagtatggcataaggaaaccaataaaaatatggatgaagagtaaagatgaatgagaagaattatgcctataataagtactagtttttaatagaatggtagtatacatcagaagaagaagcaactgatgttttgtaagcattatggaagattattatttctgtatgaattatgggtcattgaatgttaagtactgatgataaaattgaggcctagagaagttaattgacttgctgaaggtcacagtaacatttggactcattttgaattgccttgaagacaggaagaagagaaatagatggtaggatttttattaggcaaaattaggaaaggttgactggatagaaataaagcagctctttaaaaatattgtagattgaagagcaggatttgtgacactcatatctgattaggttaaaaattaaatcaaggattagttaaaataaactgctaaagttaaatatcaagacaaataactatatatcatgttggtaatataaccacaggtggaacacattatccttgtaaccctctgcgatacatggtaaaaattaaaataactgcgaagaaatcccaaactttattacatttgttgtttgaactttattatatttgttgacagtggtattagtgtaattttgaaaaaaaaaaaaaagttgtgtatattttaggactga

SEQ ID NO: 120027 - DNA, 1141 bp, Homo sapiens
aaatgtcagtgttacataaaaagacacgacctcacaaaacaaatgtattgcaaaaatctttaataatctaggtggaagatatatacgtattgtacttttgttgtaattctgaaggattgaaatcttggaaatgttggggaaaatagaataatattgattttattttttaactttaatcttttaaaaatgagtattactaaacaatatgggggtactaagattggaaatttttttgaaacaaattactgggttttgacagtaatgatttttaaagttatatttaaaatattattttagaaaatccatcctctcagtattggaaggaagtggcagaaaaacggagaaaggcgctgtatgaagcacttaaggaaaatgagaaagtatgtattgagtataatttgtaccatttttaaaaattccaggattgttttgctgcttagcatattttattagagcaatatgggctagctttagtattggcttaagaaaagtttaagtaaaaaggcagctcttgacaattatacaaaatgaatcccgttgtgttgagagtcaattctatgctgcatgtcctccatgttatatacttggaggtatgtaatttgatttatagcatagcaaatctatggaatactgaactttatttatgtaatacagcttcataaagaaattgaacaaaaggacaatgaaattgcccgcctgaaaaaggagaataaagaactggcagaagtagcagaacatgtacagtatatggcagagctaatagaggtaggtaatttaatagttatctggttcaaatttatgtatttttctataaagttgaggtagtgtagtgtgatcactttgaagtgttagggctctggaatcagatttcctggatttaagacttaacttccttcctaacaccattaagtttgctgggtagagtgggtttatccggtcagggcttcatcttcctcatccacaaaatgagagtaatgatgcctaccttatagacttgttatgagaattaaatgagttacaatagatggacaattgcaaggagtacttgcacagagtgaaagttcagtaacttaattattgttatgaagcaaaagaccatattttttggtagagttattaaaaggaattatccctggaaaat

SEQ ID NO: 120028 - DNA, 1042 bp, Homo sapiens
aggaagaaagtttttcaaatcaaaacttcatgtaactgaattgtgaccttttacatttgagatccatgatagaattaatatttgaagttttcatttggagatactgtggtagctgtcttaactgccttaaaagaattagtccacagctgattggaaatgtagaacacctacttgtccttgcagctgattggggaagtacctgtttatactctgaaataatttcagtgctttttaaaaaaaaaagacaaattattaaacactttgactttgctgactatgatctagcatggtagagactttgatataatactgtttataaatgaatttattgaggggcaagatgaaaaaaatctcatagctatatcagtatgctatacgggtcagctatatcagtatgctgatcagcttaggttttaacatttttacaataaattattggtttattctttaaaagagactgaatggtgaacctctggataattttgaatcactggataatcaggaatttgattctgaagaagaaactgttgaggattctctagtggaagactcagaaattggcacgtgtgctgaaggaactgtatcttcctctacggatgcaaagccatgtatatgaaatgcattaatatttgactgttgagaattttactgccgaagtttacctccactagttctttgtagcagagtacataactacataatgccaactctggaatcaaatttccttgtttgaatcctgggaccctattgcattaaagtacaaatactatgtatttttaatctatgatggtttatgtgaataggattttctcagttgtcagccatgacttatgtttattactaaataaacttcaaactcctgttgaacattgtgtataacttagaataatgaaatataaggagtatgtgtagaaaatttgtctgtttctatgcttttatgttgttctctttccattcttttgctaactaccttggaggagacaaggagaaaacgaacttaaagtatttagactgagatagctgaggtttttaactcccaaac

SEQ ID NO: 120029 - DNA, 1039 bp, Homo sapiens
tatttaactatgctgaatctttctcaagaaatatctgggtttctcaagtggacccaataacgggattggaaaaggggcagaaagaggctgccctagtttcctgggttgaaaagaattggtcactctttgctttcacaatttgccaagattgcttggatcaatttccacccccgaattcctggataaatgctttagttggaagtcactttccctactttatttgtcccagggtctggagcagacaaagacctccccacagtaattcatgcttgtgtgacctctgccttggattactgcaaaacattctcttcccatagatgtctaggaagctttctttggctggtgccaaagagatggtgtcattgcaggggcataaactaaaatagcacattgcactaaagctatgcaggctgtcttagccaccagtccacccccctgatttatggcccccagtgacctcagggtaacctgtttagatcaggccaatgccaaaaggggcccaaaactacaagtaaaacattttagatgtttattttaatatctctatgagcagcaagccaagtcttaactttttaggaatgatgtgtgtaagatatactagagtatgtcttctatagggcttgagttgaaaactaaaagtacatgcatactcattgtaggtatgataatttaaacaaagaaaaagaaatgtgtagtttttgtgaccaaaatattaaaataaatctggagggttgcactcccacctctctttttgatagaagccacttcacttacacaagccaacatatttattaaaaagatgtgatttatctggctaactatgcctcctgtattttttcaagagacaggctctcgctctatcacccaggctgaagtgcagtggtgtgattgcagctcactgcagcctcaacttcctgggctcaagggatcctcctgcctcagcctccaagtagctgggactacaggtgtgcaccaccatatccagctaattttttaattttttttgtaaagccagcctctcactatgttgcccaggttg

SEQ ID NO: 120030 - DNA, 1737 bp, Homo sapiens
cttcaattttcaataaataactagaaacagagaaaatagctttccaagtcatcaaagaaaacccatggtgagaaggatattaatggattaaaacaggcataaagaggaaactgaaggcaaagcattggcaaaatctagaaatgattatcagcttcagctaagtccgatactcaccagctccaaggacagagtagggaagcatcagttacaagttaggagaaacagcactgcagtattgtcggggagcaaggtgagggctttccttcctctttgagggtcagttgtcagtctggggccacactgcttccagaagggcacagaactggaaacctttaacaatggttaaaaaatctgactgctcttgttctgtcgcctgccactgctgcctgagcccgagtggttcactgcaccctgaagacagattccagacgctgggaactcgcgcctccaatcccagacactatgtccagcaaaggctccatgagagttctggcctatggtggcggcctggacacctcctgcatcctcgtgtgggtgaaggaacaaggctatgatgtcattgcctacctggccaacactggccagaaggaagacttcgaggaagccaggaagaaggcactgaaacttggggccaaaaaggtgttcattgaggatgtcatcagggagtttgtggaagagttcatctggccggccatccagtccagcacactgtatgaggaccgctacctcctgggcacctttctcgccaggccctgcattgccagcaaacaagtggaaatcgcccagcaggagggggtgtcccgcggcgccaccggtaaggggaatatcaggtccggtttgagctcacctggtactcgctggtcccccagataaagggcactgctccctggaggatgcccgagttctacaaccggttcaagggccgtaatgacctgatggaatacgcaaagcagcacgggattcctatcccggtcactcccaagaacccgtggaacatggacgagaacctcatgcacatcagctacgaggctggaatcctggagaaccccaagaaccaagtgcctccaggtctctacacgaagacctaggaaccggtcaaagcccccaacacccctgacatcctcgagatcgagttaaaaaaggggtccccgtgaaggtgaccaacgtcaacgatggctccacccacccgacctccttggagttcttcatgtacctgaacgaagtcgcggacaaacacggtgtgggctgtactgacatcgtggagaaccgcttcactggaatgaagtcccgaggtatctatgagaccccagcaggcaccatcctttaccacactcatttagacatcaaggccttcaccatggactgggaggtgtgcaaaatcaaacaaggcctgggcttgaaatttgctgagctggtgtacaccgctttctggcatagccctgagtgtgaatttgtccgccactgcatcgccaagtcctaggggcaagtgggagggaaagcgcaggtgtccgtcctcaagggccgggtgtacatccttggctgggagtccccactctctccctacaacgaggagccggtgagcatgaacgtgtagggtgattatgagccaattgatgccaccgggttcatcaacatcaattccctcaggctgaaggaataggaatatcatcgtctgcagagcaaggtcactgccaaatagacccctgtacaatgaggagctggagcctcctcaatttg

SEQ ID NO: 120031 - DNA, 1035 bp, Homo sapiens
ttttagacaagagtttccctctgtggcccaggctggagtgcagtggcacagtcttggctcactgcaacctccgtctccctggctcaagcgattctcatgcctcagcttcccaagtaccttggactacaggcacccaccaccatacctggctaatttttgtatttttagtagagatggggtttcaccatgttggccaggctggtctcaaactcctgacctcaagtgatctgcccacctcagcctcccaagtgctgggattacaggcatgagccactgagcccagctgagacaggttttataattcacttaataaaatcatatctcaggctgcaggaaaggaatgtcaaatctgatttgtgccaggcaagttcatcgtcattagtccaaaagaggagagaggtctattggaaatgaggagctgctgctttccatctcaccctcggtttttagtttgtctctcttcagtttttgttgctgctttccctcgtgtactcaggattatgttttaaacactcacaacctggacgattttggttttgtttacttattggctgtatgtttacctcaaccaggccaaaggttctatggactctggactggatgcactactgatttacttttttttctgatggtgggggtggggagatggacttttgctcgtctcccaggctggagtgcaatggcataatctcggctcactacaacctctgcctcccttgttcaagcaattctcctgcctcagcctcttgagtagctgtgattataggcaagcaccaccatgcctggctaatttttgtatttttagtagagacgtggtttcaccatgttggccaggcaggtctcaaacttctgacctcaggtgatccaccagcctcggcctcctgaagtgctgggattacaggcgtgagccaccacgcctagcctatttactttttaaaacacttgaatggtcttgtaatgttagctgttctcagtcccgcaaaagtcgggtttctgtcaggcaacgcgtctgcttaatttaggtgtcaaagagag

SEQ ID NO: 120032 - DNA, 1006 bp, Homo sapiens
tgtggattggaatcatacaatggggaacaaatggaaaagagtacttttgaaatagtgctggagaccactgtgaccacagaatgtcaagacacgtgctgccattactgttactatttggaaaatacattcttgtaaatgcaaccttagggggtttgagggggaagtctgttgggaaatgaattgcaagaaaaatattacaccctgattgggactgtcattttgcctcttattgcagcttgccagtcgacatgccatctccaacaggaccggctgtacactgtgctgggcgggggtgggtcccgtgccaggtcattcaattccttgtgagttctctttggagctttggtgggaggcaagtggtgctccctccaacccctggggccaggacgaggacagggaaggggtgggcgagggagcctgaggccgcctcatgatcacccaccagcgggagaaaatgcggcgttggggtgagcgggtctggggagacaggatgagcgctggggctgcctgctgagtggccgccgtgtcactctggatggtccctttatgcactgcagcagcttaactaactcccttttctctggtaatatttgttgcttaaaagaggatggctttatcatctttctcttaattaatatgttaatagttaatatggctatatcagctttctcttggttagaatctttctatatctttctcatattgtagatataagtatgtaaacaggcatatttcaggctcaggcatatagaattgatcataatattaaccatactattgtgggtctgttttatgtgtatgtaatctgttgtttttgctagctcttactcattgtgccttggctgtttagtaattttgtaccatgagctgcttcatggtttgtaattctacttgcagaaattctctttagctagcttaaagatggggtccttcaaagagaattttccccttcttctaggtttatgagaactgttagtccaggggcactctaaattaaatgttcagc

SEQ ID NO: 120033 - DNA, 1015 bp, Homo sapiens
aacagattacatacacataaaacagacccacaatagtatggttaatattatgatcaattctatatgcctgagcctgaaatatgcctgtttacatacttatatctacaatatgagaaagatatagaaagattctaaccaagagaaagctgatatagccatattaactattaacatattaattaagagaaagatgataaagccatcctcttttaagcaacaaatattaccagagaaaagggagttagttaagctgctgcagtgcataaagggaccatccagagtgacacggcggccactcagcaggcagccccagcgctcatcctgtctccccagacccgctcaccccaacgccgcattttctcccgctggtgggtgatcatgaggcggcctcaggctccctcgcccaccccttccctgtcctcgtcctggccccaggggttggagggagcaccacttgcctcccaccaaagctccaaagagaactcacaaggaattgaatgacctggcacgggacccacccccgcccagcacagtgtacagccggtcctgttggagatggcatgtcgactggcaagctgcaataagaggcaaaatgacagtcccaatcagggtgtaatatttttcttgcaattcatttcccaacagacttccccctcaaaccccctaaggttgcatttacaagaatgtattttccaaatagtaacagtaatggcagcacgtgtcttgacattctgtggtcacagtggtctccagcactatttcaaaagtactcttttccatttgttccccattgtatgattccaatccacatgatcttctagtgaatgaggttgctgagatctacagaaaggatagagaaaagtatagcagaatagctcagggatggactcaaagtatgccaggtaattaaagaaactgaataacctctacaaataaagacaggggcactctgaaagagaaagtccttttaggctgggcataatggctgacacctgtaatcctaacactttgggag

SEQ ID NO: 120034 - DNA, 1085 bp, Homo sapiens
ggatgggagagtgttctgaaaacctagcgtttaagcatgtatatgtgtgtagcatgttatactgtaacaaggtatgtgcgtctgtgtacagatgtgttttgagccctagtgacctatattccctcctgtaccattcttggcacactacacagcctacagctcacaaagatgatgtttaatcggcgctgacaacaagaggaagttctgagcacccgttgatctccatgtgtggaatttgcccctctgttgtttcttttagctaataatactttggaggaatttgtgtatgcccttccgttggtgactgttaactcagcaggtaaaacttgatgtagagaggctgttgctaggtttgtatggaagcccctacttctgctgaattacagacaaacctgatcttttaccagaatttacagtatgaaattattcacagacgcacgcgcgtgtgcgcgcgcgcacacacacacacacacacacacacacacacacgcacctctcatcatgatcccagcagatcctcttctctctccccaaccctgtggagtctgcatcttttgctggagtgagtgacacatccggttctgggaggctgcgacctttccaacaccccaagcaaacgccagaggctctgaagacgcctccagaggtcctgagaatgagtgtagggcagggcttgcctggctggtcaggggataaggatggctaaagtgggtggcagatttttactttatataaggagttgtccttaagtctggaaatggaaagtgtaggtaattacttaggcccaagagaaagagtgaagggtagagtggaaataaggtgtctgggtttctattcatggttctcaaaaggaatagtttgtatattttaaaagttgagtttgacctttatcttgaaatggaatttttgtttttattaagtattgcctatctctttcaagagagtgacatattatgcccgatatgatttttctgggcctttcagtggtcaagttaggctgggatagaataaatacctgcacctgctttcctctaaattcaagtgctcacaagagttctgctctgatcaattcaaaatggcgaccg

SEQ ID NO: 120035 - DNA, 1133 bp, Homo sapiens
atacttttaaaatttaatttttgaggtcaaagctttctagggcagtagaaagcatgatactccatttacccactgtagaggagtactgtagtttatctaaccatgtcccttattgtcagataatttaggttatttccaatattttgccttataactgtccatgtcctcatatttatttctcttggataaattcgtggaagtggaatcattgccatcattgcctaataggcattttgaaggatgctttttttttcacctgattgttatttaggaagtctcaatagagaataaatcctccaccttgtcaatttcattgtcttaaacaagagtctacttggcagaatggcttgttctctttgcttggatccgtgtatttcttagaccagtgctccttggaccctagctcctgaggcaaacctttttcatgcaatttagggttctttcagatctccctgtgtggaagtgttgtcttctactacagtatgtttgctggaatgagaaagtcctgtgacttcacttgtggtttcagagtcacagcttccaagtatcattgtcttggcagaatcagccatagctttttccttggctgaatcctaggtaggtgtgagcctgtattatatgattcagatctttgcccttgtcgtgggactttcttaccttgggcctttgaatgctctcataaatggtagttgagtagattcacaaatgataaggcacatggcactttcattagatgaaatgtaattaacaagaaccataagctaatatgcatgtagaactagtccaatgtcttagaagataatttagtatcataatgaaaggagacattgtttttcttcccagacagttctgaaggcagttgattttatctgtatagccaacaacaatttcttaagtctcatggtccttccccactccactagaagctgcagagtagtccttctcattctcatttactgtcccaatttcctgaccctttcactatctccctgtcctgggagaggggtgtccaggtgatgaggacctatggcctcttttctgccatgaggagctccttgtggagccctgtcctccttgctgaggccctcaagagtgcagcctgcttttctgtgtcctttcaaagctaccattgt

SEQ ID NO: 120036 - DNA, 1122 bp, Homo sapiens
caaagtgctgggattacaggagtgagccaccccgccgggccacatctttttttaatctattccttcactaatagattgtgggttgtttccaccttctcactatgtgagtaatgctcttatgagcgtgcatacaagtttttgtgtgggcatatgtgctcaagtctctgatcccctagatgtcttgcctatcctacagatccaggcctaccacaaaaaagtgtagaaggatcatataccatgagaacataaaggagggacatgtagacttaattagggagtcagggaaggctgcccctgaggccaccatatccaagctgcggcttgagagataggttgaatagaaaagtttttcaaactgcagctgatcacccattagtaggttgtgaattcagtttagtgaatcatggccagcattttttaggaggtgaactaaaatagaatagtagatgttagaggacattccatgtggtaagggtaagtattgttgcatgaaatttattttcagtagctatatgagcgcatctagcaaattgtgacgtaagaagtattctatattccgggttgcaatcagaaaaatatgaaagccactgctctagggattttttaaaaggagattatttattaatctggagctttaaatatggttccactagaagattggagagatacaggagagagaagaacctagaaagctgaagatcctttgaaagcttaaagttctgtgatttctacacttttaaaatgattcatttattcaacaaatattaaaatatttaccataggcctagattgcactaaattctgggagcatatgtaagatttgtgtgattttgttttttttgtgatctggcagagaagatgtacaagcaattaaaatgacttctataaaacatggtgggttgaggccgggtgcggtggccaaggtgggtggatcacctgaggtcaggaggttgagaccagcctggccaacatggtgaaattccatctctactaaaaatacaaaaaactggccgggtgtggtggtgggcgcctgtaataccagccactcgggaggctgaggccagagaattgcttgaacccaggaggcggaggttgcagtgagccaagatcgtgccactgcac

SEQ ID NO: 120037 - DNA, 1032 bp, Homo sapiens
ggttaagataccaaggatgatttccaaattttagacatccttccccttgttccaccaattttttttttcttctgggaaaatagccaggatgattgcaaaacataagcttgtaaaaaggcaaaactccatggatgtaagaaagtaaatttcttgagggccacacccatgataacgctggaattttcatttaattcctaactcattttttgttgtttttgtttttttaaactcaaatgtgtctctttaattgaggtcacttacttggttgggagattaatattctggtggggaaactttctttttagagtttatattgttttattccttcagtcactcagtattactaatggggtagcttttggaattttccatcccccccactttcagattacttttgtctttttttttttccctgagaaattagtgaaaacagtttgaagtcttgccacgttgtaaggagatttgcattatttaaggaaacagctggcagatctctataatgccccacctctgttctgccagtgcctaaaatttcctttgcatgactcagttaaaaaaaaaaaaaaaaaaaaaaaaaaccagaggaggggaacgagtggagagaagaaacccttgtttccctttctgagttgtaaaaagcttttatcaaggtttacatttagtcatgcttctgtcctctagtggatggcagcatgtgatgaactcagagaaactcttctcccaaattggccagtaagaactctgcaaaaactgtggatgagctgagcttacctcccataattttattttgaaaataaaaaattttccccacatagtaaacacagttatcttcacgagtgtgggaatgattaagaaaaaaaaaccaagcttagattttgcaagatgggtgacctgaagttttgcctagagggagagaagggtctcttcctcctttcactctgttcttgacagcgcctgcagcctgccctggaagaacgggtttcttcttcagatagaaaggaattgctggctcttctgccagccttgcccata

SEQ ID NO: 120038 - DNA, 1042 bp, Homo sapiens
ctgtcttcttcctcctgcccacccctctgtctacattagaaacaggttttggaggagtagtgggaacattgggtgatttctagtggggttagagaaagcagtacctggttctttggccacatctaccaaagcaaagacctagacttgtagaggagagtattgtttgcttgtttgaggattgtatttcccaggtttgttcatttgcatgagtggctgaataatgtaacagagacttcagaagtaaggaaaatggttgtcaccaaaatatcttgttttacctttatttggactaaatggaaaacacatgtttaatagctaaggctattgagtgcttatcatttgccaggaactgtttctgagcctttcacatataacacctcattttatccaccctctacccctaacaaatggtgtggtttgagttggccttggtgaggtatgaaaaggaaacaaagcagtgacctcttcctgcaggctggtcagatgtttgggataacattccttagcattcttggtggaagtggtgatttcgttgaaagctgcttcccagttgctctggagtgcaggtgggaggggtggactttggcttttccaaaggatcccaggaatgggaaggaccttaaagatctagaccaggggtatccaatcttttggcttccctgggccacattgtaagaagaagaattatcttgggctacacgtaaaatacgctaacactaatgatagctaatgatcttaaaaaattgccaaaaaaatctcataatgtttaagaaagtgtatgaatttttgttgggctgcatttaaagccatcctggactgcatgtggcccatgggccatgaattggacaagctttatctagactgttctgaactactcatctgcctcccccagcccccacccccaccccacacatccagaattctccacccattggttgtctggcctctgcctgaatagctgagtacctgtcttttccaaaactaccccttgaggggagacttacagcaccctgtagcatagtatatgatatttggctagtaa

SEQ ID NO: 120039 - DNA, 1012 bp, Homo sapiens
caacttgatttccatcacaggttttagattagaagaaaccagagaaacacagccccaattttctatttgctagttttccaaacagtaagttttcattgatttcactggctcccctccggctactatttgctgtgcacaaacaaagtctgaatgagcattttgtagtcctgaaaaggagtagcatatgggcttcaacagccggtcatattttcttttattactatatttaaagcaacattcaagattaaaaaaaaattcctggcaactagcataacaagctgcaataaaatcattcctggctattgatatgggctactttgtgcctcatgtcatgttattgaatccaacttcttggaattgactgtcttaatctgtcacttagcaaatttatattggtgaggaagaacaaaaacagatttataacttgcatatctcttcaagcttctgttaatatgctcaatattagaatgttctacttttagcgttttgggtcataagctatagaacattggggcttggtgagaggatatgggcatggggagaggaatgaatatttggcattatttatgtttgaaccattgagctggggtctttaggtttattatttcatttaattcccactctgacgtaggtggtatttccctcattagtagataaggaaatgagctagtaaagaaaactatttaaatccagatctaaaatggatctttattctgtgccaagctcttgggggaagagtatgtgtggaggaggagttgtggggactcacagagcagtggcaaggcaagccagagatacagcaaagggatatcaaggactaatgaggtactttaaaggagatcgagtcatggtaaggcatttaaattagttttgttagcaagtactgcatggaacaggaagactctgtacatgctcagtgtagggcttggtccgtcaagactggctaggagttttctagatagagccttgaatcttgcattacagtcactacagagcatgagctctgtggaca

SEQ ID NO: 120040 - DNA, 1068 bp, Homo sapiens
ataagtgcagtacttatttgtcagggcatatattatgttggagtatgatgtcatgaggcttaaggaaactaatgcttatcatttgttagtgcttaaaacaaagtagagatagccaaatgcatttctctacttccttattgccatacagctctccttgtaagttaataagtatcttattgcaaatcagccctgtatctgttccaaattcaaatgttgatggttgagcttccagtattttctcccatatattcacactgaataacatttcctgaggattgcataagacccatttaacatttgtgaactatgagacttctttgtacatttctgtttctttagttgtattacggtaatcgggcatatgtcttctaaccttgatgatctcacctctatataatataaggatgttgggagaaatatgaaatctagaccaactctaaaaaattgaatgtcaaggtaattgtcttgtcacacaatggtgtaaccagccaacatcctcgaacagatccgtgtccataatggcatcattgacttctgaactgtatggtggtgttctctgaaaggtgctatagagaaaacacaagtgtgaagggcgattgtgatggttgtgggtcagaggctcctcaagtggagtgaatgaggccagccaggaatgaagacaatgcagtgaatgattcttttgttgcatagtaaaatgaagtactagaaaatgttctcttaacaaagaatcatgtttggtcagagtggacgtgatatagtgaggagtttttgtaaattcttcatttagcgactaatattttggctcagttaaagatatgaaaaacattttttaacaaaaaggtgttagtggccgggcatggtgggctcactcctgtaatctggctttaggaactaactagctggttctgactagcgtatgagggtggggttaggttttccctatcttcccccttcttccatagcactttgtgaggctgaggcgggtggaccacctgaggtcgggggttcaagaccagcctggccaacatggcgaaaccccgtctctaccgaaaatacaaaaattagcca

SEQ ID NO: 120041 - DNA, 1038 bp, Homo sapiens
gttctcagcagggtcaggttgcctctggctgggcagtgggtgtccagatgcagggatagtggtgtagatgcagggcagtgattaaaggctttggagtttgaatcccaaccctgctcagtgtgaccttgggcaagttacttacctgtgttaagcctcaataacctgtgccattggggcctttataaagattaatgaggtgtaatataaaatacttcacatagtcattttctggcacatactcagtacgtggtggaggttatggtgattttattaaaatagaattggctgtagatgcccctccccactttccaagatcccaacatcatgcctagtctgcctgcattgttgtcgagcatgaagaaataatcgattttgtaatttattcggctccttattacttttccattcttgcagatccattgcccatatccttaagatgttttctttaagccttaccctagtcagagactattttctaaatagaactaaaagagaaatttgattgagcatctgaatctgaccttctccccaattaacccagttgggcagaccttcatttagagtgtcatttatttttcaagccacgtggtaaggaagcagagggttctccttacttctaaagtcaatttccattaaaaccttcagtgttcagtgtgtagcttaatgccttttaaaatgattgctatttttgaaccagtgtttttgtcacaacgttttgagtgtagaatattccttatttgacaaccctgagcttgtaggagtttataaatggctaagaacaatctgattagaatgtattgcttttggttggaggccaagaatattggatcattggtttagggtatgacacttaaagagaccaaagagcagagtacataatgcccagataggccaattcatgtagctttgttccataatgtaagattgaaccccaaaccctggccacctatctttgagatatatgctgttggccacaggagcattaattactccgggcagatcagcagaccatgaactacatgctacgaggggaaatcc

SEQ ID NO: 120042 - DNA, 1346 bp, Homo sapiens
tcatcaccggtgacttcagtgcctccatcactcactttgaaacatcccactcttatcaccacttcctcttctctcgcaagcctcatgtggtacctccaacctcaatagtccattgatccaccaggtttttcagtccattgaatccatcacgtcttcacggacccacactcaccccatgtcctcacttctccccttccccagcttggagtccacgatcaaccactgtaatctctaccatggcatagatccttatcacccttgacccctcaggcttggtcattcttgcttgactaaatcacagttctggttaaatccttccctctcttcacctgttctgtgcttgcacccatgaggccaaatgtgcttggagaataccacagcaccatattgtttgtctcactctaagctgatcacagatcttaagtgggcccttgatgctacctggcagtctcattgtgtttccactgtctcttcattcccaccactctctcagacaactgttgcatactttctacttgctgttcaaacatccatggtctccttacacttggttgtttcctttttcaccagaaaccccagaaataatcagtagagactgccaccagcacacccaccacctgcctgcgtctgtgcccatgctcccacctccttgggcatgatgttctatctccatctacacgtaccttctcaaggacattgctgtatgaaattttccctccctttcctatgtcatctattttcttctttctacctgattcccactggcatatgagttattatttttcttattaaataaaaacatcctctcttgactctgatttctcttccagctactagccagtttcttttcttgcttttactgcagaacgtttgaatgagtcatctgtatgcattaggtctaacatctcccctcccattctatcctgagcccatcacagtcaagtttgcaccttaactcaccgtacttcactggcattgtgcttttcggggccacgggtagcatttccttgccgaagcccatggtcaggacccactcccttcttacttcatttaccagcagcatttaacagtcagtaagtcccctccatgaaatacattctttacaggactgcttggacacacatgcacctcatttttttggttttcctggtctttctcagtctcctttgctaattccttatcgctccaaactctaagcaaagtgtttcagggtacttgttcctcatcgtgtctactctcagtgctttaaatatcacctgtaagatgacttctgcattcgtatttgtagcctggatctctctcttgaactccagaccccttcatctggctgcctgctggacatctct

SEQ ID NO: 120043 - DNA, 1033 bp, Homo sapiens
cccatttgtttctcttctaaagtatataatggggctgggcacagtggctcacacctgtaatttccacactttgggaggccaaggcaggcacatcacctgaggtcaggagtttgaaaccagcctggccaacatggtgaaacctcgtctctactaaaaatagaaaaattagctgggcatgatggcacatgcctgtaatcccagctactctgggggctgaagcatgagaattgtctgaacctgggaggcggaggttgcagtgagccgagattgcaccactgcaccccagcctgggtgacagagtgagactctgtctccaaaacaaagaaagaaaagaaagaaagaaagcacacagtgggtgaagaaagtactcactactcaggtagtgagtacctgaccaatgtagaatgacttttaaaattccagacttgggagcatttctcaggatgccagtaggtattaaaaattatttttgaccaagtaaatttggagaaagatgggttaagtgaagttggatagggattttcttttttatcggtgcttccaaagggggatggtatatgcagcatttcccaaatttatttgaccagggaccatgtatttatttatttaggagcagctcagaggactagtgttccatggagaacactgtgacaaaggctgttctacaccacggaagatttttttcctctctctcttttagagggctcttttattttggtgtatacatgtttattattcagagccagcaaactctgtaactttctccattggttatataaaaagtgttagcattttccttggatatttgtgaggttttgaagggccgggataatgaccgttgagtgagctcttacttggtgccagctacattgctgagcatttcctctagagtctcattagtgggaagtacaaattagcagttctgctttttaggtgagaggataacttgaccaatatgcaatttatgcatcatttccaacatgccagacattttaaggtgaagagattttaaaaatcatgtatagttttatat

SEQ ID NO: 120044 - DNA, 1043 bp, Homo sapiens
ttattaaatagctaacatacttactttagtttagatttatgatatagttctagttttagggttttcctgcatattgtatggtacttttatctccatatataatatatttagtatatttatgcttatttcacaggaactaataacatttatacagttttgaattattttaacggttcacatttgtttcacctttgcttttataacattgttatgtctcagctcttaattaataatgttgcagggatgcaattgctaattttaatattcccccccagaagaaacattttatacacaaacacacacacacaaaatgtatatgtatatatacatacacacacaaaatgtgtgtgtttatagatacacatataaaatgtgtatatgacattgtgtgtgtatatatattggagtaaaaagcaaggatagtcagctcctatgtttgcttatacaagacacaggaactcaagctcgcttgcttgtaaagtgaataaaattgtgttcttatgcaagtgtcacagttttcctgggactcagtttcctcattctcaaagaaggaatttaactgatgaattcaaggatcaactctaaactcattgaattgccttattaatctcttgggtcatgcaattcagtgatataactagggttagcctgagtgtttcaaagcaagattaatggaagctcattcgccagctgtcgggttaggagattattcacaaatgttgccctgtcatttgaatctggtagggtttgctgatgaataaatgaaccccattatactgacagccacctcactaatcgatcctaactaaaccaccttatcctcttcaccttccaattgtgtagccagcaacttgccagatctcagggacgttgttgggacatgtggaaggtctgagacagagggccggaaggacagacaatgccaccaactctattaatcagtccgcatttctcagacctggctctcagcctactgaatttgacaaccaaggatttgcgtgtagttttttttttttttcattttcaattaatttcccttttta

SEQ ID NO: 120045 - DNA, 1084 bp, Homo sapiens
cacagccttgattgactttctgtgctcagcttagccgttcaagcccggggttgtgtctgggtaaagctgtttgactttgggtaagtcctttaacaacctgaggtcccagtgttcttaactttctacagttttgttctaatccagcattcttgaactagcacataagcataacttgctaaataagcaccacttgctaaatacaggcttagtgacaaggaagttatttggaaaatgaaaagagggcaattctcccatcaggacttgagaagccttggagttttctttctttattgaaaagactcatgaggcctgtccaaatctcaaagttgcagagtggaaagttttgtagtaagcttcatggatgtgggatcctggctcaagatctgaactcctagctcagccccttagtattcatgagggcctctgctaagtaaaaggaacctataggcatatgggaccccacaggctgtatgtatgttcttagctgagtatcaaaaaggaaacttccataaatgttctaagactgagagaggcacagctgagaagcaaagttagggatgattttttggaagcttagcctgattttgctctgtgcattatataaatgttagctggagtacaaagaatggaaagcaagagggcaaaggtgggaggtgtttgtaatttgggaagtgcaaatgagtacttagttgttgttttttttccattaagtttgctgttgatatagtgagacttgtgactatgtatcttatgcattttagtatcacagagacctgttttacttaatctgaataatctgttgggtttttgggctgctgacagatttctcatcttgagatttcacctgtgatttgttctaaaagaactttgatacagggactctttaagttaaaactaattctgagaccaagaagctgtcccagctcgtaattcttcttacatgacaggagccaagccatgtggccttctgaggtttcagtatcattaaagtcccgtggaaacaccaaagcccactggccccactttttggtgcttatactgatgctgctgcttctgtcttacaggtccttacatcatgccgagc

SEQ ID NO: 120046 - DNA, 1104 bp, Homo sapiens
agcactttgttgttctactccagggacagcactcaggtacagtagacgcatcttaattgacctccaactaatcttgctgagccaaattgaccaaaggtggccattcctatccctgatgatgctgactgatgctagctgcattttcatagctgttagcatgtaagagagggtacctgctcacacctattcacacctgctaccacccactgaatgagatgctcattgagggtcatgggtttattcctaaacctgtttatagcagttatagtagcaaatgtttttaatgcaacattttagtgaaagatattttatgtagcaataaaatatgagtgcaaaagaagagtgtctgtgacattgaatattgatgaaagtgaattgcttaaattgctgttttaaagactagacaactttatagttgggggaggggtggtgaggagcataataatctagaaaacgtctgctgtcatattactttgcaagtattttgcagttctgcatttttaaagagacttaaattggaagctggaagccatacttgtgagtatggcttatgcagaaaggccactggagggccagccagtgggcttaactcaaagaaaaactttggcacagtattaaagggtagtgaatgaatatttattcataaactttaaattaaaataatgaaggaaggtatgtatactttttagaaaataatttcctgctttaaatgacttttcaaaaccaaattatgtatagatcttgataatgataggcaagaaaacttctactctaatttaatgcttttaaacatgtgccttaaatgttgcatttagctcttggaggacaaaacaaacgtctcagtactctttgtatttccaatactggcacatagtgggcttttcataagtgtttgtcagttgaccaagtgaataatgaatgaatgagttctctttctacttccagagctcatcagtatacttcatgttgtttaactggagattcaggggttttctgcccagtatttacttccctccccactattaataataacttcatcagtatactttgagatgtttaactggagattcagcgtttttctgctctaaaatttattctaccaac

SEQ ID NO: 120047 - DNA, 1262 bp, Homo sapiens
cctaaaatgttccttgagacaatgtggataaacaaggttagggaagatgaaatttttgaaatgagagactcaacactggctgtgtggacaggagttgggaattcattctgataaggaaaacacattctccataactcagtttgtgaagaacaaattagctcttatgataaccggcagtgtaaacgtgagagtactgttccttatagagtttgtacaacatgctttaacactaaaattgcatagcaattgtatagtactatataagggcttagtgggaatatagtgataaatgaattttttggatttattaaaatgctgatttaaaaaaatagctttattgggctataactaactgcagtaaactaaagtgtacaatttgataagtgttgacatatgtatgactctgtcttcgccctcttccccacctgcagtcaatctgcaggtatctacttttggttgctgtagtttgcattttaaaaattttatatgaatgatgtcatacaatgtatacttcttcctgtctgccttctttcagtcagtttaattattattattttaatttttaattttatttttagttctggggtacatgtgcagggtgtgccagtttgttacccaggtaaatgtgtgccatggtggtttgctgcacctatccatccatcacctaggtattaagcccagcacgcattagctatttttcttaatactctccctcccccaaccccagtttaattattttgagattgatctactttgttgcatgtctcaatagtttattctttttgttgctgagtagtgtttaattgtgtggctatattacagttcgtttatccattcgcctgatgtgagggacatttgggttgtttcccatcttggctatgatgaataaagctgctatgaatatttaagtacaagtttttgattggacctgtactttcatttcccatgtgtaattacctaggggtagaatggctgaattgtatagtagctatatgtttaactttttgagaaaccgtcacacttttccacagtggttttactattttacattgtccccagcagcatatgagagttgtagtccctccacatcctccccaacactggtatagtcagtctttttaatgttagccattcaacaagtatgtagtgctttttcattgtggttttaatttgcatttccctaatgacagaacatgtggagtatctttttatctgtttatttgccatcacgtatttccttctgccattacagaaattgggct

SEQ ID NO: 120048 - DNA, 1057 bp, Homo sapiens
catgtatatgttgatttctaaatctgtgacctctgctgtacccaggtcttcgtccccacctaccagctgcccaatagggcatctctacaaggacagccccaggcacctcacactcagtatgtcccacactggactcctcactttcccccctaaaaattgcttatattctgtatttctgtctcaattaatggcattgttgttcacatagtctcacaagttaaaagctgagccgtgctcatctcttggtccttactgtcatattcaattggttgctaagcttttaaaaatattatcttaatatctcgtggtctggttctttctccttgttttcatttccactgccatagtcactttctcccttgcatctttctagttagtctccctgcttctagttcttctcttgcaagtgatccttcatactgtcatccgagttatcttttcataattcaaacagtatctgttctttgcctaagctctcaaatggctggctttcctgataaaatgtaaattgtatagcctgacacagaataccactgttttcctgttcctgaacacaatcaggctctctcatattttcagcaccattataatagctctaatcctgacaaattccaaaagatttaactcaggtatcttctcatctgtaaagagagtctttattcatgtttccaaagaactttggatcacttcctgcactagtacacatcatactgtgttgtaagtgcttgttcatacacttatatattccatgactatttattgattttctactatatgctaggcatagtgctaagtgttgaggtccagcagtgaacatggtccctgcccacgtggaacttacattttaacttggggaaagaaaccccccaaagagggaaatacataaatcaagtaacagtacctttgagtaagtgctgtgagagaaatagatgggactcgtataaagaataaacttctgtctccaaaggcctccctgtggccatgataacttcaacagacctaggggaagagaaggcgcctgccctataagagtagggcaaagaatatcatcttccca

SEQ ID NO: 120049 - DNA, 1049 bp, Homo sapiens
gagctgcatatgttctctgccccagaagaatcatggcccaggggaagaggtagcaaaaggaacaactattccagtatgacttgatcagtttcttgatggacatgtgtgcaaggcactatagaaggacagaagagatttttactttaattaattgaaaattagtaatttatatttggtatatacgtaatctaataattcattaagtggagcaacttttcaaactattctaacaaaatctaacattataaaactataacatggagactgcattgctaaatacctttcatctacaaaggaaagttatagggatttattatgttttctagatttctagctctctagtgctcaaaaaaattgaaaattgaaaaattgaagaaaaactgaaattgaagtgaccctcatctttgttgaagaaaaaggaatgtgacaaaatttatttctatgtgcagtcaaaaagtgtggtttgtgaaatgtgttgttgttgttgatcttacaggagaatcatgaaaaaagtctccatggagccatctgagcgcctggctagtctccaggcgctgtgggacagccagaccgtggctgagcagggcccctgtggtgagcatgcattttaaaactgaaatgtgaatagctggatggatatccccctgccaggaagttaagtctattcctagtgtgctactgtaaaggtgcaattagtttcaaggtgtaattagcagcgcacagactttagattggtggacaaaagtcctatatttaagctgtattgcatcctgctatgtacttactatagaacagggaggagaatctttgctgttttcccccctaaaaaggaaaaggataatcagcattgtcaacatcggccatatttaagctttaaaattttaatttaaacatcattttgccaaagacctgtcagtgtttttgttgtatgtttcaggtggattttctcagatgtatgcctgtgtttgtgactggcttggattttcatacagggaagaagtacaatgggtaagaatgtctgtgtacatgtgcatgagcacacacactcc

SEQ ID NO: 120050 - DNA, 1055 bp, Homo sapiens
gagggggacgaagagagggaagaccataaaataactattgaaagagttgttctcctttttttttttttttttttttgagacggagtctcgctctgtcgcccaggctggagtgcagtggcctgatctcggctcactgcaagctctgcctcccgggttcacgccattctcctgcctcagcctcccgagtagctgggactacaggcgcccgccactacgcccggctaattttttgtatttttagtagagacggggtttcaccgttttagccaggatggtctcgatctcctgacctcgtgatccgcccgtctcggcctcccaaaatgctgggattacaggcgtgagccactgcgcccggccagttgttctcctttttaatctaaaacttaaaaaaaattttaaacttaggcaaagttagtaaagaggcttgtcagtagaaaacctggcatgtggaaacacatgactgagcctgcctatttctctggattttttttttctactatctgtgggcactcatctcatctttttaaagcatgtctattgaaactgcacacatgtggtgcttcagagccagggttctgactgtagttctgtccctttggcctagtttcagtttattttctgaacatctattccttcatctgtaagatgtaaacaacagtgactcctggggttgttttgagatttaaatgaactggtatatgtagagtgccaagcacagggccgggccacccagagctatgagataatattgattctcagacttctttccaccttctgcctttctcttctatttcagtaaaaatctgagtatctgctacttgtcctgcactgagcataaaactgatatgacctcactaaagctaaaaaactgaagtagacaaaggcttggttttcaaagaattgaataattgggggtggtaggggactgatgcttaaagcaacaaactataatataagatagaataaataaatgctaaaaagggaggtggggtttgaccaggagaggacttaaggaggtgaggatgtgtaatagtggcatttaaggacacatagtt

SEQ ID NO: 120051 - DNA, 1064 bp, Homo sapiens
gtcagtgtagctactgtaggagcactttcatgtactttgttgtttctgcttccagggacctaatacctatcattgctgctctggaatataatcagtggttcacaaaactgtcctctaaggatctaaaactggtaagtaatcaaacatgcagcaaatgttgcttggctttgctgaatttcaaaaacccaataattgtgggaaaaaaacaatttttttactgtactagtaagctgtatacattttatttcttgaggaggtattttcctttaaatgatttgcgtaacatttagtcaaatttgtaatgtgagatgcttccaagtatttcctcatgtattcagctgtttcgggcaatttaagaagatgaacaaaaagatacatttagtgtagcctttagtataaagtcattcagttggcaaaaactgttaaagttacatttgcacagctgcaaatagcagattttatattcctatcttacactctgtctctacaaagtttcccttcctaggaatttaggaaaacattaacaggtagagttcccctggtcgagtaatgatagttaatgttgattttctagatggggttttgggtagatttatatgaaagcaaaatgaaattaaagtgaaatctgttttcataagatatgaaggagaaaaatatttggtatattttattagtggaaataagatgctgtgttggggttgctgccagttcatatcagtcatatggacagatgcttatacataaattaactctctggtgtttgttatgggataagaaagaatttatatgttttcctggagactctcacgtttaagcctctaactttcagaggtcatagaatctaggggtttaagattttcatagtgaatacatcagacttggaatgagacgtggatctgtaggacatggagggttgagactggctagtgggcaggcgacttggttctctgaatttgcctggggtaggggtggcctaaaacattataagtatgaaaatggactaaactcatttggggtcccttaagagccaatatggtagaggaaaatgcatgaacttggaataa

SEQ ID NO: 120052 - DNA, 1126 bp, Homo sapiens
ctgtcaataactgttacccacctataagagaacttagttctatccatacaggataagcagcctcctcacatattcattctttgttttctgaggtgaatttgtcagtttagttcagtttatgttaatttgagccatttatgttatgtatgtaaagagtgtatagagtgctaattatacatttttccttatgattgcatcttacatggtatacagatcatctcctcattctttgtgaaatccattttaatccaaatgtttccttgaatgtaatacatttaagaagagctgtctacttctctttttaacttcccaatactttaaatagcctaaattatctgaacttggacatgcatcatttaaacaccaggcactaactcaagaatcacctggcaggattaagagaaggataaacattgtcaactagattgctttcatcattctaaggcttcagattaaaatcctttctgtccttggacacatcagaagacatggatcaaagggaagccaattcattactccttctgattcagtgagggggttgtgtctttgaccaacctgttcttcctgagggtgtatcaaaaggagacacaatcatagcgccacctttcagggacagtgctcatggttaacctcagtcctgcaatttgatggaagtgttgggccatttatagaaacacaaacctcattttgtttcctggagtgcaaactgagcctggattttcttgatgttgcaggggtgaacagcctttctcagtcactcagtgccaatccattgaccgcctctacccttgtccacctcgacctctcagggaacgtccttcgtggagatgacctctcagtaagttttcttttctttattccatcttcgaagaagctgtgtttaataagcctggaataattctaaacatgtctttgtagtgcattttcctgcctctctctttgtcatgacacctttgaatcatttagttacgagcttatgaagtgttttactgaaaattccagagcattcgttaattaaatgtcatatatcaccacaattatttttttttctcatttagtgatgctgaagttcacatttttttggaagtaatgctgttgaagaatttttttcttcatttaaaaacat

SEQ ID NO: 120053 - DNA, 1031 bp, Homo sapiens
agcaattgaacaagtacacagatgagatatacccagtctttctcaaaggacactgttttagaataagggattagtgaactgaatttaaaaagtgaaaaggaaggcactcacctccagcctcctaacaaggtcagggagtgggaggaggggggttttcatagctggaggcagccgagcccctatgtgttccatgccactgctggagttctctcttagtagataaagccagagaatcactagaaaagaaagtctcagagacttgggcataaaataattccctaccttcccacctcacccttaccctagggtatttttggggtatgctgagtggaggtccttttcctgggaacatggaaaacaggtaatcgcccccagttaataaatacctggtttccactcttctagtacttaccactggcagccttgtgttggagttattggcacacatatctgttttccttgcttgagagcaggaaccatcttatgttcatctctatgtttttcacaaagtctgatttagggtcttctgtccacttagtataatttagtggttgtgtgtgcatgtgtgaattttctgtttcaagcttgcttgatggtgttggattttataggactgacttgtcaaagtggatccaagtgattagtctaatctcctcaatttgcagatgagaaaattccttttcagagcagtgatatgatttgtctcagctcagcaggtagttggacaggcaggatcctggactccaattcaagacatatgccttgttttatacccttgcccacccactactgtaggtcgtttaataaactcatctagatataatttgacatcctgttatactacagagcctgacttcctcacttacatattccttagggaaaactagctttactttgcgactctaataacaattgcttaataatattctaaacgttattaaatctcttctcaagcagatgcagtgggaatttatctgtgatgagcacaatttaatttcagtatgcaattaggtgtgctgttggtttatttg

SEQ ID NO: 120054 - DNA, 1008 bp, Homo sapiens
gttgatagctgaccaatgtgggggtaaaggcagtgagaagctaggagggttttgtaggcaacactaagtgagcagagcccatacttctctgtgagcccaaggtcttaacccccttgctcatgcctgccgatataaagacttaaaaacaaggggtacaaaaggtctgctggttcaaaacccaaaaccaggctcacactgggtgctagctgttctctttagcagttttattccatgtttcctaagtgtggcttttctcaaggactagctccactgtcaccttgttgccatccatcattcagagagattggtgttgctacctaggtcagcagtctggtgaatgaagagttaattcacattgctcctcaagggctctttcatgatgtttttctattctccggcataaaagtctaagctgaagccaaaacccaaaatctgcagcaatttctttgaaggtcagtatgtgtgtaaagaaggtcatcgagattaggaagggaaggcagtgaaagttgtgaggccgggatcatccagacaaataaaagctattttatgtgtcagggtgaactgacaaatcctaaatacccctgaagtatacacattctgaaggtaaagtaatatttttctccccaaatagattttgtgtttaaaaagcaaacaaactcctgtttatagtaactgatgttttgccagcagagtgaggaagttcctaggattactaattaagccatgtcagggaaataatgaaaacacaaggaactatgacagattctctctagtgttttagaaacactagtgttttactgtttggggggaacaatctcagtagctgaaattctttatattgggcatggaactggttagcatcttttgtaaatagcttccacctcagacataaatataagaatatgattgggagaatatcagagaaatatcagaatttagagttttctgtctagtgaaagttagataacataatagtaagtgaacatatgtgctattgctttaagtaca

SEQ ID NO: 120055 - DNA, 1048 bp, Homo sapiens
tcaactgctattttctgtaattcgtaaatcaaaaacataaaaataagtatcctatttaaatttaaaatggaagccaccagaggaattaaagaggcagaggctttcaaaagaatttttctctgcaaattgaaaagaattgactagtagggaaatttttgtcattttagaccatgttgaatggtttgcattattttcttaccttgttacaaatgttatttaattttttgttgcttcttctttgaaagaaagatgtccataataaaaatgtcatgcataatattccaattaggtaaactatgggtgactgtatagataggcatagagacatgtaaaagggtgttcatcacaatattaatgatggttattttaggtggtatgaaaggtgtattttattctcttctcagtatggtttgaatgttttacagtaaatatgcattatttaagcaagaaaaagtaaaccaatatgtgttgagaagaaaagttatactagtgaagtagcaggacttttgagaaagaaagccattattttgaccttaccagtcccttaaaaatctaatttcttttcctgcaaggaactaatactactagcctagtattttatggtttactattattaacaggttttagtgtttaacatgaaatgcaatgaaagttacactgaaactttgtcttgtgttcctttatgagctacaataataaagacttctcactctgtcgcccaggctggagtgcagtggcgcaatctcggcttactgcaacctccgcctccctggttcaagcaattcttctgcttcagcttcccgagtagctggaattatagttgcccatcaccacacccagctaatttttgtatctttagtagagacagggttttaccatgttgcccaggctggtctcaaactcctcacctcaagtgatccacccaccttggccttccaaagtgctgggattataggtgtgagctaccatgcctggcccaagacttcttttcttttcttttttttttttcttttccttttttttgagacagagtttcactcttgttgcc

SEQ ID NO: 120056 - DNA, 1036 bp, Homo sapiens
catcccggtgagcccttgactttcagaaagtaaacaattaactacatggcaggtgtagggagctcttttatatggcttctaaacaaccaatgtttaaaaattaaactccacttcccacctgatcttacaactatttaccaaagttctcccaccaacatcaacattatttagcaattctttaattgcagaaccctcctaattcactgagcaacccttagagttgggagagaccacagaactatatcctgctcactcaacaaaggaggcatggtgtggccctcactggtcagaattctggataatactacaaccatgtcattagtgagtcagatgcccaaggaaatgttaaaattttaatccatgttgtgaatttctttataacaatgaatgtgcggttttgattaatatgctgtttatgtttttcatgattaacagtttctttttggtgtaaagatgacatttactagagtgttttattcatgtactttggatttgatatataaatcgacttaaagtgacaaaacccttatggttttatatttgtttagggcttacacagtattaatgatctgttagcgccatctagtgtcactttaaaacaaccattgttaaaaattcttgctatttaaaattcagaccagtcatgggtcttctgtcaaaatcattaaataatgaagtttttcaaaaattagctttagaacattttttttctaaagtaccatgactgtattctttctaaaggtagcaacaatagcatcaatgatcaatatactgttgataaaatatatgatgtcttcaccctcctataagtaattctctttgcgttgctggcatttgagatatatacatataaatatgtttaaagaaaaagaactgtaagtatgaagatatgacacttttcatttattgacaaaagagagaaataagcagtgaatacttagagttcatatattttcctctggggcctccaagtcatctgtccacacacaaaggcaatgggcattgtattattttatccttattccccacagtcact

SEQ ID NO: 120057 - DNA, 1008 bp, Homo sapiens
cccttttgtttgtggatgttacttcactgagcaaaaacacaaaactaatttttggccagaaaaattctatgatgctttatttttttaaatgacttatttttatatatagatttaccaggctttatgttcttggaatccagtttgtggaacagtttgattcacgtgtttgtgtctccttagatgacattccagactctccatctagcccgaaagttgcccttcttccacctgtcctgaaaaaagttccttcagacaaagagagagatggccagagtagcccccagcccagccccaggacattttcacaggaaggtaaggattgtaaggatttcttttctctgggttagctctccccaaggagggacatttcaaaataaaggaactcatcctggactttactaatatcttagagtttgttaaagtcaacattgcttgggttaaatttttggaaatggagtagtttcttagttcagaaacttgattcagcatgattgatgacattggatcttaatgacatatgaaaaaagcagctgagacacaaaggtctaacttatttgcaagaataatttctagatgcttctgaactgacttccagcatgttaggagctccttaaacatgattttatgacgtatttggggctacctatagatttctgagtcctattattttcaatgaaatcttttcctagtcgtggcaaatcagtactgctatagttcaggagcagcacccccgggcctgagccaccttgcagctcactgtgctcgctcagtcacaaggtcagatgttccttactctcagaagtgtggtgcagacatggacattctcagggcgaccctgcaccagtttgctccttctaatttgctgaggtagaagcacagcaagctaatcctgtgacgagaatgctttcttcccaaatcagactgagctgttaccaattattatcaaaggtgaggcatggttgtggcttcagcacccatgccatttcttttaaatgtgtgattgacttt

SEQ ID NO: 120058 - DNA, 1304 bp, Homo sapiens
ctgcaactgctgactttacatctttacttttaaggaagcgttgaaaatgcctgaaagagttcagttggagagaaaaagaaaagtgaggaagggatggtagtgctaagtaggaatgttcatctatcttgtctgaagcaattgaaatattgaaggatttacaaaaatagaagaaaaaagatcagaaggttgaatacaaaaatcattgttttaacatttctggaaagtggtgttttctagatgcctatagattatcaaaacaaggcctagagtaacccaccagcctcacaagtacaaatatagatcatggagcctctctggttagcaaagtcggggagatactggataccactgcaggctcttagctgccgtgaaaaagttgaatgttctttcccctggaagttagaaatagaatgtgttcctccttaaatgtttcagagctttaggggtatatgtttgattcccttcctcatccttctccctccccaagtagcaaatcttaggaatggctcacgctcccttctttccagtcagacggtagggatggctgagctgtggagaccatgactttcccatctgggatccagaataagttaatcatagacatcatcctggtgttatcacttggtattgaaattggactgaaaatgtacatgaagtctgggaacagtctgtaaatgtctgaggtggtaagattttgactttatcagcttgtccgctaaggttgcccagaaatggcagccacttgtgagttctatctttttctttataaactgtccatattgtgctcattctgttttcttatctattattcatgctgattacttcatttccctgttctttgcctccctttggactagcatgcccaactaatttctgaaacaggtaaattgctatgattcttctggattattccatagtgaatgtgattttcattaatccatcgtggaatcaaaatggtaatactggagcctttttgttaatacttttttggggcagactcgcagctcacctcattttgcacgacatttccataatgttggctgttgaattctgtagataatgatgcatatctgcccaggaccaacactgtaggttccttgaatcctaagtggggtgggtaagctgatatttaatttttaatatttttaaatattaatgtcaacacattgatgtatgtgctaataatataaagggtaaaataaatcccttttcctcagtagtgcaaagaggagattattacaaaagacattcagatcatgacagtggcaagccttccagtagagggaaaagatcttcaaaactgt

SEQ ID NO: 120059 - DNA, 1356 bp, Homo sapiens
cacctccggcatagctaccacacacttctgcagcgttacacggttcttttccagggttacacagcactttccagtgctcaacagctcttcagtattaaacagctccaaatgacctcagctccaagtctcgccaagtaaacaaacagaactggaggatgaaagatgcggtatttataggcacggccctcaaacgccgcgttcggtatccaaaatctgattggacaatgggaagtggcgtgaatgcaaatgaggcgattctagtacgactttctgattgggtagacggccatcagccaatcagatagcaaatgccaacctcagtcagactataaataggcccagtagcagccctagaaatgtggttctcgtgttgctgcaatttgatgcgaggagatgtctggacgagggaagcagggaggaaaagcacgcgccaagtctaagtctcgctcttctagagcgggtttgcagtttcccgtaggccggatccatcgtctgcttcgtaagggaaactatgcagagcggataggggcaggcgcaccagtgtatttggcggcagtgttagagtatctcacagcagaaatccttgagctggcaggcaatgcgtctcgcgataacaaaaaaactcgcattattccccgccacctgcagctagcgatccgcaatgatgaggaactcaataagcttttgggcggcgtgaccattgcccagggcggagtcctgcctaacattcaggcagtgctgctgcccaagaagactgagagtcaccaccataaagcccaaagcaagtaacttaaggttgtcattggtaaaaagacttctgtgtcagaaaaaacaaaaggctcttttcagagccacctaccgtctcagaaaaaggctgtacgttacaaaacgttactgctgttaaccagccatcttacttgcctgtcacaaatgcccgtttaagcgcatttcgggaatgtacggggactgaattttcaaggagcgttccatcggccattagtttgaggtaattttggttatatatgtcactgggcgaggtggcttaacgcttgtgagcagtcagtacttgcacttcagtggaggttggagcgggagggtcgttcaagcctggggcttgaccgttaacataattgagaccctgtccccacagaaactagctgggtctggtgatgcaggcctgtagtcccagctgttcgggaggctgcggtgggagggttgttcatgagtccgggaggcgaaagttacagtgaacgaagattgattgctccactgcactccagtctgggtgacatgagcgagactatctcaaactagatttatgtatgttagttatgttaagggttacacatggaagtg

SEQ ID NO: 120060 - DNA, 1530 bp, Homo sapiens
ttgatgacaactggccctaacacggcctaaaactcgcacttttctctccctccgcaactattcaaaacactgtattttacatttcttgcaaattaaaaactaacatctctggcaacggacctctaaaaatttctaataaaactcctcggatgcttgtggcactgcatttgtaaaccgccccctctcaacctactccctaaaaaagagctgctttttgagagagaagcggtaccctctgatgttactgggcggcagtctgcctacaatttccttcacaatgaggcaaccagagcggctttttctgtgtgtttgcttgcgttgaggggagcaggaccataggccctagaggcccccagctgccttctgagactgggcgaaaccctcggcagcgcgcagggggcgctagggcgcgaggggcgggcactgacgggcaccaatcacggcgcagtcccaccctataaataggctgcgttggggcctttttttcgcatcctgcttcgtcaggtttataccactttatttggtgtgctgtgttagtcaccatgtctgaaacagtgcctcccgcccccgccgcttctgctgctcctgagaaacctttagctggcaagaaggcaaagaaacctgctaaggctgcagcagcctccaagaaaaaacccgctggcccttccgtgtcagagctgatcgtgcaggctgcttcctcctctaaggagcgtggtggtgtgtcgttggcagctcttaaaaaggcgctggcggccgcaggctacgacgtggagaagaacaacagccgcattaagctgggcattaagagcctggtaagcaagggaacgttggtgcagacaaagggtaccggagcctcgggttccttcaagctcaacaagaaggcgtcctccgtggaaaccaagcccggcgcctcaaaggtggctacaaaaactaaggcaacgggtgcatctaaaaagctcaaaaaggccacgggggctagcaaaaagagcgtcaagactccgaaaaaggctaaaaagcctgcggcaacaaggaaatcctccaagaatccaaaaaaacccaaaactgtaaagcccaagaaagtagctaaaagccctgctaaagctaaggctgtaaaacccaaggcggccaaggctagggtgacgaagccaaagactgccaaacccaagaaagcggcacccaagaaaaagtaaattcagttagaagtttcttctagtaacccaacggctcttttaagagccacctacgcatttcaggaaaagagctgtagtacacagatgaaatcccccaagcaaatgcaacacgccctcaattatattagaatcacttggagagtcgatagaactttaacatagcctcatctagtaagaatttactactcaatctatcaaagatagcaaggtgaattcaaatgcaccgagttaaaatcgagttttaaagtcacctgggtttcggtagccggaagtcccgcgtctcacgactccaagctaattagtcataaccgtattgaaccaaggttgaagcccagtccca

SEQ ID NO: 120061 - DNA, 2202 bp, Homo sapiens
ccacttaaataatcatctgtagagttggaatagaatatagtagccggtgaaactgcacgattgttgctggcttaaagatagaccaatcagagtgtgtaacgtcatatttagcgtcttctatcatccaatcactgcactttacacactataaatagagcagctcatgggcgtatttgcgctagtgttgggtgttccgctgtgctgtttttccgtcatggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcatctccccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatcagaactgatgagctaatatttcctgaggcaagccagggagccggaggggaagctaagaagcttattgagaaaaaacaaaaaccctgttttaggaaaaaaaaaaaccatcttttagcgattatgaaataaaatcacagagacatttaagtatccctcaatca

SEQ ID NO: 120062 - DNA, 1060 bp, Homo sapiens
aaattcagattcaaatagtagtgtcgtaaacgggagggaaaaactaaagggattaaaaagtgaaactattgtgttctccctcgcagtccttaggtcactgcccctcgaggggcggagcaaaaagtgaggcagcaacgcctccttatcctcgctcccgctttcagttctcaataaggtccgatgttcgtgtataaatgctcgtggcttgctttcttttcgcgtacctggtttttgttgtcagctggttagacatgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaatcttttcgtcagttttcttccaatggcccttttcagggccgcccactccctctcagaaagagctgtgattgtattctttcggatggtaacatctcaatggctttactcggctattctgcctagtatgtagaactattataaaccagttgggagagaccaggttgtttggtctgagtggctgctaaagcagaaatcagctaagtaaacgaggtctccgagataagtgagctataaacttcaatgctatagttttgacatgtcaagcaacttaacgtgcagcgcgagtccgataaatgagtagctcagctttttagttttaaaaacgagttgtgcgttatttgtacgagagcctaagatgctagctgcctggaactgagtaggtggattaaaatgggtgtcaggtctgttttcccaggcgtatctgacttaacgtcagcaaaagctgtacttttagcttccctggtaacacctgccgtccttaaccgccccctgccggt

SEQ ID NO: 120063 - DNA, 1034 bp, Homo sapiens
aaaagaagagtagctctttcctttcctccacagacgtctctgcaggcaagcttttctgtggttttgccatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgaccgagttgctgattcggaagctgccgttccagcgcctggtgcgagaaatcgcccaagacttcaagaccgatcttcgcttccagagctctgcggtgatggcgctgcaggaggcttgtgaggcctacttggtagggctctttgaggacacaaacctttgcgccatccatgctaagcgagtgactattatgcccaaagacatccagctcgctcgccgcattcgcggagaaagagcgtaaatgtaaagtcactttttcatcagtcttaaaacccaaaggctcttttcagagccacccacttattccaacgaaagtagctgtgataattttttgttgtcttaacagaacaaatttctaaggacccccccggaaagcattagactatggtcttaaagttgattaacagaaataacggtttggtcagtcttgcagtgtaggttatttctgaccttattaaggtgctatttggagagaagctgtgtaagtccactatcattcaggcctctagcttgctatgattagcatttgtttaaacaactttgtaagagtaagggaaaaatctggtaagtagttaactggcgcttactaggcatttttgcaaagctttgaaaagattagaaaattgtgtcttgcgagttccagtgtcttcctcaaaatgcttaggaagattttctcagctcaatacatagtcccctaggttttctcatatattatatatatatatatatatatatatactgttaaattcatttggctgttaacattaacctgaaatttattctggtgcaaaatgtg

SEQ ID NO: 120064 - DNA, 1074 bp, Homo sapiens
ggatgatgctgcgggtcttgtcacgtatggcgctgcccaccagttctaagatctcggcggccaggtattgtaagtacactggcgcaccggctccgaccggctcaaaataattgccctttcgaaaaagatgacggactctgccctattgggaactgcaagcccggtagcgacgaacaagtttttgctttagctccattttccacgtccgcaaatagcgacctatgaaagcagcggaaaactgtgaaagacaagcaagctggaatggcgcctgaacaaatccttttatacaaactgcaaggctgcaataggaagctatcctattggtcaattatgtttggtgctttatccaatagaaaaagataacataaattccatatttgcataaaccccacccctcagtgaaaccgtgtttcttttgtccaatcagaagtgaggaatcttaaaccgtcatttgaatctcaggactataaatacatgggctctgaactgttctctgtactactctgtagtggagagtgttagtagcttttctattctgtttaggaatagcaatgcctgaaccctctaagtctgctccagcccctaaaaagggttctaagaaggctatcactaaggcgcagaagaaggatggtaagaagcgtaagcgcagccgcaaggagagctattctatctatgtgtacaaggttctgaagcaggtccaccccgacaccggcatctcatccaaggccatggggatcatgaattccttcgtcaacgacatcttcgagcgcatcgcgggcgaggcttctcgcctggctcactacaataagcgctcgaccatcacctccagggagattcagacggctgtgcgcctgctgctgcctggggagctggctaagcatgctgtgtccgagggcactaaggcagttaccaagtacactagctctaaataagtgcttatgtaagcacttccaaacccaaaggctcttttcagagccacctactttgtcacaaggagagctataaccacaatttcttaaggtggtgctgctgctattctgtttcagttctagaggatcaactggaatgttagcg

SEQ ID NO: 120065 - DNA, 1343 bp, Homo sapiens
aagaattcacagaggacctgtgttacttcccttgtgaagaaacagaattatcatgaaaatttaggtggaaaccatttcgcttttttcttcaaaaataagggaagcatgtgcccaaccacccctgggaaaaagaaccttcaggggcaaaggagcgaacaggtaatttataagaaaaacagaaagtggtctctgactgccccagacttccttcggagttgggggaattggggacgcctggacgcgttgtttttgtgtttgtggaaaaaataaatgaagagcatgaagcccgaggcttctgagatcctttcctgaccaaacccaagtgatttggtgcggggaattttaatatttttccccttttgtgaggtggaacaaacacaacttgggagcagcgcagcggctcagagcctgccagccaggcgggcgaccagagcaccaatcagagcgcgcctgcgctctatatatacagcggccctgcccaggcgctgcttcatcggcgctttgccacttgtacccgagtttttgattctcaacatgtccgagactgctcctgccgctcccgctgccgcgcctcctgcggagaaggcccctgtaaagaagaaggcggccaaaaaggctgggggtacgcctcgtaaggcgtctggtcccccggtgtcagagctcatcaccaaggctgtggccgcctctaaagagcgtagcggagtttctctggctgctctgaaaaaagcgttggctgccgccggctatgatgtggagaaaaacaacagccgtatcaaacttggtctcaagagcctggtgagcaagggcactctggtgcaaacgaaaggcaccggtgcttctggctcctttaaactcaacaagaaggcagcctccggggaagccaagcccaaggttaaaaaggcgggcggaaccaaacctaagaagccagttggggcagccaagaagcccaagaaggcggctggcggcgcaactccgaagaagagcgctaagaaaacaccgaagaaagcgaagaagccggccgcggccactgtaaccaagaaagtggctaagagcccaaagaaggccaaggttgcgaagcccaagaaagctgccaaaagtgctgctaaggctgtgaagcccaaggccgctaagcccaaggttgtcaagcctaagaaggcggcgcccaagaagaaataggcgaacgcctacttctaaaacccaaaaggctcttttcagagccaccactgatctcaataaaagagctggataatttctttactatctgccttttcttgttctgccctgttacttaaggttagtcgtatgggagttactgaggtatcagacgaattgggtgacggggt

SEQ ID NO: 120066 - DNA, 1371 bp, Homo sapiens
acctttttgccttcccaaaacatagggtctttaggagtgaaacttcatagccaaacttataccttgtccagcacagagaaggccatcaaaatgcctggtttaaataaaaatattaaaatgattgggagggtaaatcccttgacctataaatctgacctcctttaaacattatttgtatgttccccaataaactattccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccacttggtgaccaaatttgaaaaaaaaaaaaaaccgcgccaactcatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacatcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagagagagactcctcaaaaaaaaaaaaaaaaaaaaaaaaaaaaattatgtattttag

SEQ ID NO: 120067 - DNA, 1021 bp, Homo sapiens
taactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagtaagcgtcttaacacctaaccccaaaggctcttttaagagccacccagatacccactaaaagagctgtggccagacgccaaattttatttggcggcggaggggtattagaatataggaactggagaggggtggggacaagtgttgcagcttagagagggacaaagggtcctgaacccgaaagaagccagccattaaaaatggctttggggtcaattcgttgtgcttaaatttaaaatggagacaagcggccattttgctaactcggcgttcccggaagaaaccgcaggctcgcttaggtttcagacccagctgtctgtccctgtctacgtcgccaggatcaacggttgccgtaatgtcataatttcgccaccagcttctagccaataggctgtcctgtcattttaaatattaaccaatcgagggaaagctgttttgagactctgatttacatagcggaccggagtgggaacctgggcagtaactgcctaaggaaggactccccctctgttttcgtggcgcacaccttcgtagtat

SEQ ID NO: 120068 - DNA, 1108 bp, Homo sapiens
ccgcgatgcgctcaaatatgtcgttaacgaaagaattcatgatgcccatggccttggaagagatgccagtgtcgggatggacctgtttcagcaccttgtacacgtacacagagtaactctccttgcggctgcgcttgcgcttcttgccatctttcttctgcgctttggtcactgccttcttggagcccttcttcggggcgggagcagacttggctggctcaggcatcttaaaacaccagaaatgtgtcgaaagtaaagagcggatttctgctacttatagggcttttatgctaatgagggatggagagtacctcttagttaattggaagacaaactgcacagttgtcatccgtgggcagagctatgcaaatgaggtatgaaagtacagcttttctattggctatctgactagcatttgctaccgaccaatcaaaaagtcggatttactccccaggaactacctataaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaaggcactaaggtaagttaattttatgccaaccttgagcaaagcgtat

SEQ ID NO: 120069 - DNA, 1897 bp, Homo sapiens
aggactctccgaggagcctgtgttacttccctcacttaagtgcagatttgtaataaaaatcttaatgccagtggcatgctttttggatatataagaagctaaccacttggagtatcatatttgagaggtcagaaaagtccacagttaaagatcggtttataatttacgaagaaaatagaaagttttgtttctctgagttgaaatttgccaagcacggcgggaaatattgcaagtttttggcacaaggctttgtgcttcccttataatttgagatctgcgtgaagcctgagggttcggggatcattatctgagaaaaaccgggcagttcggtgtagacaatttttatatttttggctttttttgaggtgtaacaaacacaactcgggatccgagaggacactctgcggctgccagcgaggcgggctggacagcgcaccaatcacggcgcagctccgccctatataaacgggcgggcgcagcgccgcggctcgagtcccggccagtgcctctgcttccggctcgaattgctctcgctcacgcttgccttcaacatgtccgagactgcgcctgccgcgcccgctgctccggcccctgccgagaagactcccgtgaagaagaaggcccgcaagtctgcaggtgcggccaagcgcaaagcgtctgggcccccggtgtccgagctcattactaaagctgttgccgcctccaaggagcgcagcggcgtatctttggccgctctcaagaaagcgctggcagccgctggctatgacgtggagaagaacaacagccgcatcaagctgggtctcaagagcctggtgagcaagggcaccctggtgcagaccaagggcaccggcgcgtcgggttccttcaaactcaacaagaaggcggcctctggggaagccaagcctaaggctaaaaaggcaggcgcggccaaggccaagaagccagcaggagcggcgaagaagcccaagaaggcgacgggggcggccacccccaagaagagcgccaagaagaccccaaagaaggcgaagaagccggctgcagctgctggagccaaaaaagcgaaaagcccgaaaaaggcgaaagcagccaagccaaaaaaggcgcccaagagcccagcgaaggccaaagcagttaaacccaaggcggctaaaccaaagaccgccaagcccaaggcagccaagccaaagaaggcggcagccaagaaaaagtagaaagttcctttggccaactgcttagaagcccaacacaacccaaaggctcttttcagagccacccaccgctctcagtaaaagagctgttgcactattagggggcgtggctcgggaaaacgctgctaagcaggggcgggtctcccgggaacaaagtcggggagaggagtgggattttgtgtgtctccggagctatttttgactaaggcgtcgcgtcgcccaagccggagtgcagtggcgtcatctcgattttgcgttctcgagtgtcggagttgaacccatttgggcctcccttgtgctttgcacttttagcaggccctggcctccagatagcatgggaaaaaaaatgttgggattttcccgggtttctaagctgggtttttccgagttccaaacacggcacagtgtatcagtttctgtgctggttacaagcctactggttatccctatcgagtatggcaggcagtgagggacttcagaggagtacgtcttaggacaagtggcatagtactgacattatttccgaagggctacatttcaagtgcttggggagactactgccacataactgaaaattagaaaccgacactgcagaaaaatacttggtccttaaatgtggcatttggatggattaaggacttgccgaaacgtaaaactgacagacttgggggggggggatgtcccaatta

SEQ ID NO: 120070 - DNA, 1093 bp, Homo sapiens
attgcctaccctttattttcacgatgtgtttgtgcattctgtaaaaagtgggaaacactgttctccggattgtgtgggtgatcgccggtcgcctagcttgccgttcttcaggtatctcctgctgctccagaatctacatctgaatgtcaaggcatagcttttccaggagcttttaaaccgacctttcaattcgaagacgtaactgcgccaggagctttgtctccctggcatataaaagcatagaagagagcaacttctggtttttaaaataagtaaactaatctgaattgtttgcaatggtaggaacttgttatataaaatgttaattaggtggcccgtgctcgaaaactgctctcaggatatgaccaatgggagagtagacctaagctccttcatttgcatgcagacttcacgacaaaataacgaatcagagttggagaaactaaatcttcatttacataacattgtctacaaattccgaggatcaggagatgtagatttcattttctttcctaactgcagaacagcaaagatagcatgcctgagccagcgaaatccgctcccgccccgaagaagggctccaagaaggccgtgaccaaggcgcagaagaaggacggcaagaagcgcaagcgcagccgcaaggagagctactccgtatacgtgtacaaggtgctgaaacaggtccaccccgacaccggcatctcctctaaagccatggggatcatgaattcctttgtcaacgacatcttcgagcgcatcgccggcgaggcttcccgcctggcgcattacaacaagcgctcgaccatcacctccagggagatccagacggccgtgcgcctgctgcttcccggggagctggccaagcacgctgtgtcagagggcaccaaggccgttaccaagtacaccagctccaagtaaacttgtccctgcaactgccttagtaaacccaaaggctcttttcagagccactcaccttttcacaattggagctatatactgacatgtgaagatactagaaactcctgcagctgaaataggcatgtttttaaaacttaaaatggcactcactgtctgggctggtggctttatgaaa

SEQ ID NO: 120071 - DNA, 1325 bp, Homo sapiens
cgggaggctgaggcaggagaattgcttgaatccgggaggcagaggatgcagtgagcctagatcgtgccactgcattccagcctgggcaacagagcaagaacccgtctcaaaaaaaaaaaaaaaaaaaaaaaaaaaaagcaccctgtgagggaaacagtactaattatttgatattctgggaaaagtgggggacaattgtcaggcttctttgtcgaaagtttatgaactgatggctcagttaatggctgcaagtatagtgtgtgtgtatatatatatatatacctagcagtatttattaaatcccagctgaggctcttttgttgcctcaggcccctcttggtctcctccagtctgagcaagggagaattgcacagaagggcgggaactgactgtggttcccgccccttctcatgaggttttcaaacaggtccgtcatgctattataaaagtgctgcgtggctctgccagacgtattgcgttacagatttaacagctgtggtttcaagatgtctggccgcggtaagggcggaaagggtctaggtaagggtggcgccaagcgtcaccgtaaggtattgcgtgacaatatccaaggaatcaccaagcccgctatccgccgcctggctcgccgcggcggcgtcaagcgtatttctggcctcatttatgaggaaactcgcggagtgctgaaagttttcctggaaaatgtaatccgcgatgctgtcacctacacggaacacgccaaacgcaagacagtcacagccatggacgtggtgtacgcgctcaagcgccagggacgcactctttatggcttcggcggctgagcttacctctacagtacactaccgcaaaaccaacggcccttttcagggccacctatccactcaggagaaagagtagtagtcactgctaaaagtgtagtttcacgtgtttagtagctccggttttcaagttaaatggtcttattacgccttggcttcatatcttactggccggtgaggatagtgtattaaagtttattttcactcttgctgtgtcgcccatgctggagtaatcaatggcgcgatctcggcaatctgcagtctccgcctcccgggttcaaacgattcttgtgcctcagcctcttgcgtagctggggcaaccggcttgcgccaccaacacccggctaatctttgtattttttgcagcgatgggttttcgccatgtttcccaggctggtcttgaactcaagctcaaaagagatttccctcctccgcctccgaaagtgctgggattacaggcgtgagccaccacgcttggcctgtgttttctgtatttctgtaaggaaacat

SEQ ID NO: 120072 - DNA, 1053 bp, Homo sapiens
gctgccttgtccaatcagaacaggggtgtctttatatatacgggtacgaaaggctagactttcgttttttcgtcatttagcagggtttagaagttcgcaatggctcgtaccaagcagactgctcgcaagtccacgggtgggaaagcgccacgcaagcagctggccaccaaggctgctcgaaagagcgctccagccaccggcggcgtgaagaagccccaccgttaccggcccggcacggtggctctgcgcgagatccgccgctaccagaagtcgaccgagctgctgattcgcaaactgccattccagcgtctagtccgtgagatcgcgcaggacttcaagactgatctgcgttttcagagctcggcggtgatggcgctgcaggaggcctgcgaggcctacctggtggggctgtttgaggacaccaacctatgcgccattcacgccaagcgagtgactatcatgcccaaggacatccagcttgctcgccgcattcgtggggagagggcgtaaattgtcttgtgaatgtgtgctaaccaaaacccaaaggctcttttcagagccaaccaccttttctataaaagttgctgtttactgttgctgtccgtaaactggaacctctgttcactcaaggtaagtaagcattcttgcctctatccgttccccctcccctcacggaattggtgcaaaaagctttattataattggggagttcttaaaacagcctttaaggtactcttatatctccttgttttgggggccgctttcttaggcttggatgcctccggcttgggaactttcttggccacctttgaccaaccaaccttctccagcagcctccaccagcaaaagcttttggggtccgcttagtactctttttcggaataaggacgccccaagctttcttgggcctctcggctgccaggacagctgtcttgggcatgactgcagcggcttttctggcctcggtcttgattttcctaacactgcctggtttggcgggaatgaacctgaggcgctgcactccttagcacgaagatgccctcgtttgttttc

SEQ ID NO: 120073 - DNA, 1761 bp, Homo sapiens
accaaacctgttggtggtaaacacggaaaatatgcaggtaattacaactctatagctgaaaaagtgggtggctcttaaaagagcctttgggattgggtatgaagacgttagaattacttagagctggtgtacttggtgacggccttggtgccctctgacacggcgtgcttagccagctccccgggcagcagcaggcgtacggccgtctggatctccctggaggtgatggtggagcgcttgttgtaatgcgccaggcgggaagcctcgccagcgatgcgctcgaagatatcgttgacgaaggagttcatgatgcccatggccttggatgagatgccggtgtcggggtggacctgctttagcaccttgtacacgtacacggaatagctctccttgcggctacgcttgcgcttcttaccatccttcttctgcgccttggtcaccgcctttttggagcccttttttggagcaggagcggacttagcaggttcaggcatgataaataaacacttcgtccacaacctaaagagaaatgcaagtgtcctcactctgcagctggtaatatttgtagagctcctatcgtaaactggcatttaaaagcttacacattgattggatgaattgtctctgtgtgccctgtggtatgcaaattaggtgattctagcgtttctttgcaattggttggttgttctagccaatcaaatagcgttatttacaattcgacctccaagtataatagtttctcacttgctaacaaaattcacttttacatttttgtcttcattgcttaacatcgtttttaagaattcaaaatgtccggacgcggcaagcaaggcggaaaggcccgagctaaggctaagacccgctcttcgcgggccggactccagttccctgtgggccgcgtacaccgcttgctccgcaagggcaactactccgagcgagtcggggccggcgcgccagtgtatctggcggcggtgttggagtacctgaccgccgagatcctggagctggcgggcaacgccgcccgcgacaacaagaagacccgcatcatcccccgacacctgcagctggccatccgcaacgacgaggagctaaacaagttgctgggtaaagtcacaattgctcagggcggtgttctgcccaacatccaggctgtactgctccccaagaagactgagagtcaccacaaggccaagggcaagtaaaacgagaactcttatattggctttttaaggaagcagtcttaacaaaggctcttttcagagccacccatgtattccttaaaagggctcacattttctgtgtaaatagctattttgcagttttctttaataatttttccatttataagtgggtgttcttaacactgaatcgtgaaactaaccgtccattttaaagatgccataaaaatacataagcaaattggcggggcgcggttccttacgcctgtaatcccaggactttggaaggccaaggtgggcggatcacagggtcaggagttccaggacagcctgaccaacatggtgtgaagccccgtctttactaaaaataaaaaaatttgtcgggcgtggtggcgcgcgcctgtaatttcagctatttaagaggttgaggcaggagaaaatgttgaaccccggaggcggaggttgcagtgagtcgagatcgcgccactgcactccagtttcggcgacagagcgagactgtctcaaaacaaacaaaaacccaaaaaagcaaactaattaaaatgcaaagagactttatgtcaca

SEQ ID NO: 120074 - DNA, 1117 bp, Homo sapiens
tcgggcctttccgccttgcttgccgcgtccggacattttgaattcttaaaaacgatgttaagcaatgaagacaaaaatgtaaaagtgaattttgttagcaagtgagaaactattatacttggaggtcgaattgtaaataacgctatttgattggctagaacaaccaaccaattgcaaagaaacgctagaatcacctaatttgcataccacagggcacacagagacaattcatccaatcaatgtgtaagcttttaaatgccagtttacgataggagctctacaaatattaccagctgcagagtgaggacacttgcatttctctttaggttgtggacgaagtgtttatttatcatgcctgaacctgctaagtccgctcctgctccaaaaaagggctccaaaaaggcggtgaccaaggcgcagaagaaggatggtaagaagcgcaagcgtagccgcaaggagagctattccgtgtacgtgtacaaggtgctaaagcaggtccaccccgacaccggcatctcatccaaggccatgggcatcatgaactccttcgtcaacgatatcttcgagcgcatcgctggcgaggcttcccgcctggcgcattacaacaagcgctccaccatcacctccagggagatccagacggccgtacgcctgctgctgcccggggagctggctaagcacgccgtgtcagagggcaccaaggccgtcaccaagtacaccagctctaagtaattctaacgtcttcatacccaatcccaaaggctcttttaagagccacccactttttcagctatagagttgtaattacctgcatattttccgtgtttaccaccaacaggtttggttttatcctcatttgagggggttgctgctgtgtaggtctagaccacagttcttttgactggttgaaggaaaatgctatacttaaccgtagcatgtttgttttaccccaagtgctggttagaaggctagcccattgtgctgataagcacatttttcttatgttgtgctgtgatgtgtcccttgtcaaattggtttcataagaaaagaacttttgaaatatctcttttgctactgacatagtgtgagggaaaggaatgtcttccttaattccggt

SEQ ID NO: 120075 - DNA, 1067 bp, Homo sapiens
tttacatgtatgcgtcactaacacattgcccaatcagagctggatattttgaattctttatttgcatgaaaggcctataaaaggagagactctagacacgagcttttatttaagtgcgttcattctcactgctgttattgttttctgacagcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaaggccatgggcatcatgaattccttcgttaacgacatcttcgaacgcatcgcaggcgaggcttcccgtctggcccactacaacaagcgctcgaccattacctccagggagatccagaccgccgtgcgtctgctgcttcccggagagctggccaagcacgcagtgtccgaaggtaccaaggctgtcaccaagtatacaagctccaagtaaatgtgtgcttaggtgctttaaaactcaaaggctcttttcagagccactcaagtctcacataaagagctttaatattgaatttcaccgttttctagggaataatttttccgattttgtaatcccagcactttgggaggccgaggcgtgcggatcgagaccagtttggctaacgtggttaaatctcgtttctactaaaaatacaaatattagccgggcgtggggcagtcgcgtgtcatcccagagactcgggaggctgccgcaggagaatcacttaaacccagcaagcaaaggttgcagtgaaaagacatggcgcttttgcattctagcctgggcgacaaaggcgaggcttcgtctcaaaaaaaattgatcaggagatactcctgttctgtgttggcaagatcctgtaatcctagcactttgggaggtcgatgcatgaggctttcttcagctcaggagttaacagatttgcctgggcaacatagaactcgtctctgcaaaaaaatgaagctaaccaggtgtgacggcttgcgtctg

SEQ ID NO: 120076 - DNA, 1057 bp, Homo sapiens
cgaaggaattcatgatgcccatggccttggatgagatgccagtatcggggtgaacctgttttagcaccttgtacacatacacggagtagctctccttacgactgcgcttgcgcttcttgccatccttcttctgcgccttggtcacagccttcttggaacccttcttcggagcaggagctgacttagctggttcaggcatgctgtcagaaaacaataacagcagtgagaatgaacgcacttaaataaaagctcgtgtctagagtctctccttttataggcctttcatgcaaataaagaattcaaaatatccagctctgattgggcaatgtgttagtgacgcatacatgtaaaatagccttcaccttatttcctttctaattggttggctcgtcaaagaacaattttaaccaatcaaattgcgcctttcacaattctaccgatgactataactagcttcttattcctccatcgagcccattctttttctttattcagtggattgttagttcttctgctgttaggaagccactatgtctggacgtggaaagcaaggcggcaaagctcgggcaaaagctaaaacgcgttcttccagggccggtcttcagtttccagttggccgtgtgcaccgcctcctccgcaaaggcaactactccgaacgagtcggggccggcgctccagtgtacctggcagcggtgctggaatatctgacggccgagatcttagagctagctggcaacgcggctcgcgacaataagaagacccgcatcatcccgcgccacctgcagctagccatccgcaacgacgaggagctaaataagcttctaggtcgcgtgaccatcgcgcagggcggtgtcctgcccaacatccaggccgtattgctgcctaagaagacggagagccaccataaggccaagggcaagtgaaatgattactagtcaaatccgtcagtgatcccgagtcccagaaaccaaaggctcttttcagagccacccaccttttctgtaaagtgctggaatacacatacgatgcctgaaatctcaatgttcactgtcctaat

SEQ ID NO: 120077 - DNA, 1173 bp, Homo sapiens
aagcagcggagattttggaaaaaaaattctaaagcactttctaacgcaaacacattcgattttttatagctaaacaggataacagatcagtctattaagttaaatgatcaatgtctttgcaggtcatggtctacgtgaaacatcaaagaaacctgtaacggaaaacgacttgtttgaaagagccagttctctatccaaatttaccaatcagaatcttgcactgaaaaaataaaccaatcgtgaatctctacggccacttccggaatttagcaaccgatcactaacagggatcgtccacaatccaatcagagtgattctgttcctatatagaggggcaaaccaatcttcctaactcatttactttgcagatgaactatggcgcgtactaagcagacggctcgtaaatccacaggcggtaaagcaccgcgcaaacagctggccactaaggcagctcgcaagagcgctccggccacgggcggcgtgaagaagccccatcgctaccgccctggcaccgtggctctgcgcgagatccgtcgctaccagaagtctaccgagcttctaatccggaagctgccgtttcagcgcctggtgcgagaaatagctcaggacttcaagaccgacctgcgcttccagagttccgcggtgatggcgctgcaggaggcctgcgaggcctacttggtggggcttttcgaggacaccaacctgtgcgctattcatgccaaacgcgtgaccatcatgcctaaagacatccagcttgcccgccgcattcgtggggagagggcgtgaattgttttgagtacaaaccttaaatccaaaggctcttctcagagccaaccactttgtccgtgaaaagggctgtaatcctttgagacgcattagaccactaaactgcactgatccaaatagacatttgaaatagtggcattcagttccctcgatgcttcatttaaatttccaaatttaagcgctccctcaggttttcgcctagggctgggcctccctacgctgttctccattggtttagctggctttgttttgctgttcaggccctctgctgctttcttgtacattgttctcgttttctaaactcctggccacttaattgtaccctgcttaacccatcctcttgttttctggctcaacgctctttcatgtggtggcctgcattttagg

SEQ ID NO: 120078 - DNA, 1558 bp, Homo sapiens
ttgatgcaaacagctcgccagagagcctgtgctattgttcctgcgaaaaaacccaatttccctgcacatttggataaaaatgagtttatctatataaagttgagacggtaagaattcacagaacaatgccctggaagagagatttgcaaatgaaagagggagaaatagtatttttaaggaaaacatgaaagttgtctcgatttgaccgaagtttgaaagagagttgggggaataagaaaagtttcaagatgccggttttaaaactatgcatagaaacaaaggcaggaatgaagcccgaactctctcggatcagtttcccccaagtctctaattatttcatgcccagatttcttatatttttactcttttttaaggggcaacaaacacagcagcgcggtagatacgaggagtccttttccagcagcgccgcgcatggagcaaggaaccaatcatcactcagcgtctctctatataaaccctcagcctccctcgtagaggacatgctgttctgacagtttgagattacttattgtcttttctgggaagacaaaaacatgtcggagactgctccacttgctcctaccattcctgcacccgcagaaaaaacacctgtgaagaaaaaggcgaagaaggcaggcgcaactgctgggaaacgcaaagcatccggacccccagtatctgagcttatcaccaaggcagtggcagcttctaaggagcgcagcggcgtttctctggccgcgcttaagaaagcgcttgcggctgctggctacgatgtagaaaaaaacaacagccgtatcaagcttggcctcaagagcttggtgagcaaaggtactctggtgcagaccaaaggtaccggtgcttctggctccttcaaactcaacaagaaagcggcttccggggaaggcaaacccaaggccaaaaaggctggcgcagccaagcctaggaagcctgctggggcagccaagaagcccaagaaggtggctggcgccgctaccccgaagaaaagcatcaaaaagactcctaagaaggtaaagaagccagcaaccgctgctgggaccaagaaagtggccaagagtgcgaaaaaggtgaaaacacctcagccaaaaaaagctgccaagagtccagctaaggccaaagcccctaagcccaaggcggccaagcctaagtcggggaagccgaaggttacaaaggcaaagaaggcagctccgaagaaaaagtgaaactggcgggacgttcccctttgaaaattttaaacggctcttttcagagccacccacaggtctcagtcaaaagagctgaagctttttggaggggggagtggggtggagaggggtgcgggtgctgcggtgttgtgcggccacggtctatcctagtcgtgctggttgggggtcagttattaacagctcccagcagcctgggcgcaaggatccttccgtctcagtctcagccacagtcaccggatagctaaggctacttgagccaccaggtcctactttttcttcaaattcccgcggtggtgtgtgattggccggccgatttctgttaaagcgcggcgctt

SEQ ID NO: 120079 - DNA, 1273 bp, Homo sapiens
gggctgaggcagaagaatcgctcgaacccgagaggcggaggttgcagtgagccgagatcacgccactgcactccagtctggggcagagcaaaactgtttcaaaagaaataataattttattctcttgtctatccattcggtagacaagtgtagcgttactgcctcctttttgcaaataataaggattttaggagacagacattatcagttcgagagcccacaggcactggactagaagacacagaaacctacactcaagacccaaacaaggaaacaggaaggagtcaaatcaacttgcatttcccctaccctcaccgccccctttccttcccaaggcaatagtgtaggggacgcccagtaagttacggaaaaggcggagacagaggtttcgttcccgcccctccaattcagtctccaaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgctcttgtccaggctgtagtgcaatgacgcaatctcggctcaccgcaaccaccccctcccgggttta

SEQ ID NO: 120080 - DNA, 1123 bp, Homo sapiens
aaaagcatttagataggttaagattttctaaaatgagacctagtagctgatcacaagtcctatcacactacataattcagggcgcgaaactggaagattcggaccaatcagaaggactttgcctttataaataggagtaagaacaactgtttgttcagttgtgaccattgcttgaaacccattcctatggcacgcacgaagcaaacagctcgtaagtccactggcggcaaagccccgcgcaagcagctggccactaaggcggctcgcaaaagcgcgccagccaccggtggcgtgaagaagccccaccgctacaggcctggtactgtcgccctccgtgaaatccgccgctatcagaaatcgactgagctactgattcgcaagctaccattccagcgtctggtacgtgagatcgcgcaggacttcaagaccgacctgcgcttccagagctcggctgtgatggcgctgcaggaggcctgcgaggcttacctggtggggctctttgaggacaccaacctgtgtgctatccacgccaagcgagtgactatcatgcccaaggacatccagctcgctcgccgcattcgcggagagagggcataagttgtactgagggtgtgcgccaacttaaaccaaaggctcttttcagagccaccaacaatttcagttgaaagcgccgtagcactagggagtaatgtctcctaaaacaaggagggtggagggttaggggatgggggcagggccggtggctcttctaaactaggcttttgtgtcttggccattgtcttcaaaatggccgatagtggcggctcacgccttgtaatcccagtactgtgggagcccgaggagggcgggttacttatacaaaggtcaggaattcgagactagtctgcctaacatagtgaaaacccgtcttcactaaaagtacaaaaccaaaaaacaaaaatacgggtgtggtggcgccctcctgcagtcccagctatatcgggggctgaggaaggagaatcgcttggacctgggaggcagccgttgaagtaagccgagatcgcgccactccactcctccatgggtgacagcgaaaccctgtctcaaaacaacaaaacagaaaatggttgtgtgctgaggcaaa

SEQ ID NO: 120081 - DNA, 1132 bp, Homo sapiens
aatttggtaggaaactagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaaggcgcagaagaaggatggcaagaagcgtaaacgcagccgcaaggagagctactccgtatacgtttacaaggtgctgaagcaagtccaccccgacaccggcatctcctccaaagccatggggatcatgaattcctttgtcaacgatatcttcgagcgcatcgccggcgaggcttcccgcctggctcattacaacaagcgttcgaccatcacctccagggagatccagacagccgtgcgcctgctgctgcctggggaactggccaagcacgccgtgtccgagggcactaaggccgtcaccaagtacaccagctccaaataaatggacgcatgttcaaacccaaaggctcttttcagagccacttaatgatttcaattaagagttttaatgctgggtgctgctgtattctatgggagaagtgtcgccaatacaggtaaaattttcctacatcacctgtttattctgtgcgtttgacaaacactaagcttttagagtttatttgtctttataaaggtggggtacaactacattgttcaggctggtcttaaactcaagcgctggtcttaaactcaagcaagttttcccacctcggccttgccttgtattactgagcagataatttgacacagcaggaaaagtgggcattcttgtttaggaaccaaaaactaagtttgcaacttaaaatgcaatcaatttggagcaacacgtccaccagtcta

SEQ ID NO: 120082 - DNA, 1149 bp, Homo sapiens
cacaagataaacttctcaaaacgtggtcctccgaatctggccccacaacacatctactgaatgagaattagcgtcttccaagtcttaaagtagtcgtttacggactacagcttgagaagcgcagaattagaactttaagaagttaacgttcttggatcgcagactaaccgagaagagaggattcaaaaatgaagtgattcatccaatcagattttccagtaattcaccaatcacatcgttggactcttcagccaatggttttgttgcgcgggtcttttgaaaatcaacaaggccaattagaatgtttctgagtatatataagggcagtttccactctgccaagtggctgagtttttctttcaggtagtctgagatggcccgcaccaagcagactgcacgcaagtccaccggtggcaaagcgccgcgcaagcagctggccactaaggcggctcggaaaagcgcgccggccaccggcggcgtgaagaaacctcatcgctaccgtcccggcaccgtggctctgcgcgagattcgccgctatcagaagtcgactgagctgctgatccgcaagttgcctttccaacgcctggtgcgagaaatcgctcaggacttcaagacagatctgcgctttcagagttccgcggtgatggccctgcaggaggcctgcgaggcctacttggtggggctctttgaggataccaacctgtgtgccatccatgctaagcgagtgactatcatgcccaaggacattcagctcgctcgccgcattcgtggggagagagcgtagaggtttccgggcagtaattctatccaacttaaaaaggctcttttaagagccgcctactttcacccgaaaatagctgtgattaactaatcaaatctttgaaactaaacattggttttagtacttaagtcctcatttgattggctaaagttaatggtaagcttgctatatttgttcccgtgctttttcccgaaagtgccagattgtcagcgtccttttctaaactggcttttaggggtttggagcttcgatttggtagtggaaggggccacctgggggcgtttatatacattgtctcaagcgttagtcgcgttgtctacttacacccattatagatgggattttttttcgttgtgtatttctggtta

SEQ ID NO: 120083 - DNA, 1003 bp, Homo sapiens
ccttggtcaccgccttcttggagcccttcttcggggcgggagctgacttagctggttcaggcatgttcgcagccgaagtgataccgtcaaatgaccacaggaaaatgctggtgagcccaaacgccctcattatttacctcgtgtatatgcaaatgaggctggctgagtttcggtttctcattggttcttttagtgtctgaatatatgataggccatttctgaactcctaaatctcatcggctctcccagaagctcaaccttgcataatttgacctttcaactataagtatgtaagtcagaagtggttttttttttttttttttttttaaatttttttaaacacctgcttttcgattggctgaaatctgtgttcaggagatagcacagtctactttgccgaatatagattataagagtttagctcttgcgttttactagaatcaatcactttccttcttctaaacaagtatttaaatacttcactgcgtctggatgtggaatgcagggcagcaaagctcgcgccaaggctaaaacgcactcttccagggctggtctccagttttctgtgggccgagtgcaccgcctcctccgcaagggcaactacgccaagcgggtccgggccggtgcgccggtgtacctggaggcggtgctggagtacctgaccgccaagatcctggagttggcgggcaacgcggcccgagacaagaagacccgcgtcaccccccgacgcctgcagctcgccatccacgacgagaagctcaacaagctgttgggcaaagttactatcgcgcagggcggtgtcctgcccaatattcaggccgtgctgttgccctgtctatacaagtgactgactaggcaaacaggactaatgagaaaatgtttaatatctcaagtaagtgctttaatgtagtcgggaagaagcaagttcagtaacgtttacaaaaccttgtaaagtttagatggacagggccactgcagtgttcaagttatcctgcagaagagg

SEQ ID NO: 120084 - DNA, 1337 bp, Homo sapiens
ttggtgatggagagggtgaaatcttgcagttttcaaacacttccgaaggggggtttcggtccgcatgtgctttacagccggcagcagaaagccagtcactgtgaccttggggacaaagctgcactcctcaggcttccggtcttgtggaccgaggctcctctccaatcgtcctaaagcaactgaaggaacaattgataacaatttaaacatgttaatttatttaatctgatttggttgttaaaacagccttaaaactctcattcctatttcccagcaattgcaagagacgcctccgcggagccggcgctcagatgccaaaggctggagtcgttggtgacgtcatccagggctgggctatgcggggtggggccaagaagcaggaccaaagttccggtatgcgcgctttcagtcttcaattaggtccgaattcccggcatataagggcgttgctttgccttggcgtttaggtttcttaagttggttttagaagttgcttagtcatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttctgaaggtgttcctggagaacgtgattcgtgacgctgtcacttacacagagcacgccaaacgcaagaccgtgacagcaatggatgtggtctacgcgctgaagcgacagggacgcactctttacggcttcggtggctaaggctcctgcttgctgcactcttattttcattttcaaccaaaggcccttttcagggccgcccacttttttcataaaagagcagacatcttgttatcctgctttgttccagatttttgctgagaagtagttactgtgcacatgtgtagatttgcaggtaacgtttaattactcgtgcttaatctcgcatgtttaggatttgggcataaagtacttaaagccactgttttctgcttgagggaagttggtatgttgaatatgtttagctttcttgtggcattttaacactagatatcagtgagtaagctggattgtgacagtttataattcccgtgggccttcctccttcagtttaagcttgaagcgttcgtaaggttctcaaagactacagaagttggaaacttcgcggagagactgcaagttaccctttccaaaatggcgggaagggctaaaaacaaagaaagctcgcacccagacggcgggccttaaaccaaggcgaatccgtgagcgcaacacatctgcgtgagt

SEQ ID NO: 120085 - DNA, 2056 bp, Homo sapiens
aaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaat

SEQ ID NO: 120086 - DNA, 1125 bp, Homo sapiens
taactactttcttccaagctttctgcagaaaggactccagagatactcattcactgtcccttttgatttgctttcttcatgagcaggcataataattattagtcttgtcttgatttctcaactgaagcaaggaaagatgaagagctcttgtttaaaattacccagattcatagagaaaagagttcttacttgcagtttcccatatgtattgctgatcagttttatattagcaaagagtaaaagtaaataactgatttcaagccatataaaacctagaagacttagggactctgatacagagtttgtcttttctgcagtgattttaattttgagaattcttttcttagtcataggaatataaataatatttctactttgtctcacagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgt

SEQ ID NO: 120087 - DNA, 1217 bp, Homo sapiens
aacagttctgagttgacatttgaaatcttggtatatctttttatatttataaataacttttacttactacaataaaattgagtaaaagtagcagcctctgtgcctttcgcaaggaaagcatacaaattgctgaatggaaattagaaaactgttgttaacaaattgatgaaacagaatgttatgtatcatctcattacccagaggtaaccatgttagtaccatgtgttttggatccttttgacttcctgttttctctgagtgcacatgttcctttgtgttctggtccattacacttactaatttgctgtattcagtgagctttaatatcatttcctttacaaataggctccaatctaatatctagtttcttggattctggacctttttgataatttaagaaaccgtgtaccttctccccagaaaagtgcacatatactgtacattttgcagtcaaagttttcataaattacctgggagtctgtggatgccaagtaagaactcctcttctaggtttgagtgcctactctgtgccaggcacttttctgagtgctggggaaacaatagtgaatgaagtgagccaaaaatccctgtcttttaggggcttacattctatggagaaaaacaaaataggaaaggagaggagtgttgtttttgtgagtcagctgggacggagatgtggtacagtttagaatagggtggttggaaatgacttcactgagaatatgcctgttgagcaaagatgtgaatgaggtgagagagagagccttgaagattcctggaggaagagcccttcatccaggaagagatatcaaggataaagaccctgaaatgggagtgagtctggcttgtttgaacaacagcaaagactcagggtgactggagtgcaatgagtaagtagaggaagagcagagaaatggatcagagtagtaactacgagtcagatttcttaagagcttgtaggtttctaacagaagcagttttggtggagtagtgagggttgattgtttaattggagtatgttccagaaaccttggaagacagaattggagacaatgagcaggtttatttatttcaaagcgttttactgcggagaggaacagagaaatgggacaacagcctgagtgtgaggcagttgagaggtttttcttgttgattgtgcttttgtttttgagaagagaaataatattggaatggtccaatacgaaggaataaattga

SEQ ID NO: 120088 - DNA, 2577 bp, Homo sapiens
tttgtctagagctggtcggaactgatggctaccagtggcaggtacttcctgcaggagaaacagtgtaagcaaagatgggaagaggtaagctatggttgaaggatgctcactagaatggagaggaaatgggaccagttttctaggccagctctagaaaaattatgaattataaatttcacaaggtcatcgtctacattattgatttttcctctaggagaggcaagaattgagtgttgtgaatagttctgaactagagaccttttgaaaccaaaaggaagatggtcttgagtctttcttgttacggtaagtggtataccaggctctgtttctgtataaatgtggatgggggtgtggggtggggcagggtgaaagacaggaaagtatgggagaagatatatggaaaaagagaatgcccctttcttagctcctaagatagcagagtgataaaactgagccctatcctaccaacttaaggctattttctactccttttcaacatgcatgcatattcacattaggcttgcagtaattgctttttgattgatttgtagcacaaagagggtagtatgcctaatgcttaggcaggctctggagtcagaagataggtattgaaatcctggctctgctgcttactatttgtaagttgttgggtgattatctaactgccctaagcatcaggttttccatctataagatccaaacactggtattaatacctatttcatagggtccttgggaggactaaatgagataatccatgtaatcaatgaaaaataaatgagaaatttccaagtctaaggcctataaacaccatctaatttttaaataatgctttactaactttgtctcttggtcccatataccctttaaggataaccatgaactctcaagttgtatgaattagcctgtctgcttggacttttgtcgtgttccagtttattcctttcacttcgaccctaggcaggaaagagtactagtctcttcctaggatggggcaagagaagcatcctgaaggagggtaccctggagctaagacttgaaagatgtatttgggcttgctagatgaaccagccagggctactggtctagtctgttatacagctactgggggtccaaggataatgattgcctttttgttctggtatttgttcacacttttcatttattcaacaaatgtactctaggtagtagggatattacagtaagcaaaagactaagtcctaaccctaatagaagttatattttagtaaaaagacaaacgaataaatataaaatgtataccataaagttgaatggtgataagtgctgtggagagaaataaaatgtgataaagcaacacaggctattttagataaggtagtcagggtatgctgctttttgaggaagtgatcttcaggcagagacttgagtccaataaaggagtaagctgcatggggaagagcattctaggcagaaggaacaagtgcaaaagctcggagatggcctgtgaggctgaagataacgcagaggtgccacattatgtagagcagtaaaaactttggattttattctgagtgtgctagaaaacagtattttaaattagggaagtgtcgtgatttttttttttttttgagatggagtcttcgctctgtcatccaggctggagtgcagtggcacaatctcagctcactgcaagctctgcctcccaggttcacaccattcttctgcctcagccttccaagtagctgggactacaggcgcccgccaccacacctggctaatttttttgtactttttagcagagacggggtttcaccgtgttagccaggatggtctcaatctcctgaccttgtgatccgccagcctcggcttcccgaagtgctcggattacaggcatgagccaccacgcccggccttatgatctgttttgaggtttgacacccagacttattttttaggtgttgacatctaaaaaaagcttggatatgaataggaaaattatttccttatttattcagttttttttttcttcttcttaatgccccacacttcattggttgtttagggcaaataagacatcttggactgataactttagggaataatgtaaatgatttgcctggctgtgacaaaactaagaatcctttattttcactctattctccttttgagcttaacactaatacaaattttaaaagacaaaaccttttatgaaccccccatcttataacagctatttgtctgtatcccggcatatctttacttagttgtgattctgagttggaattcttccttttccttctaatatttctccataatttttttctagtttttgcataatcttcatattaatcattaactggccaaattgttttattagttattgcaagtgggttttgaacaaggctttgcacaagaatcaggcatagaaaatgggcttaatacatgttagtggttttgtgcatgtgaaggtagaattaagaaaataatagaatctaccatttattaagcatctactgagacctaggcattgagcttagtaccggcagtgtctttgttctcatagcaactctgtgaggaaaaaagagaatattgaag

SEQ ID NO: 120089 - DNA, 1111 bp, Homo sapiens
cgttgcccgccagttccaggatctcggcggtcaggtactccagcaccgctgccagatacaccggcgcgccggccccgacccgctcggcatagttgcctttgcggagcaggcggtgcactcggcccacggggaactggagaccggccctagaagagcgagtcttggccttagcgcgggctttgcctccctgcttgccacgtccagacatagcgagcgcaactcactacgagcaaccacaaagtgaacgggaaaggcggcgctttttataaacactattgggcgcgaaaaagaagacgtgttgttggttagggctgcagtttaatttcaaccaatagtagtgcgtcttctggatttgcgaatcctgattgggcagacctgacctctgacgttaccctgaataactaccaatcagacacaagacttcaactcttcaccttatttgcataagcgattctatataaaagcgccttgtcataccctgctcacgctgtttttccttttcgttggcgctttatagctacacagtgctatgccagagccagcgaagtctgctcccgccccgaaaaagggctccaagaaggcggtgactaaggcgcagaagaaagacggcaagaagcgcaagcgcagccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgcctggcgcattacaacaagcgctcgaccatcacctccagggagatccagacggccgtgcgcctgctgctgcctggggagttggccaagcacgccgtgtccgagggtactaaggccgtcaccaagtacaccagcgctaagtaaacagtgagttggttgcaaactctcaaccctaacggctcttttaagagccacccatgttctcaaagaaagagctggtgcttgtattcctcctctgctggccactgacaaacccttgtaacttgctactgtgttttttggtctgaagtagagcagttatttaactaatccttagtgactttttttttttagatctgccattct

SEQ ID NO: 120090 - DNA, 1478 bp, Homo sapiens
aatgtcgttcacaaacgaattcatgatgcccatggccttggacgaaatgccggtgtcagggtggacctgcttcagaaccttgtacacatagatggaatagctctccttgcggctgcgcttgcgcttcttgccgtctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcgggcaacgcggcccgcgacaacaagaagacccgcatcatcccgcgtcatctccaactggccatccgcaacgacgaggagctcaacaagctgctgggcaaagtcaccatcgcacagggcggtgtcctgcccaacattcaggccgtgctactgcccaaaaagactgagagccaccacaaggcgaagggcaagtaactatctgtactagtttgtggcagctcaagtaaaatcgagtccaaaccaacggctcttttcagggccacccacgtcttctctaaaagaacttaacatttattccatgtgaaagaaagtgagacatggacaagactctagtcataaattacccatctttttgaaaacagtgtagcgaacaccgcagatttaaaagaaaaactagagggaaggtggtccagattttaccacgcttaaaagttaagatgtgaacaaatctcttaggccattacttaattttaaacttaatcagtgtgtgtccacagagcaccagtggcttcgtgagttcttgaagcactttggcccaaaagagttatcgcccgggctagaatttagcagacagctgttccacgcgggccagggcggcatgaagaagtcccgccgctacgtgcccggcacagtggccctgcgcgacgttcggcgctaccagaactccgagctgctgatcagcaagctgccgctcctgcgagagctcggcggtgacgccgctgcacgagagcgaggctgaagaactttgt

SEQ ID NO: 120091 - DNA, 1050 bp, Homo sapiens
ttatgaggcaggaatcatgttaaatgaaaaaaggaaaaacagcctaggtcttgaggattaaaaaggactgaaggagaacaagagggagtagagcacagcaggcctgtttcccttttaggtcccctcccccaatgcagagggacttcccgccaaagctcttccggttttcagtctggtccgcagaggttacccataaaagaaagctgccatcacaggcagcagacctttgttctctgaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatggacgtggtctacgcgctcaagcgccagggccgcaccctctatggcttcggcggctaaatggcattttgaagcccagtcattctctaaaaaggccctttttagggcccctaagctttcaacaaaagagttgaaatgactgcaaactgagtctcttaatagggccattgtcagtgagttctgtcatcctattttacaagattaactcgacgccgaaaatgggctgatgactacaggtgaccttgggccgagatttttccaaggccagaagagcctctgctggccagtaacttctggcggctgcctggaaattgcctgcagccggtttaccgctcggattagtttagaaagccaaggggtctgcggtccaaataggggcgggctagataattaacttccctctggaccttcaaatacgtctcaggagataatgagtttgatgggctccactaaatgctagaacctccaggaaaacttcgtggtggctggtttaagaggacttggcgggcacagagctctgcatgggggggagggggacagaccatgctttt

SEQ ID NO: 120092 - DNA, 1047 bp, Homo sapiens
catggccttagaggagatgccggtgtcggggtggacctgcttcagcaccttgtacacgtatacggagtagctctccttgcggctgcgcttgcgcttcttgccgtccttcttctgcgccttagtcacggctttcttcgagcccttcttgggcgcgggagcggacttcgctggttccggcatgttgaaggcgaactacgagcctgagacgagcagcagatcgagaaaacgggaagtaatgggagcaaggtaccaggagtcgtttttatataggacctctcatgcaaataaggtgaagagtgaaagtcctgtatctgattggtggttattagggtgacgtcagaggttagttatacccaatcaacccaatctgcaaatccaaaagacgtacttccattggttaaaactaagctacaaccctaaccaatgacatatcttctttttcgcgcccaatagtgtttataaaaggcgctgcctttcctcgttggctactttcagtaagttgtgaccagtatgtctggacgtggcaagcaaggcggtaaagctcgcgccaaggccaagacccgctcttctcgggctgggcttcagttccccgtgggccgagtgcaccgcctgctccgcaagggtaattatgccgagcgggttggagccggcgcgccagtgtacctggctgcggtgctggagtacctgaccgctgagatcctggagctggctggcaatgcggcccgcgacaacaagaagacccgtatcatcccgcgtcacctccaactggccatccgcaacgacgaggagctcaacaagctgctgggcaaagtcaccatcgcgcagggtggtgtcttgcccaatatccaggccgtgctgctgcctaagaagactgagagccaccataaggccaaataaggagcgaggttgtgaaaactggaaaacaaaggctcttttcagagccattctacactgtcttagagaaagctggacacagtcatgtttgtttcacttcatgtttgcttcgctagataacattgtaaagcgcttctttcgcggttgggctgg

SEQ ID NO: 120093 - DNA, 1117 bp, Homo sapiens
actggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaacc

SEQ ID NO: 120094 - DNA, 1036 bp, Homo sapiens
aggcagctctgaggtctgccgcactgctcatgcttgcggtgatagtggtagtggtagtgatagtgactgggcttgcaatatgggaaagattcaggatcctctggggtctgctgtaaactcctgataccattgaatctgttctttaagaatattgccagcattgactaccctgcttcttttagttgtcatctcttttgttttgggcaacagtttacttcctgattatgtactttcctggttatgtttcttctgttgttttatgtgtttgctgataaactgctttctttcattggtatattttattaattctgttaccctgactattctcaaggatcttccctctgcctctgctctttttcacatatatttctaaggctttagctattcttgtccttctttttttgagctgatactttccatcctacatttgaacatccttgttattctgatgttggcatctttcacttccacaaacgctactatagtccagctctccatttcttttcttaattctcaaaatgcctagacttgaacttgttagtttctccctgctaaattatttctctactatttacaactcttcccatatctagcaatgatgtgattatttcttcagtgttccaggctgaaacacatggggtcttagctaataaatctttcctgtttgttctgtctttaaatcatggttcttggattttttgttttgttgtttattagcaaggaatcccaattcaaactgcccccttcagattcagttcatctctgtctactcttagccatctctgttgtcacctttttagtcaactattaccttaaatgtatttccttactggttcttgaagattatctatgaaattgaattagacattcttttgccactttcgtattttatttataattctccttagctccttccaactttctccccaaataatatggctatatatttgaaaaccattagaattttctgagagatttatttttcagtatcattatattattcccacaatagcagtttattttttctctattcaga

SEQ ID NO: 120095 - DNA, 1324 bp, Homo sapiens
gggacccttctcagttgtgagattatgaactcaaagttcaagatcccaaagttttgttgtagtgtgaatggcaagaacagtctttctctgatgcttctagaagattcaaatcataaaaagctttctttgcctgttgaaaatacactgtagtaatctactgttataacatcagccctcttgcataggaaaccttttatacaaccagaaaacatgcactgaaaataacaaatgagctctcaagcttggtgtttgcttggtggggacccacgtgggttcaacatgtgtattgagaagtgttatttctgttcagggcccatctaccctggtcacggcatgatgttcgtccacaacaattgcaagttgttcagattttgtaaatctaaatgtcataaaaacttttaaaagaagtgcagtcctcgcaaagctaggtggatcaaagcattccagaatgcagctggtaaagagcttacagtggataattcatttgaatttgaaaaacgtagaaatgaacctatcaaataccagcgagagctatggaataaaactattgatgcaatgaagcaaattgaagaaatcaaacagaaatgccaagctaaatttataatgaacagactgaataaaaataaagagctacagaaagttcaggatatcaaagaagtcaagcaaaacatccatcttattcaagcccctcttgcaggcaaagagaagcagctggaagagaaaatggtacagcagttacaagagcatgtaggcatggaaaacacatcttaaaaatctctgtaaccatttcttttatgtacatttgaaaatgtcctttacagacttggaactgctaaattattagtttattttttacataaggtcacttaaatgaaaagtgattaaaacatatctttcctacattgacatctgcaaaacatcagatattacgaatgttagattgcatctcagtgttaaatcttcactgatagatgtacgtatgtaaatcatgaaaattctacttctaactatagaagtgaattgtggatgtaaaatggttatgctatttggataatggcactaggcagcatttgtataacaactaatggcaaaaattcatggctagtgatgtataaaataaaatattctttgcaataaaatattccgtttattaacgttacagaaggggggatacaacaaggaactaacaatttgtataacagtgtcaaatgttattttgattttagtatttcctgttttggtttatttgtatcttagaagagcacaatgacattgtttgatgaagcctaattattctggactgttttgacctggtttaaccctt

SEQ ID NO: 120096 - DNA, 1427 bp, Homo sapiens
cgcgttgccagccagctccaggatctcggcggtcaggtactccagcaccgccgccaggtacaccggcgctccagcaccgacccgctccgcatagttgcctttgcggagcaggcgatgcactcggcctacgggaaactgaagcccggcccgagaagagcgggtcttggccttggcgcgagctttgcctccctgcttaccacgcccagacatggcaaaaggtctattacctttacggtcaagaaagactgaaatgaaattggaaaaacgtacattttatagcctctactgggcgcgaaaaggaagctgtgcgattggcttacgttttatttttatttagaccaataggactcgagtatgcaggatacctattttgattgggcaaaactggcatctgacgtcatccacggataatcaccaatcagcactgacctattctactcctaatttgcataataacatttaaataaagaggacgaaacagccctaaggttgtcttttattttgttttccaccatgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaacaagcgctcgaccatcacttcgagggagatccagacggccgtgcgcctactgctacccggggaattggccaagcacgccgtgtccgagggcaccaaggccgtcaccaagtataccagctccaagtgagcctctcgctgcagtaacagttccgccgtgacccacaccccaaaggctcttttcagagccgtccacgtttctcaagaaagagccagttcactgttaagtttgtctcccattaggtaccctttgggactcgcttcgtacatataaatgtacttgtatatgtgggtttttttttgttttttgttgttgtttttgaggtgtagtctcactttgttgcccaccctggagtgcaatggcacgatctcggttcactgcaatctccaccttccgggttcaagcgattcttctgcctcagcctctcgagtaggtgggaccacaggcatgtggcaccaggccctgctactttttgtatttttagtagatacggggtttcaccacgttggccagactggtatcgaactcctgaccttaggtggtccacttgcctcggcctcccagtgttgggatcacaggtgtgagccactgcgcccggcccaaaatattttaaagaggattattagcaactatgagtgaccgtggcttagggaagacacaat

SEQ ID NO: 120097 - DNA, 1064 bp, Homo sapiens
tttttttttaatatatttaaaaaaaagagtgtctcctaaagtgtaagcgctatcatgctggactaatgttttaatttaatttaattgttgtcttggtagagatggggtctcgctattttgctcacgcagatctcaaactcctgacgcccaggtacactcccatctcggcctcctaaaatggtgggatcacagacgtcagccaccgagcccggtcacttttttgtattccccacagtattgatgtatatcttctgcgttcaaaagcaattttttaaagcctcataacgtggtaacagaatactttgcacattacaaaattcagaacacggaaacaagaagctcgcttttttttcccccctatttcggtttggccctttagatttcccctcccccaccggggcgggacttcccgccgacttctttcaggttctcagttcggtccgccaactgtcgtataaaggcgctgcctcaggccagaggcctcacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaataaaaggcccttttcagggccaccctactttctcagctgaagagtggtaacactgaggagtggttttggtaggtacggaattttgcttggttctgagtcagttctggggggaacagttttttgaacacagcggcacacgtgtggccattcacccggggtcactgtaggcaggactaattacgagatgtaatgtctaaacttgctcaaaattcgtaagc

SEQ ID NO: 120098 - DNA, 1090 bp, Homo sapiens
ttgtatttcccacagtattgatgtatatcttctgcgttcaaaagcaattttttaaagcctcataacgtggtaacaaaatactatgcacgttacaaaattcagaacacggaaacaagaagctcgctttttttttccccctatttcggtttggccctttagatttcccctcccccaccggggcgggacttcccgccgacttctttcaggttctcagttcggtccgccaactgtcgtataaaggcgctgcctcaggccagagtcctcacaaagcgttgggtgagactcctcttgctcgtcatgtctggccgcggcaaaggcgggaagggtcttggcaaaggcggcgctaagcgccaccgtaaagtactgcgcgacaatatccagggcatcaccaagccggccatccggcgccttgctcgccgcggcggcgtgaagcgcatctccggcctcatctacgaggagactcgcggggtgctgaaggtgttcctggagaacgtgatccgggacgccgtgacctatacagagcacgccaagcgcaagacggtcaccgccatggatgtggtctacgcgctcaagcgccagggccgcaccctctacggtttcggtggttgagcgtccctttctatcaacaaaaggccctttttagggcccccactttctcagctgaggagccgtgatgcttgtttgcccagtttctctttaccatttgttcgcgcctgctgagtttgtgctgctatcggagcatgcgtctctagtcgctgtaagtaggcatcagtcactaatcgctctccagtaaataaaatacccaacacaacttgtttcaggtgctccagagcttactgacatgggccgtcgcgcagactgtagtgcagtgtcatcatggctcactgtagcctcccgattagccggaacctcgcgcccaccaccacgcaaggctaattatttttccaaagaccgggtctccgtgtgtttcccaggctagtttcgatatcctggcctcaatcccctcgcctatgcctaatgttggtattacagtagtgagccaccacgcctggccacgatactgttgaggttttagggttagttacattta

SEQ ID NO: 120099 - DNA, 1558 bp, Homo sapiens
ctcctgagtagctgagattacaagcgtcagccaccatagcccggctaatttttgtattttttagtagagacagggtttcaccatattggtcatcctggtctcaaacccctgagctcaggtgagccacctgcctcaacctcccaaaatgctgggattaaaggcgtgagccacagcgcccggcgactttttttttttttttttttttttttttcccttgagacagggtctggctttgccgcccaggttggagagcagtggcgcgatcgtggctcaccgcaacctccgccttcctggccgaagcgatcctcctccctgagcctccccagtagctggggttacaggagtgcatcacgcgcccagctaattttttacatttgtttgaagagtcatggtttcgccatgttgttcaggctgctctcgaactcctgacctcaagtgatccgcccgcctccgcctcccaaagtactggaattacaggcgtgcgccgccgcgcccggccgctttttcctattccttgtaccctttctgcagttaaactacaacacgcctgaccccaccaagtcggccacagccccgaaaaagggttccaagaagactattactaaggcaagaagcgaaagcgcagccgcaaggagagctgctccgtgtacttgtacaaggtgctgaagcaggtccaccaacaccggcatctcgtccaaagcaatggggatcttgaacaccttcgttatgccatcttcgagcgtattgcgggcgaggcttcccgcctggcgcgttacaacaagcgttcgaccatcacctccagggagatccagacggctgttcgcctgtcacgcatgctgtgtccgagagcaccaaagccgtaaccaagcacaccagctccaagtgagctccttgctggttcgtccacttggaaccccactaggttcttcctgactcacactccactaggttcttcctgacccacaccctaaggactcttttcagagatattcacacttcctaaatagaactgacgctcgtttatccctagttttgaaatgttcagttagctttaacctaaagcctttcataaatgcttcttaatttatgcaaaagatacattgtggccttatgatatttccaatattatctgctactaagtattttatgttacaaacgtcaaatacacaaaacgggagttttattgtgcgaatttcacttatccaggctcaatttcaacaccgagaatcccctgttgagttattgtctagaaaaccaagtatttaaagtaaaagtcctatcaacctctactgaaatatcactggacgttttgcaggttacaccacaattttcaggccacctggtaggatactcagtgactaccatgtaatccaggtggcattctctttcaatttttcttttataacatgaaagcagggaatgtgctttcttgcctaatttgcacaaaatgacctaaaggtgttgagattaaaatggagaaagaggaaggaaagaaattagaaccaatttatattacctcttcccaccagttagaaatgaggtttggatccttccttgc

SEQ ID NO: 120100 - DNA, 1096 bp, Homo sapiens
cagcccaatggattcttatgaaaagctgaagggattttttaaaatatctttcatcaattgcacaagattcttgaaaacacaaacaagtatgtgaacctggaggctgttttcctcctttggagcttcaaagtgccaaattctgtaccattgttttaagcatttaatcaaattttgaggactaacaaacacaatttgggagtccaaccgcgagcggcggcggccagagggcggtggattggacgctccaccaatcacagggcagcgccggcttatataagcccggggcccgagcatagcagcaacgcaaaacctgctctttagatttcgagcttattctcttctagcagtttcttgccaccatgtcggaaaccgctcctgccgagacagccaccccagcgccggtggagaaatccccggctaagaagaaggcaactaagaaggctgccggcgccggcgctgctaagcgcaaagcgacggggcccccagtctcagagctgatcaccaaggctgtggctgcttctaaggagcgcaatggcctttctttggcagcccttaagaaggccttagcggccggtggctacgacgtggagaagaataacagccgcattaagctgggcctcaagagcttggtgagcaagggcaccctggtgcagaccaagggcactggtgcttctggctcctttaaactcaacaagaaggcggcctccggggaagccaagcccaaagccaagaaggcaggcgccgctaaagctaagaagcccgcgggggccacgcctaagaaggccaagaaggctgcaggggcgaaaaaggcagtgaagaagactccgaagaaggcgaagaagcccgcggcggctggcgtcaaaaaggtggcgaagagccctaagaaggccaaggccgctgccaaaccgaaaaaggcaaccaagagtcctgccaagcccaaggcagttaagccgaaggcggcaaagcccaaagccgctaagcccaaagcagcaaaacctaaagctgcaaaggccaagaaggcggctgccaaaaagaagtaggaagctggcgtgtgaaaaccgcaacaaagccccaaaggctcttttcagagccaccc

SEQ ID NO: 120101 - DNA, 2381 bp, Homo sapiens
agggcaagatgagctgagtaatttttaactgggcatcatttttagaaactggagtttaagtacccccttttccattttttcctgaagtcgtgggcagggcgcaaggtctgtgaatcggccgaccggatgcagctggtgtggagagttcccaatcaggtccgatttattactatataaagtactgctgcgaggcttgccgtgttgcattttgtttagtacaagacatgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccatggacgtggtttacgcgctcaagcgccagggccgcaccctgtatggctttggcggctgagtgttttacttacttacacggttcctcaaaggcccttctcagggccacccatgaagtctgtgaaagagctgtagactaaagatagttaatttcttaagaacacttaaacgtatggcagttttggcaaattagcgattccacataagcagtcgctgaagtttgaggttcggtgcccctttcagcattacttagtggttaaaagtgccggcttctctgatacacggccaaatctataacgcctctctggtttttgcaaaagtcataatgaaacagccggtctcatttatcttgtatcgattactttaccgctaccaatgcgagggctgtgtaactatgacactgtggtccgcaacgcccaaaatgttttaatatcgccctttacagaaaaagtcggccaacttctaaaacattaagtacgtttaaatttgagaaatactggcataccacaacgctcgaatttcatatccccttcaatgcctccatttacaaatttactctagtttcacttttcctttacgttctttaactttttgtcaaatcagtaatgacacctcgtaattaaaatagtgcaaggcaagtttagatttatcaagcttatatttaaacaggattttgatgcatgaaaaatcctagacttttgggggatttttttttgtttccgtttttgtttttctttagctagcaaaaccattttacgtttcttgacccaaaacagaggcggaatgtctccctttcactagcagattaaactgggagccaattccgtgtgtgagacgtggcatggcacagtctactgtccaatcagaacgcgagggcagctataaataccgggatgatcagtttttttctctcatttgtgttgagtaggtacgtctacttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctgcgcttccagagctcggcggtgatggcgctgcaggaggcttgcgaggcctacctggtggggctatttgaggataccaacctgtgcgccattcacgccaaacgcgtcactattatgcctaaagacatccagcttgcgcgccgcatccgaggggagagggcataaatattcctatcagcccaagaagtctgtccaaccccaaaaggctcttttcagagcccctcaattgtcaccaaaaggaagctgtagcttttgagacgtgtcttagctccatgttaaatacaagctgtggacaaaacgtggtagtggcccaacacactataatgcaggagtcaggtcacaggctgttggtatgctaaatcaatttcacatacagaacctgttcctactgataaggattatcactcaaaaaagacatgtcatggggtcaattttacagatgaagtttagttttgaaaagtattcctgtttttatccttgaggaatgtgtctcctgcgtatctacctgcccctactgaagggaacaagtagcacaatgagtgtccacaggctctggtgaggccgaggcaggcggatcacaaggtcaggagatcaagaccatcctggctaacacggtgaaacccccctgtccactaaaaaaaagactgccggccgtggtggcacgcgcctgtagtcccagctactcgggaggctgaggcaggaggatcgcttgaacc

SEQ ID NO: 120102 - DNA, 1169 bp, Homo sapiens
gttgcagtgagctgagatcgcgccaccacactccagcctaggcgacagaattagaagccgtcaggtaaaaaaaaaaaaaaaaaaaaaaaagtggcaggaaccaaatgaagatagtattaacaaccaaccaggtttttcctacaacagttctgaccaatcaggatcagatcatcgttataaattctggtagaagccactgctcattcagctgcttgctttcagagcatagctttctcaactatggcccggacgaagcagacagctcgcaagtctaccggcggcaaggcaccgcggaagcagctggccaccaaggcagcgcgcaaaagcgctccagcgactggcggtgtgaagaagccccaccgctacaggccaggcaccgtggccttgcgtgagatccgccgttatcagaagtcgactgagctgctcatccgcaaactgccatttcagcgcctggtgcgagaaatcgcgcaggatttcaaaaccgaccttcgtttccagagctcggcggtgatggcgctgcaagaggcgtgcgaggcctatctggtgggtctctttgaagacaccaacctctgtgctattcacgccaagcgtgtcactattatgcctaaggacatccagcttgcgcgtcgtatccgtggcgagcgagcataatcccctgctctatcttgggtttcttaattgcttccaagcttccaaaggctcttttcagagccacttacattctcactgaggatagctgtcacaccattggtcgactgtcttaaatcaactttaaagcagggataaactggcggaaagtcgtcaagggttgttcattctgattccttgcagtgtcctttgtcttctaagacggtccttttcacttgtcctctgtgacccatctcacaagggtctcactttctccgaggaaagtcagcaaatctatatccaaggtcaatccgcttcaaggggaaagccaaagtccttcctgcacatgctgtcctttggggatagcatctccagaaccccataactaacaattagattacaggttaaatgagatgccatttttaactgaaacgggcactgcccttgggtcccctggaagcttgctgaaaatcacggacatgaggccggttgatttagcacatagacacgggagacttcaaaatgaggacccacccaccaat

SEQ ID NO: 120103 - DNA, 1349 bp, Homo sapiens
cgctcaaagatgtcattgacgaaggagttcatgatgcccatggccttcgatgagatgccggtgtcggggtggacttgcttcagcaccttgtacacgtagatagagtaactctctttgcggctgcgcttgcgcttcttgccgtcctttttctgggccttggttacggctttcttggagccctttttgggggcaggagcagatttagccgggtcgggcatggcggaggagagtgaaagagcactcaaataacaagaatgaggacaagctgggttatgccctatttatttacaagtctatatgcagatgagattgagaaattcttctgtctgattggaagttactcagatgacgttaatatcaatatagtccaatcaaaacacgtatattcagaaagctcatttgcattaagaggaagctgcaagcttagccaatggcccagcttctttttcgcgcccagcagctgctataaaatgcgcgtccctgtaggttcctttcactcactttctgacttaggccacaggtcgttttaccatgtctggacgtggcaagcagggcggcaaggctcgcgccaaggccaaaacccgctcctctagagctgggctccaatttcctgtaggacgagtgcaccgcctgctccgcaagggcaactacgctgagcgggtcggggccggcgcgccggtttacctggcggcggtgctggagtacctaactgccgagatcctggagctggcgggcaacgcagcccgcgacaacaaaaagacccgcatcatcccgcgccacttgcagctggccatccgcaacgacgaggagctcaacaagctgcttggtaaagttaccatcgctcagggcggtgttctgcctaacatccaggccgtactgctccccaagaagactgagagccaccacaaagctaagggcaagtaagggctgaactttaaaaatgtaaacttacaagacaaaaggctcttttcagagccacccaccatttctacggaagaactgagcactctgttctccaaacctatcagaaatttgtggccgagttcaagcactgaggccattactttcctattgggtaaaataaaagtattgaatcaggcctagtaaatactatccaactgctaccttataacatgaaggaacctccttaattgtcccctccccacaaactgtcctgggtctttaaaaaacttggggccgggcgcggtggtttatgcgtccttagcattttgggaaactgaggcaggtgggtggggaggggagaaatctctagggacctggagttcgagaccaccctgataacgagacccctgcctcttaaaaaaaaaatgactgggcgcggtggctca

SEQ ID NO: 120104 - DNA, 1206 bp, Homo sapiens
aaagtgagtgaaaggaacctacagggacgcgcattttatagcagctgctgggcgcgaaaaagaagctgggccattggctaagcttgcagcttcctcttaatgcaaatgagctttctgaatatacgtgttttgattggactatattgatattaacgtcatctgagtaacttccaatcagacagaagaatttctcaatctcatctgcatatagacttgtaaataaatagggcataacccagcttgtcctcattcttgttatttgagtgctctttcactctcctccgccatgcccgacccggctaaatctgctcctgcccccaaaaagggctccaagaaagccgtaaccaaggcccagaaaaaggacggcaagaagcgcaagcgcagccgcaaagagagttactctatctacgtgtacaaggtgctgaagcaagtccaccccgacaccggcatctcatcgaaggccatgggcatcatgaactccttcgtcaatgacatctttgagcgcatcgctggcgaggcttcccgcctggcgcattacaacaagcgctcgaccatcacctccagggagatccagacggccgtgcgcctgctgctgcccggggagctggccaagcacgccgtgtccgagggcacaaaggccgtcaccaagtacaccagctccaagtgagctctcgcagctgccagcaatccaaaggctcttttcagagccactcacgcttccagagaaagagcctgtgcattttgcttgtagtcttttgggtggactccggccggcctccattaggagggaagacggcgggaaaaggtaagctaagctccctaggctttttgcgtgtgagtatagacgctccatcagacaaatttagcttgggttcttagatacccttggggaaaaaggcttgcagttgtgctttaagctataattacaagtttgctttcggttttcggttactctttccttttgtgttgttttttttttttttttttaaatggagtcttggctctgtcgcccaggatagagtgcagtgccgcgatctcggctcactgtaagctccgtctcccgggttcaaccaattctgcttcggcctcctaagtagctgggattacaggcgcccgccaccgtgcccgactaattattgcatttttagtagagacggagttttaccgtcttgaccaggctagtctcgaactcctgacttcgtgatc

SEQ ID NO: 120105 - DNA, 2778 bp, Homo sapiens
aaagtgttaggaaagtttttgacaataccttgaattagattatgtagaaattagtctcatctgttaagagtaagggaaaggttgagagctgaagcgtgtagaaccagattagtacagctggtgtatcaaagactaaaaggggttaaatgagcagccctgaaggccagctgagattaaacacaaaatttcaactagacccagtctacatggtttcctgactttgcttagccatgttccacatccccaaacagggtgatgaaagcagaaggaaggggtttttctatggatgggtttggcatggctggcatgacagaaagttaaggaagtaagaagttatttctggaacagtggggaggatcatttaattggccgagccatgaagtccgtgtcatactaaggaacttgttaagataccatagttagttacaatgacttttgacttgccttaacactatcatattttcttcatgaagaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtaagtagaaggaggtatgcgtgctatgactgtgggagtcctggaagcttggtagagggacataggcatcacagtgggagagcagatgcttagcatcagtttctgttggataaggatgacaatagttttagtgtagtatgacttgtagagttctttttacttttgtaaaggatataaatccattttgtttttgtcgtcataacatccctacgactgtattgttcttgtttgccagatgggaacttgatgcataggaagcttaagttaatttttcaggggtatccaaataattaaaggtaaatttgagaccagaaatcaggctttctagttccttattaaaagatttttctactgcatagcactgctttaagtttgttgttttcctccttcctctgccttaggagtacaaaatattggtgttctgtgtaacagggaaggcatcagcagaaatcttttcctttagtactaagcaaaaatgatgcctttctttctgtgctcattacgtattcgtgttccttactgtccctaagaagtgaggaagattctgctgcttccttccccaagcatatatccctgtagatgtgttcgtggtcctctttcattgttcattacatttcgcaaagggattccttattatccaactgtctgttgtttccaggtctcagctcgcgtacatggacatagggtactctgggaggaggtagtacattcagcatctgcaccagagcctccaaatactcagctccaatctgaggcaacccaacataaatctccagtgccccaagagtcacaagagagaggtgagtagccagatttcattgatgataagggggggaagtacaaataaaagtccatttgggatacctatctagttcctgaagaaccaggaactaaaatcctgtttacagaccagtcccaaagtctgtgtttaaatgtttaggcttcaaatatagattattctttctagtggtaaactcatgaacaaattaaataatttgacttttttttttttaattttttttccttttattattatactttaagttttagggtacatgtgcacattgtgcaggttagttacatatgtatacatgtgccatatttctgttaccacagtacatttacaacatacatttttgaggttatgctggtattgtcatgccactttatttggaaatatttcagtatgtatttcctcagacgagcatttcttaggtaacttaaataaataaattcctaaatttatcacaattaagaaatgtagtattgctacaatactaacctaggccatagttcatattttgacagttgccccaattatgttctttctggttcagagtctagtctggcgtcacactttgtggttagttgtcatggctgtttagtctcctttactttggaatagttcctcaacctttctttttttttgaagagtacaggtgtgttattttgtagaatggctgcagtttggatttgcgtgatgtttgatcatgtttacattgaggtcatatatatttggcaggaacacctcaccctgccaaggatacatgacctaaatcttaacaagagatgttgtactccttcttaggggtacaacaggaatttgtcctattattggtggtgttatctttgatgacttggttaaggttattcttgcagggttaatcattgtatagttactatttttccctttgtaactaataagtaatttgtggaagatactcttgagtgtatttaaatatcttagtcctcattaaactttgttgctaaaacactagttttagtgttcattggta

SEQ ID NO: 120106 - DNA, 2446 bp, Homo sapiens
ttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcat

SEQ ID NO: 120107 - DNA, 1073 bp, Homo sapiens
ttgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcattaatctgttcttaaaacttctttttactggctttcatacttagcattccagtgaaatgttcttagactcaccagtggacaaataataaggcctttttttattattatttcttgtcttttttgatctaatttatattttatattgttgaattctccctcctttggcttgtgggatcctttttctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttgg

SEQ ID NO: 120108 - DNA, 1390 bp, Homo sapiens
agcactttaggaaaagtcaccgtagcccactgtggcatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgcccacagatttgcaggcttaagcagaacaagggaagattgatatttttggatatgctatagcagctttctcctatgaaataaaactgatgatgtttggaagtatactactctcaaaggtgtctttaaagtacaggttaatggtgaacattttcccccagtggcttcacctcattcctcccactggccttaccccttccttccccagtggaagcattttcaaaagcaaagataattttcgctggtgaacttcagaacttgccttcagggttagcttcatgtaattttaccatttcccatccccattccccaccacattatgtcaagattcaagttataaattaacgttttacttagactttgaaagagatttcatgagtaatttgaatgaaccttgctgaattaatctgaatagcaactgtctgacttgataactccagtgccagtatagtggctgctgcatagacactattcagtaaatgtctgatgaaagaaattggactttttccctttaatactgatgatgcaattttgaaatgttgcttgttctggaatacttcggaagttaaacaataaagtcagcttggagaggagatcatgatctttatactgtgaatagcagaatgtcacagatgaagaatattaaaattaggggcgtccactccaaaacatatcaccagagtgacaacttcagccctcagcctctgcaatccatatatatcctggtcttgggagtccatagaatactgtttccttctaataaaggtttcaaacaaatccctgcagatttatttaaagtgtttgtggaagataattttccatataagctgtgcagtattctatggtatatgtccccattgttcatcatttacgtcatttacagtttgatcaccataaacaatttttcagtgaacatccttgtatatacaactttgcctacttacagaatttttttctttgttcagttcccataatgagaatcaatgaggcagaaggtaggcatattttctaaggcttttgatgcattttccagaatgccctccagaaaagttacactaatttgtacaccctgttagcagcctatgataatgcccaattttctatacccacg

SEQ ID NO: 120109 - DNA, 1049 bp, Homo sapiens
gcctctttaatagcaaaaggggaggggacacaaggtgccgagctagcaaacgacagagtctgtcagggaggtggctagagaggcccggaagtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagaggtgcgtttgcaggagtatgtgtgtgtgtgtgtgtgtgtgtgtgtttgtggagagaggcccttccctccccagttcctgcagcctcggctcccaaggagggagacccctgcgagaagccgtgggggagggaagggcgctctgcggcggaatgaagtggtcctcggcgttcctgcgtagagcccaatatgggtgtcccttgtttagggccgttaccgagtgtccgggtcggttcttgagggtatttggagacgggatgcatgggtcacatagacaagcctcgagaatgggagccgttacatttttgcactgcctggtaacaaggtcagtttcaaggtctttaaattattctgtggtactggccaagagccagaacgttggagtcagattacctggttcaaatcctgcctctgccacttactggctgtgtgacttttcactagttcctaagctctctctctgcctcattttactattttgtaaaatggggataatattccctaactcactgggttgttgtgaggattgaatgcattcgtatgggtaaggtgcagagtaagcatgatttaaagatttgcttttattagtggtactattattatttataactatgatgacacattagtgactggcttttgtacggttgctttcaattttactgtcattcatcaattcactttgtaatggatgatttctatattttaggagggaaaaataagatactctgaaaaagagcctatcccaaagcaaagaccaaaactggtttgtgttggacgttgtgatactcaaactctcaaaggctttaagac

SEQ ID NO: 120110 - DNA, 2022 bp, Homo sapiens
aggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtagaaagaacaggtttagtatctgagcgctgtggcctgtttcctcctgaaatcccagatcagagtgaggggcattcctttaacatccaggagttcttcatctcttttttgtaccgtgaacctccttggcagtaaggtgaagtccctggactccttctcagaataattttttttttaaaatacataaaccataaaggattacaaaagaacgcagtcatatcaacatacagtttgcaaagtattaactttgtattaaagtcatacttttttttattagtacactaaataataaaacctacggacagggcttataactggcaattacaaagcagtgataagtatctctttgcttggttgtaatgtgatgtaaaaacatctgcaggttctattggtgacaaagtcgtgggtactgcttatgctacattgatttgttgcttccattcataattggaaggaaatgctaactttctcttaaagactagttaaaaataagattagcttttgtcctgttcaagttcatggactacgtgggaaggagttcatggaccactggttatgaacctctggtagaaaatgggccgacttttacctccatgttcttccctgttttatgagactgtgtcctctttgcatcatcctgtgtccctgtgcacacaccctcagaggacctgtgtggccagagccttctaaatggtgagctggataccagggttcttgacttgggtctgttgcacccaaggcctgtaacagtggaaagtcagtgcgagtctcttagcttcattctttataaaggatgtgggaaattctgagctgcacatgagaaagtaacttgaaaactgtaattttataataactataaatgtctggaaggaaacctgcatacatatcgtatgccaggccatgttaggtgatttcacgtactgtgatgttgtttgggtcccccaaactccataaactagagattgtaatccccttttcagataataaaaggtattaatattctctgagaattttgcaccagtttccaatggattttcataaaagcacaaatgtatatatgaaggagcatagagtaatgataagaacgtgtgctctggcatcattctacctgagctcccatcctagcattgccactgattagctatttaaactggctgtgccttaatttccctatcagtaaaatgggtataataataatacctcccttataagattgttgttttctgcgttaaatgagttaacatttataatgctcttggaaatagtgccagccacctaggtagttctatggaagtgtttgatgaaaacatgaaaataagaacaaatgatttctaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagaggtaaggattattttctagacagtatgaattctgcagacttcatccaatttcatttaaggatagccaacaaaattcattgatagggggcttatgtgcccatcacagatcaactctcatttaagactgagactaaaaggagtatttccaacataatgatggaaagctttttcaaccaagactggacatagtaaataagatattagtaaaacttaggtttggaaagaattggttcttgcttgggttttgttttgttgtattggtttttttttttcttgtattggtttttgttttcttgagacagggtcttgtt

SEQ ID NO: 120111 - DNA, 1012 bp, Homo sapiens
ctggagccctatccctcccccaatgcccctcactactattgagcttcctgtgaagactcctcactccccattcccctccaccccaatcctagatcctccatacagatctcaaatgggatctgcattttctcatctatctcgaggttgtttatcattaactttatttaggtgcccacttaagaggcttttcctgtttattactagctgttggcaggaatggggcctgggggtgcttcccagatcttccccactccaccattttggtcagccccttcttcaatgggattacctattgttttaggggttgttgaaagtggaagatgtggccctgaccctcacccctgaatggacacagcaggattcatctcaggggaatctctgtagagatgaaaagcaggagaaccatggcagcctggtctccctgggtaagactaaaggacactaatttctgttaaggtttcttggcattctttgtatattagaacctgttgagctattggaagctgttgagccctgttatgtttggattcacaatcaccatttctgaaagcctgtaactgactagctccttaccctttctttttttgttgtttttgagagatagggtcttgctcagtcactcaggatagagtgcagtgacacaatcatggctcactgcagcctcaatgttttgggctaaagtgatcctctcaccacagcctcccaaactgctgggactaaaggcatgtaccaccacacttggctaattttttaattttaattttttgtcgagatagagttttgctatgttgcctaggctggtctcggactccagggctcaagcaatcttcctgccttgtcccctcaaaatgctggaattacaggcatgagcatgagctactccacctggcctgcttatcccttctgaccttgctttctcctctccgtgccagtattctagttaagttaaatgggttgaagtcgatacaaccccgagtacaggtctggctcacaggagatgcccactaaatgt

SEQ ID NO: 120112 - DNA, 1007 bp, Homo sapiens
aatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaccagtgagattaccttcatagatctgaaaatctgatgttatccaggtttctgaagaacttctcgccaaggccatttgtgcttgtgtccaattctctgacctagattgtgactcaatctagtgtgtttcttaccaagtacataggcagagcagggttactgtgattgaaagaatccattttttttttggagacgtagtcttgctctgtcgcccaggctggagtgcagtggcacaatcttggctcactgcaacctccacctcctgggttcaagcgattctcctgcctcagcctcctgagtagctgggattacaggtgtgtgccaccatgcccggctaattttttatgtttttagtagagacgggattttaccgtgttagccaggatggtctcgatctcctaac

SEQ ID NO: 120113 - DNA, 1048 bp, Homo sapiens
agactgtctcaaaaaaaaaaaaaagaaaaagaaaaaataataaaacaaatgttgcaaaatattaaaagttggtgaatgtgtgaaagatccgctaccttatttctactttctctgcatccttttcattttcatttaattttttaagtaggtaaaaatgtacatggctcaaaaacaaaaattttttaagttatttaatgaaaagtttctattctactcgattttcccagccacctagtctcttcctcctactctgaaataggttgtaactgttactaatttttcgtgtgtccttccagatatttttttgatgcatatgttttccatattgaaacaaatatattttgctctctttatcactaagatggtagactcttgcattttttatttctaaacagctgcttaatattaaaatgtatggatacattttaaaggtagaaagaggtaacatttatgatcccttcttagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatat

SEQ ID NO: 120114 - DNA, 1050 bp, Homo sapiens
cattatttacctttacatatcccctttccttttcctctttctctcttaatgttttattttaccctaagttctatcttatttcctcctttctgcctcttttcacctttttcttctctcctttgttttgtctttctccctttcctttctccacttctttaagcataagataaagaggtaacagtggcacaaccaacatactttagcggtaacaacaggagaaattacatctgggtggagaagggaagattccccagaggaggcgacatttatattggccttgaagaatgggtagggttatggcaggcttatatctgggaaaaaggtcatttcagggttcagccactgccacaaatagtatactttttgttttctgttatcagagtgagtctgtcagctacatctcattttcctcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaaggtaaagaagaaagacccatcttgggaggaaggggaagatgggtaacataggacattggggcttttttgtacttgctactgtttctgatcattaaagtcaaaaaggccgtctcagaatctgatggctcatatatagactctcagacagcctagtttgtcactcttcaacccttacttttttgtatattcatattcttctaaattctggctttaccacttaatttagtccttctgatatttatctctctttatactgacctccttgctatttttagcctttatcctatcagacaatacctctatcttccacttgcactatatcctttctgcttcactaaataagcctttgctccattatgtctgcaactaactttcagatggttcaagaaaaaaaaaatttgtatacttacaaagaaaaggagtaacaggctgggtgcggtggctcacgcctataatcccaacactttgggaggccaaggtgggtggatcacg

SEQ ID NO: 120115 - DNA, 1085 bp, Homo sapiens
ctaatcttaagtcttttctatcagagtatttttctgagtaagtattgtacattaatccggaggtcagatttcaaaggtcatagttaagttctcagaatttgcagttttactttatggtggagtttgtattaataatgatggcttattcttcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtgagaaaaaagatgtgacttctgcttgagaaaacataaattgtggatttctaggccagagtgaagaacagccattttttcacaaagcatgtttttgacagtttggtgcatcagaaaggggcatgagtttcacggaaagttggctaatgtggtcccaacttatttataacttttctgtggaaggattttatatttctctattaagctacaaaattctgtttgataaacatgctgctcatcttagaaaacttctaagacaagagaaagtatcaaagagatgacagtagcaggatgggaagcagtctcttggaggggcatcactctgttgcacaatacaaataattaagaattaaggttttgcagatatatccattgctctgactccattacagggttttaaaatgaagacattaactatttcaggggaatgagatgtgggagtacaatggaaagttagtgagg

SEQ ID NO: 120116 - DNA, 1044 bp, Homo sapiens
ttgagctgtttcggtcaggatgattgaaacagtaccttccttcagaaaactgtaggcgtttttgttccatttcttttttcttcctatattatctggatttgtatttctaaagtatctatcattaatcaggttttggtgttccttcatgagacagagtgactgattttagtgtaaatactccagtccctccttgtcctgaggttttctgcatttttatatttttttcttcgtaaattattgtctagatctcggggtttccagaagaaaagatcaagggagaattatcaagaatagattatttttctgaatagttaaacctttgatggccataaccttgacccttcagactgcagagatgcaggaaggacttctggcagtgaaggtaaaggaggaagaggaggaacattcctgtgggccagaatcaggcctgtcaagaaataaccctcataccagagagatctttcgtagacgcttcaggcagttctgctatcaggagtcccctgggccccgggaggctcttcaaagactccaggagctctgccatcagtggctgagaccagagatgcacaccaaggagcagatcctagagctgctggtgctggagcagttcctgactatcctgcctgaggagctccaggcctgggtcagacagcaccgtcctgtgagtggagaggaggcagtgactgtgctggaggatttggagagagagctggatgacccaggagagcaggtgagaagatgggagaacagggatttgtacctataagaacaagtatggggtttcagtgcaacaagaaaaggtagaggaggaggattttttttttatgccagacttgatcttctgtaggcttttagtctctctgcctctgttttttctttgccagcttcttggtccttcttttctatccagcggccctgaggaggcctccttgccatgttctctctgatattgggttcccaactgtccttgatttccaccaggtcctgagccatgctcatgaacaggaagagtttgtaaaggagaaggcaactccaggagcagct

SEQ ID NO: 120117 - DNA, 1022 bp, Homo sapiens
tcccactctggccaatagtttacttcaaactggaaaataaaaccactttctcagtgccatgtcactactttctagtggtgctaagaaagtagtgttggacattcatagcctacagttcttttttttttgaggtggagtcttgctctgtcgcccagtctagagtgcagtggcacgatctcggctcactgcaacctctgcctcccaggttcaagcgattttcctgcctcagcctcctgagtagctgggactacaggcgcctaccaccgcgcccggctaattttttatttttagtagagacggggtttcaccatcttggccagggtggtcttgaactcctgacccttgtgatccacctgccttggcctcctaaagtgctgggattacaggcgtgagcaaccgcgcccggcctgcctacagttcttatattggttaatcctgtaattttactaggaaagtattttctcaagtcctttttgtagtattgtgccaggcattggggttccatggctgaggttcatgagttggtgatatcatgtcctaattcttcatttattcatcaggttttaagggaaataatagaaccagggctatagaaagtagcttccatgaggctagattagcttttgctgaatattctgagatctaaatgtatacggtaatatatatacaggcacataaatactactaacaaacatagagcagtgcttggcacatcatatgaagagttttatgcacagtagcttccttaatgctcatgataattttatcaagtgtgtactgttgtcttactttacagataaactgcagcagagagggtaaatgacttatccaaggtacacagctaggaagcagcagagccaggattcaaactgagatggaacacatgaccacatcaggtcctgccccacaacatgtgttattggttatcttctagttcttgtgggtggtgtgtttataggtatttatttatatttttagttttaaaagcctgccattttgaatgggattaaatgaacttgtga

SEQ ID NO: 120118 - DNA, 1187 bp, Homo sapiens
ttggggttacaatgaactatgaccacaccactgcgctccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctacagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggtttta

SEQ ID NO: 120119 - DNA, 1088 bp, Homo sapiens
gggcagtctggtggattctgaaatccttatatgtaggtaaacccttctcttaattattagaaattacaaacccccacaatctttgataattttctattttgtatatgctgggttcatatatgcattgcatctattcagatatatactttttggggcatctagcaacatagagctagcagatacatgtcctctacaagcaagacaaatggggagaaactccactcaatacagtggataataccagaagtggttagttcaggcatgactttccttgatctggctcttcttttcttgccacttaaaagtcttagtgggataatgtgtgagaaattctgtttcaactataaagtgccttataaatgaatggtcatgtttaccccagagtgtcagtgagtgtcacttgagccattcagctcttgtacacagatgacttatgcaactcaaaagttatgtatgacgtggggttggaaccgcgtttccctctgcagaatcagctgactcactggaaggtggaattcttgatcttggctcagttttatcccatattctaccagtctcaggcatgtggttatccctgtacttaagattcccaatccctctccccttaaagcttttggttggatgatagagccatacatcatatgaaaaaattagtgcatgactaacaacagaggttctggggtttctggtggagaccactgctttatgatgactaaccaaagcccccttagttatgtatttcctggaaaccctcatgacttccataactttgctcttttattctttcagaattaagagaggctcagttatactcaggtaggtgatgagagacaaaaccatattagggtaaggagtaaaaatccttgtgaacctaactactattatgaatgatttggaaattgcttagatttggattcttttggttacatgtataaagatgatacacaacaaccacaaaaatcctcagttgtttctatgtgttaacagtatctttgcctcctgaaatgtctcagagctgaagccatagggtaaaatcaatctcaggtgttaaagaaggattatagggtggaaaccgcagttccccaaaa

SEQ ID NO: 120120 - DNA, 1515 bp, Homo sapiens
cataataaaaagaaagcaagctggacaggtaggcaagcttgaggtccaatcataggacgcttaagttagtaaatttgaaatcctgaggtccttgaccagtggatggtgggtactgaaggagggtatgggaaatgctggtatagcaaatagtatgcatcccattttcctctgcctgccttttagctcctcaacactgagttatgttccagtgatccttttctccctaatttctcccatgagagccagtctgtagttggtttttcaacaaacatctgtgaaagaaaaccgaagttttaaatgacttctcatggttattttttttcctttctcttgcaggacattggggacacattgagcaggtatagttttctgtttccctagtgttaaatcaaatatgagaagactgtctccttcacatttgtaaatcctgaaaggagccctgagcctgaggatggacatcttatcaaattgacacatatccctgaagagagtcactagtatacaaagaattagatgaaccacagctctactcagtaaaattcaggaagtagggggttcatgtgggaggctgccggtggattaggggtatgaggacacttccatggagagggtgtggccttacagggacctgggctgaatataagggtagtttatgtctattgcttcctatacatttcagaatcctttcccccttcattatctcatttttttttttctgtaatgggggaaataaagcctaagaaaggtgtgactggcctgcatttacataattactgatgagccacctggattctggctcttattcttactcttgctatttctctatgttccatcaaaaaaaaaaaagtgaggaagaactccctggcagctggaacacgatcaaagagggagagcttggagggggcagtaagccagggcaaagttgttttgcaggatggatgacgaggcaagtgggatgggccttgggaagctcatgtttggtgtaagaatgccttcaggggtggaaactgactttgaggaagctgtactgtgaaggtgattaagatcctgaatggtgaaaaccttctaaagcaaaatgcagcttgactatgtgggagcatttaaggagattggggaggtccttatagatggggcagtttggctgggaggcctgtgttgatagaatcatgttgatggaattgaggttcctgagggatcctaggatggagataaggtggagttcataccagtcccagccagatgacctaagcaaataatactgttacctgatactttatgatgccagtctagctgtgacctaacatacagagttagctgcctcagaccctagcagtttgtgacattaaggattgaatttggctatataagataggaaacccaaaattttattggcttaaggcttaaacataataaaagaaatgtgcaggttgggtgcggtggctcacacctgtaatcccagcattttgggaggccaagtcaggtggatcacctgaggtcaggagttcgagaccagcc

SEQ ID NO: 120121 - DNA, 1249 bp, Homo sapiens
aataagtatggtttttacattttaattttaatttaatattatttatttattttgagattgagtcttgctctgttgcccaggctggagtgcagtggtgcgatcttggctcactgcaacctccgcctcctgggttcaagcgattctcctgcctcaacctcctgagtagctgagattacaggcgcacaccaccatggctggctaatttttgtatttttagtagagacggggtttcaccatattggtcaggctggtctcaaactcctgacctcgtgatctgccctcctcggcctcccaaagtgttgggattacaagtgtgagccacagcgtcaggccagtttacatttttaaatggtaaaaatcagaaaaatgtatttctttctttctttttttctttttttatttttgagacgaagcaagaagggagtggacagcatagtaatgcagttgaggtcaaataatatcaaagctgatacccatttgattcaataacatgaccatcattggtgatcttaggtagaactatcacaatggaataattggggcaggagccacattagggggagttgagtagtgactaggtcaggtgaatggagactacacaagtagatgactatttcaagtacaactgttaaggggttgtaataaaatacttagagacgagacaggattatggagttttatctggaagggttggttaaagaaactagaagttagacatattttcaaaatacatatggaaaggagtatatgttgtaaggtttctaggtgagggagaacactgaagccacaagaaaccatatactggccgggcacggtggctcatgcctgtaatcccagcactttgggaggccgaggtgggcagatcacctgaggtcgggagattgagaccagcctgaccaacatggagaaaccccatctctattaaaaatacaaaattagccgggtgtggtggcacatgcttgtaatcccagctactcaggaggctgaggcaggagaatcgcttgaaccagtgagacgatggttgcagtgagccgagattgcgccattgcattccagcctgggcaatgagcgaaaccctgtctccaaaaaaaaaaaaaagaaaggaagaaagaaaccatgtactgatcagcaatgtgcggttcctgagaaggcaggtggaaatgagaactaaagtacatatgccaggaattagtgtcagagagtcttctgttgtatgggaagaaatgattgtttcagagtatgggaaaga

SEQ ID NO: 120122 - DNA, 1600 bp, Homo sapiens
cccacccccactctcttttctctgtttacccccatgttacctgtctcacggacacattgtacacggagacatccttttgacagtttaaaagaagtgcataaaaccgcgtacacatcgacaagctgcagacactcttactcccatcggctctcagacaaaacgcagttggacgttaactgacttatgcccattccttagtctataagcatttccccagcactttcctgcaatccgtcctggtctagaaactcacagaaaagaacagcttttcgctgctggagtaagtcacttaaccactctgagactcaggagataacacagttatgaggaatattgtggaatcatgtgactcacagagccctttgtgaactggcacagctaaacagaaacgtggaaacaaagtattacatataaaacagttgtaaggtgaccttcaaggagtccatgatactgtgtattttctgtacgttgagggcttcaggaatgcgtacacaattatgtccgtgtttaaatatgagtacattcatgtgcaatcacttaacatttatggacctttcagctatattatttcactcactctggtgagaactcttgagtaggttgggaagatggtgtttgcccatttcacacatgagggaaataagtcactttcacagtgtacctatatggaagagctacaatacaacatagttctaagcctcctactccagtcacagttccgctaagtcatgcaatatcctaccagggacaggtagatgactcattgtttaagatagacacaaatagtcctgacgaggtagctgagtggttgaagccacaggctgctaagatagacacagattgccaaaggagtggcttgtttgcccctgcgccctgagtctcttgtgggtggcagtgtggcctaaggacaagcgccaactggagacttggcatcaggtgtgtggactccatgtgtgataagaagtaccatgctgatgctaaggtctacctaattttgaactgcccatctgttttgcttttctcaggagcaaatccagaaccagctcgaccatttaaaaagagtgaaagatttaaagaagagacgtcgggcccagggggaacaggcacgagctgaactcttggtaagggttgttggaattcacagttggttctgctggtgctctcctcttctgtagagctgatgttacttcccttaaacttgtccagcatgtcacccagaacttgtaggtagaggtggatcaaccgcacatggcagtgggaactcacccggagaactaagattcccttacttttggggaaagcatggagaagccaagtttggaacccttggaaatcagacctgtcagtttactttaacctgctaactgcgtagaccagggttgatccttggcaaagctgagataggtaaaattattggatacagttagcttgcgttggtaccattctgcagacaattgctaatagtggatttgtgtaatccccactgttgcttctctttggcttattctcctttcttaacaatgccttaattctgaattttttactctgccctcttcctccagtctcaaggccttaacaagtggctgatgtgttaatttat

SEQ ID NO: 120123 - DNA, 1022 bp, Homo sapiens
atgactatttcaattattacttttacaaaatcattcctatattgtcttataacattacaccctttgtgttggtaaaaaatagccaactcctccttatttatctgtcaaccatcattctaatacactttctgcatccctctcttacactcttatactcttggtaattcattgcttcactctatgtcatttttcagtctcttcaatttacatagttctttgactctctttctgttctctcttgttctgtgtttcacaacgtgtatttgttctcactctctttcttctggtctttttaatttttcttggacacccacaaaagtccagtacaactttactctcttcctattaatttcatattcacggatgtatttatttctttattaatcaccaaagacctagttgtgtactaggtgctacaagggaatgaaatatcaattcttttctccaattcattagtgaaaaccacgttaatactttggcagctaccatctgttgtgtgcttcctatacaccaggcaccatgctaaacatttcctgaatacctggttctcataactctttgaggtagttaatatcatcttccttttacagaagaagaaatggtcgcagagaggttaagtagcttgcccaaggttacatagccgatgaagaccaggcctggagtctgagtcctgtttgattccaaatctggtgctcctggggtagctctaccattgacgatatgtggacattaatggacagtaggagaagaataaacttataacttttcctcaatcatgtcacaatctccccattgcctgctgccggagcttctccctgacaacgagcttctagactgagtgagcctctagttaatcctcacaatgaaatctacaagcaaagtcaggagtgttgggcacctttgaaagggtggtggattagggctcaggtagtaatgttgacttctaatgctgctgccacacctttcaaagcacttcacaacctctgtatgacctggataatatttctatattctatatttat

SEQ ID NO: 120124 - DNA, 1026 bp, Homo sapiens
gacagcaggatgatgagtccaccggggttaggaggtaggaagtgaagacaactacaaagagagtcctttccagtgctgggtgttcagagaagcccagaaggagaaagcctggtgcggagctttggttaaccatggcctgttcctctctgtatctggaaggatgaggctgtcaccccagtgtgattcaacctgtcttattaaaactcagcctgggtgtttgtgaggtcccagtaggtgagtgtttctcttttgtctctgctcgcccagcgttcctttcccagtctcatcaccatcaagcagctccttctcatcccctgttccttctgatcaaacattgtctagtgggagtgaggaaaccattaatgtgctcaacaacggattgagcctcacactggtgcctctgacttcctggttgaatgcaaaacgtctgatgtgaagcatagatcagctaactagttagtttttattaattttgcaaaaatttattaagtacctattatgttctgatcgctatgctactactgaattttccctttgttatgtgtggaaggaaatacaaagaaatgtgtgttcagtgagtttcctaattgtaaacattactagagaattcatcatgttttctagtggtgggcataaattttctcaaatcattcacattctatctactttacacttttgcaagagatttgaccagtgatagaaatgtggactgtggagatttcttctgtatgtgaaatgactcaactgctagaaagatcagtcaggtgatttaggtctttcaaaaaaaattatgacttattaaactaagaacaaacatttctcctgcaaatgaaatgtcctgcctaaattttccattatgtgtaatatgtaaaaataagaaaaaatataatgtcagtcagaaagattattttctggttctgtaactgcaaaaaaatcctgaagaattgatgtttggtgttagaaagctgaaatagatttcaatatcctctccttttcatgtaagataaaatatagtagtaaaaacat

SEQ ID NO: 120125 - DNA, 1030 bp, Homo sapiens
aggttacctagtcaataagtgctaggactaggattttagagtaagtttaactccaaatctggtcctccagtgttgaggataggcggaaactgatatctcacagccaaagagcaaaggttctgcttaccttcaatcaaataaaaatctcttctggtaccagcaattccccatgacagagctcttaactggtgcccagcctccacttgtacatcaggaagaaacaaaaaaataaaaaggaatgggcatccttgaatgggcaactgcatctctggtcacaatagggattgctaatgctgaccatctggcacttttctaagcacacatgtgtgtgatgagctggagctggctcagattatctcttgattagtaaatttttaggaattttgtgagacagttattaaaccatcagtggcttgagacagccatggcaggaatatttacactatgaaaattggcaaacactacaaattagggctctccccatctgccaccaaccaagttgtttattaaacatttactctacactgctgattatccttcacaactctacatattattctcttccttccaatatgaagaagttgaaacaaagaaatataaataactttcccaaggcagtatagttagtaagcaccagagctgatgtttgaacccaaatctgctaactgtagagggtttgcaccaaccaaagcccaccaaatctctgcagggaggatgaagccaaggtcagaactttgccattgagttctttgccatcgagttctttgccatcgagttctttgccattgagttctttgccaacaattttccccctcagtctaggcagaggtgtgcctctgttttagtggcattggaggtagaaatgttgacatggtatggtggtagagggatcccacggagggaaagagctcattaattctgctgagactctagggtccatagcccacagacaattcattagccacaaattatggtaaaaggggcaggggaatatctataggaaatatgccaacaatagtcatcactgtgg

SEQ ID NO: 120126 - DNA, 1060 bp, Homo sapiens
gatctcattgtaggaggtgtcttcacaggagagtcgaattagagctgggacctcacagacaaaatcatccacctgccgatcggggcagaagggcaggtgcagggtggatggtgtctggaccactgactccactagcccaatgacccaggccacagatgccagctgccagcacaggcgggggtggatgatggtggcatagtggaggggctggcagacagccacgtagcgatcaaaagccatcactgtcaagaggatgcactcagttgtccccagggacaggaagatgaagatctggacagagcagtccaggaagctgatggtcttctttgggccccagaggttgaccagcatttggggaacacaactcgtggtgaaacagaggtccaagaaggagaggttggagaggaaaaagtacattggagagtggagcttggggtccagcgcagacagcaggatgatgagtgtgttgcccactagggttaggaggtaggaagtgaggacaaccacgaagagagtcctttccagccctgggtgttcagagaagcccagaaggaggaagcccggtgtggagctttggttaaccatggcctgttcttgtttgtacctggagggatgaggctgtcactccagtgtgattcaacctgtcttatcaaaactcagcctgggtgtttgtgaggtcacagcaggtaggtgtttctcttctgtctctgctcgcccagcctccctttccaaggctcatcaccatccagcagctccttctcattccctgttcttcctggtcaaacattgtctagtgagagtgaggaatccatgaatgtactggacagcagatggatactcacactggtgcctctgacttcctgggtgagggcaaaggaggctgattaaaatatgcactaattcattaattcattcattcaggggaaatttattgagtgccactatgttctgaatgctgttctagagttgtctcttatctattggatgatctcgtaaggtatattgaatgaattttctgataagttgtctctgtaggctcaattattgctctattggttga

SEQ ID NO: 120127 - DNA, 3987 bp, Homo sapiens
aaaatccagtgttggcctggcaggtggaagggctctggagtgggagctatgtggttgactcagcctccttaaggcaagaggatggctgttggctgtaggtgacaactggagagaggcagctgtgagcctctagtagtcaacactcacagcagctgggtgtagcatgcagccccagcataaaggacctgggcaggcgttcactgtgccccaggctgtcattaggggctggtgcaatgccaaagagagggatgttccaactgggttgacacatctctctgatttattggaagctctgtgcactgacttttctctccttccccactttttccttttgtttttaaattctctcttatttccctgatcgcattttttctatcggtatccttatgttctctggcttttcttgttctgttttgatttctccttttaatttattctgtccacttaccctacgtcctccccctacatttttctgtgcccttcctctctttccctgtgcccttcctctctttccctcctccccactccttcatcacctcctcttctcctactatcccaattgtgcttcttcctccagaaagaggagcgtgtctctgaactgcgccatcaactccagtctcggcagcagctccgctcccggcgccacccaccgacacccccagaaccctctgggggcctgcccaggggaccccctgagccccccgaccggcttagctgtgatgggagtcgagtgcatttgctttataagtgagggtagggtgagggaggacaggccagtagggggagggaaagggagaggggaagggcaggggactcaggaagcagggggtccccatccccagctgggaagaacatgctatccaatctcatctcttgtaaatacatgtccccctgtgagttctgggctgatttgggtctctcatacctctgggaaacagacctttttctctcttactgcttcatgtaattttgtatcacctcttcacaatttagttcgtacctggcttgaagctgctcactgctcacacgctgcctcctcagcagcctcactgcatctttctcttcccatgcaacaccctcttctagttaccacggcaacccctgcagctcctctgcctttgtgctctgttcctgtccagcaggggtctcccaacaagtgctctttccaccccaaaggggcctctccttttctccactgtcataatctctttccatcttacttgcccttctatactttctcacatgtggctccccctgaattttgcttcctttgggagctcattcttttcgccaaggctcacatgctccttgcctctgctctgtgcactcacgctcagcacacatgcatcctcccctctcctgcgtgtgcccactgaacatgctcatgtgtacacacgcttttcccgtatgctttcttcatgttcagtcacatgtgctctcgggtgccctgcattcacagctacgtgtgcccctctcatggtcatgggtctgcccttgagcgtgtttgggtaggcatgtgcaatttgtctagcatgctgagtcatgtctttcctatttgcacacgtccatgtttatccatgtactttccctgtgtaccctccatgtaccttgtgtactttcttcccttaaatcatggtattcttctgacagagccatatgtaccctaccctgcacattgttatgcacttttccccaattcatgtttggtggggccatccacaccctctccttgtcacagaatctccatttctgctcagattccccccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgttgggatagacagatggacctatggggtgggaggtggtgtccctttcacactgtggtgtctcttggggaaggatctccccgaatctcaataaaccagtgaacagtgtgactcggcaccttgcagtcttcctgtgaacagaatgggcttcaatccaagaagggaggttcagaggactccaagttcatgaaaaggcattaaagcggagggtgaaaagaggtgttttattgatccattgagggcttagcagaatgaagcaggacatgattaagtctgagattagtgagtgaggacactactggttaaaagtgtgggctctggagtcagactgccagggtatcagatccaaccacatgcaaacattttcttagtctctattccccatgtcctcatttatgaaaatgagaataacagtaatacattcctccataggttgggtacaaagactattataaattgtgcattcaggtgcctaggttggcccttgggccatggtatatgttgcgtgaatgttagcctctgtccctgctgtttaatgagttccttgacagtagtgggcatgtattgggagcctggagcaagtgcctaagcatcccctctagggacgctccttcccaggaactaagaagagtaaaagaatgatgactgctagaaggtaatggatgagatggctgctgagtgcttccaaccttaaacatctttgtttaggaactctgagcatcttggaaataatttgctatcaaactgaaaaaaaatcttgaatggacaagggcaaaaacatttgcctgagactttaaacattttttgtgtcatcttggagagtgcttttttgaagctcaaattttcttttattttggcactgatttttaaagtgattctcagatttttgtaagacagctgcaagggttggatgggccctgtcattcactgacctgttaagagccaatttctgaacttccactaaagcatgggctggttgaatcttagaccagtacttgaaaaactttccactgtgattatccaccttggaccagttggacttaatttgagtctctcttcttcccacagtgaaatatccgctaggaaaagagaagaagtctatggagtagataagcctgcagtttggaaaatgaatagttggcatcagaacagcagcaggaggctgggtgtggtggctcacgcctgtaatcccagcactttgggaggctgaggtgggtggatcacgaggtcaggagttcaagaccagcctggccaagatggcgaaaccctgtctctactaaaaatacaaaaattagctgggcgtgatggtgggtgcctgtaatctcagctactcgggaggctgaggcagataattgcttgaacccaggagatgaaggttgcagtgagtttgtgccactgcactccagcctgggcgacagagtgagactgtctcaaaaaaaaaaaaaaagaaaaaaaaaaaagaaacaacagtagcaggagctatagaacagccctgggtagaacctaaaagacccaaattatcatctcaaacttgcattgcacttaagtgggctgtaaattataaacaaagggtgaaaagttctactgtggccaaaggtaagccagacactctgctagcaggagtgcaggagtcgagagccaaacggtgcggctagcagagtgcccagtgcaaaggggtgggaaggagtgagattgagaatattaaaaaggtacttagaagagaacttgtaagatttttactggccaaatttaaaacatgactgagcactatttttcatacaggcctcctactaataagaaaaacaattttgagataactacttatttgagttcacagttaatgttcctgatgattaagatcagttgcaaatgttcatctgtcaatgcttatctacaatgagacttcatgtattcatttctgaaagtgtcttttcagggtgaatggtgctattgattagcactaatactaattattagtacattatatataattacaatgagatatacacacacatacacacacacatatatacatatac

SEQ ID NO: 120128 - DNA, 3457 bp, Homo sapiens
cccctaataataactggaaaacatatttgggaatattaccctgccaggattaaaatttcagattagctttccttctttttttgtttgtcttaagaataggtgtccacactagatacttcaaggcctttttagctttatgattccataattgtcatttaaaactttgatttgggttataagaaaccttataacattttttaatgatccccttctttctcctcccattttcctttgctgtaagaaagacagaaaaacttaaagaacaaacaaaaacaaagactacaactttggggacatgcctcagcatttcccaacctatggatagaccattcactccatcttctcatctcatttctggttgcttcctaacggccccagtggcactgagcattctgcctgcagtaacctctgtccagtgcagttagggcctcatgtccccagccaatgactgaatgtccatcagcaatctagttctttgcccttttctcctatcccgtcttcattcctttgtcctccttcccttctcttttcccttcccctcttcctcccctgtgccatgcaggagggtcccccccagctgaccagaccctggtcatcaagacattccgcttcctgtcacagaaactctttatctccgtctcagttctctccagcctgggcattgtcctagctgttgtctgtctgtcctttaacatctacaactcacatgtccggtaagtttctcttctgacgttttccttgtctgcctctctgagatactgatcatgttcctggacaggatgagaataaaacctgtgtaactcccatggccatgtatcatggagtttttcattctgacttgttgagaatgaaaacagggaaaccagatataacccccactcctactccaaagtagctaacgggaggaaaaaagaaaagaagagaaaaaaacaacctttggggccaggtctcacagtcttggactctacataaatagcctgtattctagtgggggcctgtgcttgggaagccctctgcaactccatcttcagccccatgactgcattgctctgcctctcaaggctccactgtcttctccaatcctgtcttcctttagcccctggccctgaaattagggtcatgccattgcgtggtatttggagagctcagcctccctggagaagaggggtaattctctctccctctcaccctctccacctctgccctagttatatccagaactcacagcccaacctgaacaacctgactgctgtgggctgctcactggctttagctgctgtcttccccctggggctcgatggttaccacattgggaggaaccagtttcctttcgtctgccaggtgaggaggtggtgggcaaattccttacaggatgtgactctcccacccgtctcaggagcaccttccatgatttatgattctctgcccttcctcctcagctttccctgactcttgtccctgttctttccttctagcatcacccctctgttctctgtttggctctgtcccttctttctgtgtctgcaggccattttcattctgtagtttacttgtcagttccaaggttgccatggcaggccttgcagagaagaggagggagccattgaaggcaaaggaaggggatctgctcaaaggtctcctgaacaatggtggcttgtctgtggtatgggggctgagaatcagaactgtggactttttttgggagcctttgttgggtttggaaggatagaagcagagatggaaacacagcagagagttggggggaagggaccactgccacacagggaggaggggctctgggactgttggtacatggaaggttctagtgctgtggggagaggccagcttcaacagtgatagttgagtggttctcttttccactggtggaaacacccactctttctcctgatctgcctgcctgtccttgctctctctttttcctctgctctgtgctgtcctgatcatacatctgtgcacatggcatttccatgcacatgcacatgcagttcatcaggaatcctctgttcccagtgaggccagagtgcagctggagaagcagacaattagctgtagtgcaataggagaggttccagagtagggatctgcacaaagtgctttgggggcaaagaagggaacacagttcactgctggcgtgattgggtggacctcactgaagaggtggcatttgaatactgaaggacaaataggattttatcagctagagaaatagaggaaggctacttcaggggcatagggagcatcgtgtggctagaaaatacatgaaagagagtagatgaagagaaagtgagtagttcagcatggctggagcgtggggtaggtgtggggctgggagatgagcctagctggacaggtggatgggagcatgttgtgaagggtctgtgtcatatccagaagtgttcaggctataacttatagatattggggagtggttggaggtttttggccactaaagccaggaggttttagcaagatcaccctggtggtgtggaagtagagggtggatgggaggaattgttcaaggtggggagactgctctcctcctgccgctccccgtcctgctcacattttcgcatcctccctgtgccaccatgagctccctgcccgtgctccctgcccactctcccttagggttctgcccatccttactgcagtcccggctactactctaccctgttctgcctgtgccctctcttcctttctaggcccgcctctggctcctgggcctgggctttagtctgggctacggttccatgttcaccaagatttggtgggtccacacggtcttcacaaagaaggaagaaaagaaggagtggaggaaggtgagctgctgcccaatcctcagcccccagatccttggctcctggggcacagagcattttcccctgacgtgcctgttctccccacatatttatccagactctggaaccctggaagctgtatgccacagtgggcctgctggtgggcatggatgtcctcactctcgccatctggcagatcgtggaccctctgcaccggaccattgaggtaccactggagaggaggtgctatggtcaggagaatgagcagggctcagtggccatcagggccctggggctgtgtgtgtcttgagggatgaagctacttggagagagtgccttcctcgtattggaagctcttcctttccttcctagaaggagcccctcataggcctccagattcagctgaagaaaggaaggggtgggaatctgggaagggtgtgtagaacttccaggcatcagggaaagtggggaacaagcacctccaagggttcaggaaaacattcttaggcctagaatgagatttggcatcagcattgagggtctcataggaaaacagttggaagccagagactgagaagcgttgaggagaggaggggaggctggcaaccatctttcttgtgaccttgtttctgccctag

SEQ ID NO: 120129 - DNA, 1039 bp, Homo sapiens
ccaagcatccttagggcctcaggtgaaaataaaatcagatacaaccatgcaaagctctagggaagtgggaagttgaaaatgcctaggatcagctctttggctacctgtggtcactccttttattgtcgtctgcccaggtggcagctacaagaagattggctactatgacagcaccaaggatgatctttcctggtccaaaacagataaatggattggtgagtggatcttgtttgtattttccttcagcccctctcgacagtcaagggaaaaagtcatgcctttgagtgaggatggaatggtagagactgttaggttggaatgtggctggcagctgggccaggagaaagggttaagtgagagtgaatacaacccctaaggcgtgggtaggggagactggtgtatttggagagggaataggcggtggttagtactatttttaatggtgcattgctggggtaactggggattagaggcagggggtgggcagagggcgggaaatggaaactccatttgggtttcccagatgtcctggtgtcttgatatatttgaaccagctacttcaagcccagagctgtctctttgtctgtctctgtcaggaaaacggttgcttaaactatggaggaggagggaaaacctcatgtaattgtcatctgccaaaatgtgctttttatttttatatgtatttttaaaaattttcctatttttatgtaatttagaggtagacgtgcagttgtgttacatgaatatattgcatagtggtgaagtccgggcgtttagtgtgcctgtcacccgaacagtgcaccttgtacctaataggtagtattacatccctcaaaatatactttttaaagagagaaagcaagcagttattctttgtgtacttggtctaaatgataggacataggagagaaactgaaggtggacaaaaggaaggacctactgataaaagaaagcctccttgagaatgaaggggaggctcaaccattgaagatggctgccgtctgccctgcccagcagatatccagtcattcccagcact

SEQ ID NO: 120130 - DNA, 1036 bp, Homo sapiens
ccaaggcaggcagatcatgatcatggtcaggagtttgagaccagccagaccaacatggtgaaacctgtctctaccaaaaatacaaaaaaaaaaaaaaaaattagctgggtgtggtggcaggtgcctgtagtcccagctacttgggaggctgaggcaggagaatcacttgaacccaggaggcagaggttgcagtgagctgagatcacgccactgcactccagcctgggtgatagagtaagactctgtctcaaagaaaaaagaaaagaaaagagacatgcaaattaaaaacagctactctctttcccagtggcttccattaatttcaggaatttccccttgagtggcttgggttgagaggttgatgacctgtcagttagactcaagaaagctgaatctaggagaaccgctattttttttttaagggaatctgccaaatttccttgctgtgtaaagcttcaatgtgtatagcttggcttttgtagattgtattttcttgaaacttagcacacaggtatttgcagaacttctaggagttaatttttctgctccactcggctctcagtcttttacggcatggccaagagagctatttcttggcctcctgtgaaaagtttctttcttcctttctccccacctccacatcctttcagctcctctttgtatccaggacaagaggaaatggacttcagccatggtgaaaggagtgtgagttggcttttgaaggaaaagttatggtaacggaaacagttctagaacagaaatcttagaaatgaccaaattttactcaatggcgctttaagaggcagatataacttatccaaggaattaaaacccaagccaacagaagagaatgttctaaaattaaaatgaaagccactgggaaaatagagcctgcccatcatgagaggaagaataagcagaaatatgtgtaaagctttagaagccaaaatcaaagtgagagacatctcgccgagagaggtgtgaggaatggaataggtggcagacatgttgtggagcctcctcactgaagactttt

SEQ ID NO: 120131 - DNA, 1529 bp, Homo sapiens
agaaatatcctcctggctggcaagcagagtgagaagactgctatcaccttttctagaatcttttggaattgtaggagctgttagatcctgggttaactctatgaagaaagtcagaaggatcagagaacatcagtgtcacagctcttcattggaatatccatgtctcctcctttactctgctctaccttccatcctttgccactaattatccagagtgtttgtcaaaattctctgtttgcagttctgagctagcaactgtacacactaacaccatcagacacagctaatacctactctagtctagtagcttccgatctaaggcagacacatgggtatagttaaagattttgaatgtacatgtgtccaatctgacaacagtaacacaaaccatccattcaagtagaagtgattgagtcagaattggattgcaccccttcccccacacccacacacatttcagttctttcctcatgattttttcctcccaagacatcccaggaatttgtggagaaactaaccaagcgactgaaaagacaccctgaggagacaggaggcttccaggaggcaccgctggcctatgatgccatctgggccttggcactggccctgaacaagacatctggaggaggcggccgttctggtgtgcgcctggaggacttcaactacaacaaccagaccattaccgaccaaatctaccgggcaatgaactcttcgtcctttgagggtgtctctgtgagttaaaacttccttcatactcccctgtcttcccaatcttgagagagactcccaagaggcaccttctacaaacatgcattctctgtttttctcagttacttctttgcagaatcagtctccgaccagagaagtagggaccttcaaattagaagaacccatcaaagactagaggaaaaaaaatgatgtattccatttttttaaacccctcccctcatttcttttcaaactagaccaagtattcatgagtcagatgagaactataggattttgaaagacaaaacagtctgaaaggtcatcttcttattccttttaaaatgaaaagattagtttccagagagatttgctgacttgcttaggccacacaaccagaagcctgctggtgttctgtctggggattttttcccattcaaatctcataagtgaagctccttctccaaagaataatgtttctaaaatctagggtatgggcatctggggtatgtcctatatgcaggcaaatgccataaatagcattcattcagaggctcaattacatcaaaaacagaaggatttaaagagtccctgatgttctctttcactcttgcttttgtctcctttgccttgctccacatgttccttccctcagggccatgtggtgtttgatgccagcggctctcggatggcatggacgcttatcgagcagcttcagggttagtacaggggcaggaggggaccggacatgggggctaggctggggctgggctgggatgccccctggggaagaatgccagagacatcacaagattgccctggca

SEQ ID NO: 120132 - DNA, 3270 bp, Homo sapiens
tttctatgagactgaagcccggaaagttttttgtgaggtggagttggatctgaagagggaggggcactgggtgggagtttcccttggttttcttgtggggcctcctcttggcatctgtgcctgagttgatagcatatgatctgaggtgacgattcataggatgtctctgtctgttggctctgactgcatcccttgtctgcacacacatgatactttcttcagatctcatttttctactgctttgtgtttcctgagaagcccatgaattccatctgtcctgactggctggaaaaggccactcagaaatacaggggctggggagaaacttagaaggaagaattgtcagcctttcctactatccccaagacttgtagatttctctttttagttctactgctcttccctgattcccaagaggctaaatagtatcaagtgagataagacaaaaacaaacaaatgagcaaacaaaaactcagccattctcctctgtattcaggtgtacaaggagcgtctctttgggaagaagtacgtctggttcctcattgggtggtatgctgacaattggttcaagatctacgacccttctatcaactgcacagtggatgagatgactgaggcggtggagggccacatcacaactgagattgtcatgctgaatcctgccaatacccgcagcatttccaacatggtgagagtgtggggacttgcagtctggcacctgggagggtggagaggactgagggggccttgcaggggaaagggtggcagggagagggtgcggaatttggatataaaggagaagagggggctgtgcccaccctgaacttgtctgcattatgtttcctgtggatcctacctttgctctgacttccttgggtagagagagaaaaaaaaaaaaacgatggagttgtatgttcagtaggttcctgatgagtggaagggctgttaccatggagacgaggagcagttggtgagaagtcaggaggaaccggcattaatgataatatggatgcttgtatactcaagcacacctttacaggagcactgtgtctgggcagaattgcatttcattttcttggtgatttatgttagtgttttagagttgcttaatattcactcatgattgatatgcaattagcttggatcctgttgctttttttaatgattctttttttagaattttatgtggagaaggggcttttgaaatcatttagccccagacagctggttaatgacagacttggagcgaggaggcgcattctctgatttgagagggctggggcagccctgcagctgaggggcagaagtgagtgtgggtgtgggcacaggggaagaggcttctttgttgctcagcactacattgtaaagagtacaggaattttgggtaagctcgatacggccacctatgtgtctgcttattacaccaagtgtgtacctgctttggagagcatgttaggggtgagttaatggttgtaaagccccaaaatagcttgatttaaaaagttttactaacagtggcatttgtgtggtacttagattcatgatttcagggattctaacagcaaaactctgatgtggacttatctacattttgtagaccaggaaaatgagactcagagtggtttaatgacttgtctcaggtcatgcagctactcagcagtccagctggaattgaatcctagttaaatctggctccaaactgctctgctcatcacttcccatggaaaaccatgaagcctgactaaaaagtttgtacttttatctgctaacactgtttagctactggcaattgctgagcaaaggagaaataagatttaggaagttgactctggtggtgtgttgtgatgaaagatctgctgccacatggactctgatgatacacactgttttgggacattctaaatggactctatgttttaaggtatgttagttgaaaaatacaatgaaaaaattttggaagatcactttcctgtagagtacccaagaggtgagtcatccataaaacctgggaaagtattggaactggctaccaaagccagaaagacttgttggtgccctgagcccaggacttgccaatcgttgcttctgtcttatagcagggagctagaggaggctgacagaaaacagggatttggctggatctagtggctcacacctgtagtccccagcaccttgggaggccaaggcagaggatcactggagcccaggagttcaagaccagcctgggcaatatagtgagacccccagctctaaacaaaaagagagagagagagaacagagagatggttagggacatagagggacacctgagcattggggtgggaagacttggaaggtccctttctgactttgtgtctagagaaagatggttcctgcttttgaggccatagggcttccagtgggaccagcctaaaatgccagtggggaagccaatgttttctgaagaggatagagcagtcttaacaataggttaggggcaaaagagattatagattaatcaaacagcacaaatagaagtggatcaaagcaagggttggacctagggggccggagccatggagacttagaaaagaagcagagttgcttttattccctaaggatggccttatgtttagatcaatagttctcaaactttaacatccgtcagaaccacctggaaaggtagttagttcacaggttatcaggcccttcccctggaaattctgattcagtagatctgggctagggcctgagaactgacatttctagcaagtccctggggatgcagatgtactggtctggggatcacacctcgagaactattagttagggtagtggttttcaactactaccctagactcagacgctatactatctggaggcatttttggttgttacagttgggggtaggggatggggagggatacatgctcctgatatctaatgtgtagaagccaaagatgattctaaatatcctacaaagcacagcccctggcaacaaagaattatcttgctcaaaatgttaatagtgcagagaatgagaaaccctagtttagagaaaacatctttaggggcaatatgtggaaatggagagtgggttagagtggttttagagaaatgtagctgtgggctagaggggaatgtgggaggtggcatcctggagataagattgtgaggaaatcttgattggggtagagatcccatcagacctaggaccagtacaaactaaaaagctacctcaagatatacattttagcccactgtcaagcatccattcttgagagccagaca

SEQ ID NO: 120133 - DNA, 1018 bp, Homo sapiens
gaaaagagaagagggaggaaacaaatggaaggtggggagaaggggtttgcagaggtgaggaaggaattttcataatatggctttgagcaagctatctggggatgtggaaagagtttaccgtattcctactgacttcttccacccactggtgtttgaagcatagaaacatggggtaaagggcttggtgacagagggaagggggatgtctgagggtgagctgaaaggaggtaaggtggtatgttcattaataccaaaggaggggtgtgcaggagaggtgatgggtaaggctccagatggaagacagagaaggaagtttaatgaaagaggagaaaaaaggcacttgacaggaagagatgccagaaaggagaagaaaacggtaattaatgatgaaagtgagtaattgagaaaggaactaatttgttcgagaaagataagagcaggaattgcagacaggggaggggccccaggagagcttgccctcatctcctcttgtctttcagtgtgatccaggccaagccaccaagtacctatatgagctgctctacaacgaccctatcaagatcatccttatgcctggctgcagctctgtctccacgctggtggctgaggctgctaggatgtggaacctcattgtggtaagcagggctatgggggtcagaagatggggtcattcccttttgagctctactgaagggacgatggcgattgtgggtttgtattgaaaaggagtgtggaggacctgctactaagattcagagtcctctgcagacctgagctaggcagcctcctagcaacagtggcctgacagtgctgcagctgacctccttcttcagaaggaattgaaattagatcagtgaaagagcatcccggttgtgaggggtgtgtgggcctttgagaatctcttttccttaggcagaccagaggtggggaggtttggagagagtaaggaagagaaacccaaaggcaggaagagggttaaaggaactcttggccactcttggtgtcctcagtgaacaga

SEQ ID NO: 120134 - DNA, 5175 bp, Homo sapiens
aattactcccttttcttggtcccactttgctgtccagatgatcttattagcctccctttatcctcctatcctaattcaactcgaatatcctcatttagcctttttttttaaagaaaagctccacccacatatcatacccttcatgatttcttaattacttttctttcttacctccacccagcacccttccctccccacttgtgggttctctcatcagctttaaccctggccctttactctctgtcctttagccaggggatctgtacctgtccccactcccaccctctagtgccccatccctcttcctctgtccccagcctgcccacagaccacgccctactctccccttcctcccactggggagcctgccttttcctctttcccaccattcctctctgtatgcctccccgactcaccccttaggttgccagatcatacacccgccctgggaagggggcatcaggtaccggggcctgactcgggaccaggtgaaggctatcaacttcctgccagtggactatgagattgagtatgtgtgccggggggagcgcgaggtggtggggcccaaggtccgcaagtgcctggccaacggctcctggacagatatggacacacccagccgctgtggtgagtagcctcggaagcccctcccctcttcaagactattccttttcctgccgcaaacttagcattactgcttgcaagtcagcactttaaatccagtataccaaaattcacaaatacatttattgaatgactactacataagagcaattttgctctgtgcggttggaggtagtagagctagcagcctgcacagttcatttcatcctcccttcattaggccactgatcattggcctataacattgataattcatcttgtcagttattctctttgaggatcattagtggcagatgatgacaaaaaaattctaaaatgatttcatcacatttttgaatacctctgtcaccaacccagagaccatatgcccaagaaacaaaagccagtttaatattaatagaagccaactataataagaaaagcaaatctgattgtgcatccaaagttatatacatctacatatttcaaagccagagaaccgcccactgtagctgactttgaagagatcccattttgtgtgcttatagccccatcttgggttcctaaaatggtaattttttttttcttttgggaatgtgtggatgcttgcacaggtaagggaggattggaagataggtaggcaaatccttttcacatgtgattttctttagagcaggatgcttgtggacccaaacctgcacctgagtcccctgctctttaaagggaaagagccttcttcaactcgcctctcttcttattttcctatctctccacagtccgaatctgctccaagtcttatttgaccctggaaaatgggaaggttttcctgacgggtggggacctcccagctctggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacactggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagacaggtccttttctgtacttcctagacaacctccattattccctaagggaatcagtgttgtgtctgtctacttttttttttttttttttgccacgtaattttacaaactctcccttttctaggcacccgaactctctgccatcttctctcctgggatgcagtcatcccatttgtatgcctcatacttcctctaccctggtagattctttcaagatccttgggctttactttcctcacataactcagttattctgcttctagtttaccattttattctggaaattgagagtcccatccaggggtggacttatgacactactgaaacttagacttcaaggttcctcacctacagggccctcttcctgtgctctaataatatagagggctcgatggatatgtgttcatatggtaacaggcttttgtaaaaattgcagaaataagattttaacagcaattgcttaaagccaattgtatgtgtaattttttttcttaaagactcccaattttgtaatattcaggcaccacagaaccaagatctgccccaaacttagctattggcattcccgtctcaaattctgttgtcctatgaaaaatcgaagaagaaaataagtcctgacccccttacccccagacccaccttgttcttatccccaggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcaggtgagatgagaaacccttaccgcgcgcactgcaatgccctccccttcactctgcaccctccacccccctgaaattctgcccttaggctacggggcgtcgtcctttcgcaccttccccaacccaccccagtttgcggccacccccttccctccctacctgtttcctgcctccagtcccggttttccacgaggctgcggtctctccttgtccctgcttggctacacttccctgggctccacctcctcccagactgagcctcgccggtgtcaggcagagcccagcagagggcggcagggtgctgggagaccctgagctcccaccacgttttcccctgtggggttccttgcgaccttcgctggaaccttttccagcctgctgcctcctaggatttcacctaatggactttctcagcctgtcccacccatcccaaccctggccaggcctctcgcgctcttccccacatcttttccttccgtgtaccccttccctcgtcttttctcaattccatgtcctgtctccctttcttaggcttctgtctacccagccccaggctcccttccacgaccccaccactccctcaaaccagcctcccttccgtacccaactcgttccctccaaaaccgtttcctctcccccacatcctcagtgcttcactgtatcgactcatactcccacttcagacctcaggcgccagccccgtttctctcccgtcccactcgcatccttcccttcctaccctggttcctccgtgcttcagcctcccgcggctccctccgcccaccccgccctcctggcacgccccgtccccatttctcctcccctcgggtccccttaagtgagatccctcccttcctctttcgttcctttcctcctcgaggttgcatcccccctcccctccccgcccctccgactgtcgctcccacctcggcgctcgcttccctccccgcccccttcctgcctccccagctcccgcccgcccccccaccccccgctgccgcgcgccgcccgtgacgtcagagccccctcccagccccacatctccctcctgctcctcctcctcccctccgtcggtcagtcagtccgcgaggagagtccgcggtggcggcgacggtggcgagagccgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgccatggggcccggggccccttttgcccgggtggggtggccactgccgcttctggttgtgatggcggcaggggtggctccggtgtgggcctcccactccccccatctcccgcggcctcactcgcgggtccccccgcacccctcctcagaacggcgcgcagtgtacatcggggcactgtttcccatgagcgggggctggccagggggccaggcctgccagcccgcggtggagatggcgctggaggacgtgaatagccgcagggacatcctgccggactatgagctcaagctcatccaccacgacagcaaggtagccctggacatgggggtgggtgggaggtgggggcttgcggggcagggggccagccagctgcacgcgcccccatctgtctgagtcgtctctgggattgcgaggcagacccctcccttgtgtgactggcaggagatgggctgggggtgcaggagcttggggagagtcgcaggggctggaggtccaagatgagggtctaggggctcaagatggttaagcatgctgcaaggcagacccttctgccccgctgcgggagtctcgcagaagtgtcggggtttggagaaactggtggtggatttaaggtattaggagacactgatcctctgagggagtaaactaaccctggaatgggttgggggtggagggaatgtcagaggtggggagctggattgggggtttacatttaccatggtaacaaggtaaaatcttggcgtaggttggagctggaaggaatagggacagaatgaggaaaattttgagagacttgagagctctagtttatttatcttaacaaaacagcaaggtagtggtgagccctacctgactccttctcatccttctattcccaaccctgttgagcattcccagactgtgggatagatggcatatggtgattggggaaggctaatgatcaagag

SEQ ID NO: 120135 - DNA, 1099 bp, Homo sapiens
tatagaggagacacttgtaaaacatttgaataaaagttgaacaacaaatatgacgaaagaaaagtgtgcaggccccgcacagtggcttatgcctgtaatcccagcactttgggaggctgaggcaggtggatcacctgaggtcaggagttcgagaccagcctgaccaatattgtgaaaccctgtctctactaaaaatacaaaatttagccagccatggtggtgtgcacctgtagtctcagctactcgggaggctgagacaggagaatcgcttgaatccgggaggcggaagtcgccgtcagtcgagatcacgccattgcactccagcctgggtgacaagagtgaaactccgtccccccaccaaaaaaaagaaagaaaaaaaaagaaaagtgagggtggagggagggagagcacgacgtgcgcgcaccctctccccttgtccactgctgccgcctccttcttctgccgctcctggtgctgcttgtgtgctcgtttggagcggacctggtacctcttttgtgaagcggcagctgaggagactccggcgctcgccatggccgaagaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgattcgacgggcaaccaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttgcttccaccacatcctgactactaccgtatagttttctctattctttcatttcccccttccccattcctttactgtacataaagtaactggtatatgtgcacaagcatattactttttttttttaaaactaaacagccaatggtatgttttgattgacatcaagtggagacggggcggaaaaatac

SEQ ID NO: 120136 - DNA, 1108 bp, Homo sapiens
ttgcagggaggcggaggttgcagtgagccaagattgcaccactgcactccagcctgggcgacagagagtaagactgtctcaaaaaataaatgaataaataaaaaggaagaagaagaagaagaacaattgcaatcctccctggctctagaatgtcatttaaaagtcgagtgtcttcttccttccctgttttgaagcagcccttctcatgacaggcttgcttgccaaggttccctctgaccttaaatctcttccttttggtgtcttggacagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaaggtgagtagtgccatataatattaggtattaactgttgggtggccaagaacaattattctctcaactgagatgagatccctcaacccaaacatctcagtcctgggaatgatttccataaaaatgtacacatcaataaacagaaactcatgcttagggatgtctgttgcatcattattcagagtagcaaggaaattgggatcaaaatcaatgcctttgagtaggtaagtgacagaatgaacaatggtagccatactgtgaatattatgcaggcattaaaaagattattttagcactaggccagatggtttggaggccttctataaggtattattgagtgataagagcaagctgctgtaggatacaaaaacaaaaacaaaaccctagggcatggtggtttgcctcgcagctactcaggaggctgagacgggaggctggcttgagcccaggggtttgcagttacagtgagctatgattgcaccactgcactcca

SEQ ID NO: 120137 - DNA, 1232 bp, Homo sapiens
tacgtgtaaacgatctatttacctctgttttgccattcctgaaaagagagatcatgtgcataaggagttaaacagaataagataacatttttgtaaagtagttagaatagtgcctggcacataaaaacagtacatgagtatttttattatgattttaccaatcctaaatgcaaatgacttcttatttaaagaaagaaaagagaagagaggaagggactcaaccaggagccaggggtccttgttcccccaggtgactggaactagagtgaaataccaagttgacctgggagggcctagacatgccggaacttaccaaaagtccggtggagattctctgaaagagaaacaaatggaaatggatttagtagggcactcaaaaaggatcttttatcctgagtctttgttatttaattacttaaaacttgttctaggcacgacacacccactgtagagaaagggaaactgaggggaaaacagggtattgagagggagagacggtccaagaacgggaccatttccgttatgccaaaaaaccaaaaggcaagaattgggagaaacgatgactggaactcacctatctctgctcgaagttttcctaaaatagaaaaaggcaacattttagttcctgcatgttctggctctcggtggggaccctcccacacccagcgcctgggccccttgtgcaggctatttctctgcagcctggaaacaacctcaggagagtaggaagagcactggatttaaagccaatggttgcggctctttctctagctatagtctagatacaatagcgaataaagaatgtgagcaatgctccaagccagcacaagcatccaatacatcccagctgctcttcgccccttttcttggattctcagttcacagagctgctccagcccactgcgttgccactttgtttatctaaagccacttcccatctgaatgaggagggaggagctgaacatttagtgagtagctagctactttgtgactggatttgtagtaggcactttgcatgactttaatcctccctacaatttaggacgaaggatgttttctctatttgacagacaaggcaactgaagcttggagaatctaagaattttgctatagagttcagtacctgagatggaattcaaacccaggctgcctgactctaacattcagattctttctgctcagccatgagggctgaaggcctttttttgtgtggaagaagtaaacaagcaggc

SEQ ID NO: 120138 - DNA, 2347 bp, Homo sapiens
tcttcttcttcttcttcttttcttttcttcttcttcttcttccttcttcttcttcttctccttctcttctccttctccttcttctccttctccttcttcttcttctttttctttctttctttttttttttttgagacagagtttcactctagttgcccaggcaggagtgcagtggcaccatcttggctcactgcaacctccgcctcccgggttcgagtgattgtcctgcctcagtctccctagtagctgagattacaggcagatgccatgacgcccagctaatttttgtatttgtagtagagacagggtttcaccatgttggtcaggctggtttcgaactcctaacctcaggtgatccgctggcctcggcctcccaaagtgctgggattacaggtgtgagccaccatgccaagcctctgttggagttcttacagtgaattttgtgttattcttcctcattcactgtagaaggcaagaagaaagagcttcgagaacaacatcccagtctgagagatgaggggactagtgatgacaaggtcttccttgcatgcagaggggccggccagtgccccctatctgccccagctgggactatggacaggacccgggtgcttcaagcatcccaggctgggccaccctttttttgctacacctgtggcaaatgtttcagcaggcgctcctacctctatagccaccagtttgttcacaatcccaagctgactaacagctgcagtcagtgtgggaagttgtttcggagccccaagtccctcagctatcacagacgcatgcatcttggggagaggcccttctgttgcacgctctgtgacaagacctactgtgatgcttctggactaagtcgtcaccgccgcgtccatctgggttaccggccccattcatgctctgtgtgtgggaagagcttccgggaccagtctgagctcaaacgccaccagaagatacaccaaaaccaggagccagtggatggaaaccaggagtgtactttgaggattccaggcacccaggctgaattccagacacccatcgccagaagccagaggtccatccaggggcttttggatgtgaaccatgcaccagtggccaggtcccaggaacccatatttagaactgagggtcctatggcccagaaccaggcatctgtacttaagaaccaagcacctgtgaccaggacccaggcacccatcactggaaccctctgtcaggatgccagatccaactctcatccagtgaagccctcaagactcaatgtcttctgttgcccccattgttctttgacttttagcaagaaatcctatctctccagacaccagaaggcccacctcacagagccgcccaactactgcttccattgcagcaagtctttcagctcattttccaggctggtcagacaccagcagacccactggaagcagaagagctacctttgccctatctgtgacctctcctttggggagaaagagggccttatggatcactggaggggctataaaggcaaggacctgtgccagagcagccaccataaatgccgggtgatcctgggccagtggcttggcttctctcatgatgtccccactatggctggggaggaatggaagcatggaggtgatcaatctccccccaggatccatacccccaggagaagaggcctaagagagaaggcctgcaaaggagacaaaacaaaggaggcagtgagcatcttgaaacataaataaatggcctttctgactgagctctttctttgtgtttagttttcctgaggactgacctctggggtaatgaggctggagtagagggagacaggtgcgtggataaggaaggaaatacataaaagacaaggggttagaagtgtgcttatgaaaacttgtattattattttttatttatttatttatttatttatttatttatttatttatttatttttgagacagagtcttactctgtcactccggctagagtgcagtggcacgatctcagctcactgcaacctctgcctcctgggttcaagcgattctcctgcctcagcctccggagtagctggtattataggtgcccaccactatgctcagttaattgtttgtatttttagtagagatggggtttcaccatgttggccaggctggtcttgaactcctgacctcgtgattcgcccgcctcggcctcccaaagtgctgggattacaggcgtgagccaccgcacccggccaaaactcgtatctttattaattagcacctagcttgtttgtttgtgtctgaccatcaagtagtagttgttgaataaacagtggatactctgatagatatgaagataggagaaaaggatgagaggaagg

SEQ ID NO: 120139 - DNA, 1070 bp, Homo sapiens
gctacctctgcctcccgggctcaagcaattctcctgcctcagcctcctgagtagctgggattacaggcatgcgccaccatgcccagctaatttttgtgtttttagcagagaccaggtttcaccatattggtcaggctggtctcgaactcccgacctcgtgatctgcctgcctcagcctcccaaagtgctgggattacaggcgtgagccaccgcgtccggcctcctttcctttctatacttcacagttgctggccttgtgtctgtcttttaatatttctctcttccttccatggttttatctttctcttaggttttaattctctgaatcttgagactggatgttaatcttgtacacacacacacacacacacacatatatatttatataaacttcttgagtctctcctgttcttccagaagccagtcacctttgaggatgtggcagtgaatttcacccaggaagagtgggactgtctagatgccagccagagggtcctttaccaggatgttatgtcggaaacctttaagaatctaacatctgtgggtaagaggctgggcttccctcagcaagccccctgtcctaagggccctggaacatctggtttccctggacaggtagatcagcttacaattagtttcactgacccctggttctatgctttccaggtgtgaaagatctgagtcactaagctcagtggtaaagagaagaaatgatagcctgcatgaaggcaaagataacacttgtaacatgatgacagtgttctcaaaatatgcaaatttttccattcatcaaacaaatatttactaagtcactcctgagaaccaggtactttgctagcagctggccttttaatgtctcctttccgcatctacatgtcccaggttatggttcttaaacaaaggctacaggaggtagcctgttgtccccatcagatgtgaaggggccatacctgggaccaactcaactctttctcattcccacacatcagccagaatctttctgcataagccagagctaatcaccaagcttgagcaagaagaggaacagtggagagagtttgtccatctcc

SEQ ID NO: 120140 - DNA, 1594 bp, Homo sapiens
agtgcagtggcgcagtcttggctcatggcaacgtccacctccagggttcaagtgattctcctgcctcagcctcctgagttgctgggattacagatgtgtgccactatgcccagctattttctttttgtatttttagtagagacagggtttcaccatgttgaccaggctgatctcgaactcctgacctcagatgatctgcctacctcagcctcccaaaatgctgggattacaggtgtgagccactgtgcctgtcctccggaatttttcatttaatatttttgaaccatggttgaccatgggtaactgaagcattggaaagcaaaaccatgataaaggggaactactacatgtattgaaaatccagatcacagaattgtgtgtgtgtgtgtgtgtgtgtgtgtgtataattttggtcatggaagagatcttagagagtgtctcctttattctcacatttctgatgaaaccaagtcagaaagaataaagagactcactcgaggtgatctgtgacagatcctagcctggttaccccagctacatgatttccaatggtactgagtctaacattaacattaggtttaaacattaacttttgtagatcaagaatgtccacttgtccttggaaaattatttagcatctctgcattaggtccttaagacagggccagtaattgttacctcattgctgagagcatccagtggcacactgtaggggtttagtaactgctggcattccctgaccaaataaggaagctgtttcttaccctccctcttgctgatatgttttgtttttctctgacctcaggtttctagaagcagggtagaacagacggcagacacctagcccaggctggtgttgttactaaacaatggcagctggtgagccaagggtgaccagggccctgaactcggtggcccagctttgagggaagcaaaattgttctcaattgtggaagaggagaatttggacagcagaacaaaaaaggaagacagcctcttggagcagatacatttgtcacaggaagccacatcaaaccctggggcctttgctgggcctctccatctgcccagttactgggaggtagatagccccaggaaggaatccagtcaggcctgggcaccaggccaggagtggataaagctagaaagagacaccacagaagagaagatgtttgaacagctgaagccaatcgaacctgtacagaagacgctcccatgggtgggcgaggtagctgccaccctgcaggaagccatgaagagagattgctggagggaggcacgggtgaagaaggtgaggagactaagctagagagaggtggggtccaggtcctggactccaggagctctttcatacatactcctgcctgcaggtcaaatgaaatctcagattgttccagactgaacgacatccagaaaaaggagctgcaagacctttctccatctcccgcaccatcctggcatccttcatggagtacttcctgaaatttgttagagtggcagcattttttccttcgctttgctttcctgtttatattctgcatatctgcatatcctctttcctctcccccacatcttatctttctccctttctctt

SEQ ID NO: 120141 - DNA, 1858 bp, Homo sapiens
cctggcacgtgttgaaaaagtcggcatcccagaaggaagattctgggcggatgggcatcggggaaggtagtcccaaccaatgggaccgtttctgagcacataagcgcattcagtgggtgctaacaagcgcctgctttgccaggcgacagtgagcaaaaccggctttgttcccggccaccggaagcttcgaggctggggttccggatctgggcgcccaatgacaaactaagcgcggaggacagggccaggagcgcccaccagggcggcgatctggtgggtaggtgcagggcaatggctggaaagggtccccgaagccctgagcagagaccaaagggccgtgcgactgcaggaaggccattttgcttggctgacaggcggaaaactcacgtggctggagtagcagggttggtgacgacaagggtgaatcccactaagcattgcaactgtttgcggtgtgaggggtgagggggattctcatcattctcagaattgctgtggataaagggttttgggttggagagagactgggtgcactcaaaggactgaaagatggcgacgacacattccctcagaggatttacattctggaagggtggggacaggcccgggtacagataagcccgcaggcggcctccagctcttacagtcgaaagtctgatgagttatgcccagtctccttcctcctcccgccggcatgaggtttggggccctgtggatgaaggaagttcatgggaggcaaacgtgcctgggcaagcaacagccgcagagattcagtccccacgggggttagaatccacacttagggcctctgcctaccgcctccagcaaatgccatcttgaggactagcggcagcagtaggtcttctctgccagagaactggaaggccaggttcttgagggcactgttactaaggcgtttttttttgtttgtttgtttgtttgtttgtttttgagacggagtttcactctcatttccctggctggagtgcaatggcgcgatctccgctcaccgcaacctctgcctcccgggttcaagcgattctcctgcctcagcctccctagtagctacgattacaggcatgcgccaccacgccgggataattttgtatttttagtagagacgaggtccatgttggtcaggctggtctcaaactcctgacctcaggtgatccgcccgcctcggcctccccaagtgttgggattacaggctgagccaccgtgcccagccttattaaggctgttttgaagtgcagttggctggaaagtggaagaataatccaagatctgcatgcctcataaaaggagtgcgaatggttttgaaagacaggaaaggaaagggagagagaggaaagaaagagagaggaagaaaggaaggaaatcaaattcatatcccaggaatgcacctttcatgacaacattttggagatccaattaactctattcctcgagggcgtttttccttgctggtattttcagttctattaacacttctcaaaaagtgaaaggaaaaaatagtcaacagggttttttggtctttattcttttctttctatctctagtaagggagatgtgggtgagtggctgtcagcaggaaaaggtgagagttcagctatgtttgcatctgagcaggaaatttccaaggatgagcagggaactccagtgctgggctcattgtgagccctgaataagtgattgctcttgggttgttagcagtattcttcacaaagatctgtatatacagtggttccccttatccacaggtgatatgttccaagagctctagtggatactttgtttttgttgttgtttgaggcagaatctcgctctgtcacccaggctggagtacagtggcacagtc

SEQ ID NO: 120142 - DNA, 1026 bp, Homo sapiens
ttggtcaggctggtctcaaaccccccacctcaggtaatccatctgcctcggcctcccaaagtgctgggattacaagtgtgagccaccgtgcctggccaatattttagattttaaaaggatatttttataactagtgctcaggaaagaaaaagaaagtggaagtaaaaattatctacttttcgggcggcttaccttcactccctcattgacagccagcctccacaccagccatatctgtccagtttagactgcagcccagtcctctcccaggctgctcaatcagaatccaagagagcagaacatcggcacttgtgtgtggtcagcgggctgagaacagaagaccggactcttttggcctcctcctcaggttgagacctccccattgtcacctttggctttcagcaactggacaggacaacgtacccaagggggcgccccagtcccgtgttaggctcggaatctgaagtgtttcccaaatccacgctgacatagatgtttcctctccacctagtgaccgtggattctgacctcgggacagagcgaggtttccaggccaaaacaagtggttcccaggttacaagtggaccccacaaacatactgtcacttctgctgctgcttccagggataaatgtggcttatcctggggaccaacccctactctccatccctaggatgggggagaggaagggaaattctcagggcattggcctagggagttggagaagctgctggtgaagtgaaaacaggagcagaatagggacattagagataaaggggcatagaaaggaatcagctctgatgacacctgtgtaggataaatgggttctgcttggggagaggctcacaggtttctaactgggatggtgtttttaacatggatgataattatagctgtgtcagttttacaagcgatcagaaaactacacttaaattttaggcaatttttgtgcttacagagatagtataatgcgcttacacacgaagaaagggaagaagacaaggggagaagaagtgattataggaat

SEQ ID NO: 120143 - DNA, 1033 bp, Homo sapiens
ctctcacggcttgaaaggtgagaccttggggggcctgatgtgtgggggatgttgggggggaacagtggacacagctgtgctatggggttctttgaatttgatgttttgagcatgcgatgggctgccaaagtgtcatccattactgggacagatatgaatttgttcatgaatattttttctatagtgtgagacagctgccttgtgtgggactgagaggcaagagttgttcctgccttccctttgtgacttgaagaaccctgactttctttctacaaaggcacctgaatgtgtctgtgttcctgtaggcataatgtgtggaggaggggagaccaacccaccctcatgtccaccatgaccctcttccccacgctgatctgtgttccctccccaatcatctttcctgttccagagaggaggggctgagatgtctccatctttttctcaactttatgtgcactgagctgtaacttcttacttccctcttaaaattagaatctgagtaaacatttactttttcaaattcttgccatgagaggttgatgacttaattaaaggagaagattcctaaaatttgagagacaaaataaatggaacacatgagaaccttccagagtccatgtgtttcttgtgctgatttgttgcaggggaggagaatagatggggctgtgcctagtgggtgctcaggccagtatggactttatgtggtcactgctcagctgggtcatctttgctccttcattctccttggcccttcagtagaaccttgtcctaccaccacctgtgatcacagggacttggatgtcacctacggtggtccctgcatacaaatctcattgtggtatcaagagactaattttcagacctgtccagctcttgccctcctcccagggctctttcctggattgtatttttcatcttgcctccaatctttttaaaggaagcagattctaaaatttgcagagaggaggggtcccatagtttctcatcatagtgaactttttgttggagctcctcttctgctctcttactcttc

SEQ ID NO: 120144 - DNA, 1040 bp, Homo sapiens
gagcctctccacgcacgtgccctccaggtaggccctgatctgctctgcaaattcttctgcctcccacttgcgcttggtgatctgagccgccatgtccgccgcggtccaggagcgcaggtcctagttccgggctatgtaatccttgccatcgttggcgtgctgttcatacccgcggaggaggcgcccttccagccccaagtcgcagccatacattatctggagggtgttagaccctggccccgcccccgcggtcagccccgcccaccgagccccgcccccgccccgaccaacccgcggggattttggcctaaacggaaaatgaaacctggtaaaggcgcctgggcctctcccgggtcgaggatctggcgggtcccgcagcctcggggtggatcttggagccggagactcgcgggggggacccgggacgtccgtgggggatgaggaggggtcgtgaccttcgccccaggccggggtcattcaccggcctagctctggtggtagtagcggcgcggcatgggcaggttcactcttgtcagtctgtgcgcgggcctgatgttccgtgtgctccggtcccaatactccggtccctcctgctccaaccacggcgactgcggctacatcctcggagtcgccgcgtcgctgtcgaaccgcacgaactgcgtgtcgtccacgtagcccactgcgatgtaccggggctccccgcgacccggccgggacacggcggtgctgaaataccttatggagtgggtacctgggggcgaggaggggctgagacccgtccgaccctcctccttgcgctgctccccgggtcctgcgccccagtgcgcgggcccctacctcctccccgcagaggccatttccctccggatcccgcactcacccgcccaggtctcggtcagggccagggcccccaagagcagcaggaggagggttcgggacgccatgaccccatcctcggcgtctggggagaatctgagtcccaatgggttcgcggggacttctggaacagggaccccagcgacgccgattggcttcgctag

SEQ ID NO: 120145 - DNA, 3575 bp, Homo sapiens
gtcccggccgggtcgcggggagccccggtacatcgcagtgggctacgtggacgacacgcagttcgtgcggttcgacagcgacgcggcgactccgaggatgtagccgcagtcgccgtggttggagcaggagggaccggagtattgggaccggagcacacggaacatcaggcccgcgcacagactgacaagagtgaacctgcccatgccgcgccgctactaccaccagagctaggccggtgaatgaccccggcctggggcgaaggtcacgacccctcctcatcccccacggacgtcccgggtcccccccgcgagtctccggctccaagatccaccccgaggctgcgggacccgccagatcctcgacccgggagaggcccaggcgcctttaccaggtttcattttccgtttaggccaaaatccccgcgggttggtcggggcgggggcggggctcggtgggcggggctgaccgcgggggcggggccagggtctaacaccctccagataatgtatggctgcgacttggggctggaagggcgcctcctccgcgggtatgaacagcacgccaacgatggcaaggattacatagcccggaactaggacctgcgctcctggaccgcggcggacatggcggctcagatcaccaagcgcaagtgggaggcagaagaatttgcagagcagatcagggcctacctggagggcacgtgcgtggagaggctcgcagacacctggagaacgggaaggagacgctgcagctcacgggtaccagggaacacaagacgcctccctgatcgcctgtagatctcctgggctggcttcccacaaagagagaaggaaaatgggaccaacactagaatgtcgtcctctctctggtcctgagggagaggaatcctcctgggtttccagatcctgtacaagagagtgactctgagggtctgccctgctctctgatacaattaagggatgaaatctctgaggaaatgaagggaagacaatccctggaatactgatgaggggttccctttgacaccagcagcagccttgggccccgttacttttcccctcaggccttgttctctgctttacactcaatgtgtgtgggggtctgagtccagctcttctgagtccctcagcctccactcaggtcaggaccagaagtcactgttccctcctcagggactggaattttccacggaattcggagattatcccagatacctgtgtccaggttggtgtctgggttctgtgctcccttccccaccccaggtgtcctgtccattctcaggatggccacatgcgtgctgctggagtgtctcatgagagatgcaaagtgcctgaattttctgacacttcctgttagacctctcccccagacacatatgatccaccattccgtctctgactataaggccaccctgaggtgctgggccctgggcttctaccctgtggagatcacactggcctggcagcaggatggagaggaccagactcgggacatggagcttctagagaccaggcctgcaggggatggaaccttccagaagtgggcagctgtggtggtgccttctggagaggaacagagatacccgtgccatgtgcagcatgaggggttgcccaagcccctcaccctgagatggggtaaggcaggagatgagtggagggggggtcatgtctcttaggaaagcaggagcctctctggagaacttcagcagggtcggtgctgggggctgagggtcagggacgctcaccttccccttttttcccagagcagtcttctcagcccaccatccccatcgtgggtatcgttgctggcctggttctccttggagctgtagtcactggagctgtggtttctgctgtgatgtgcaggaagaagaactcaggtaaggaatggatgaggagtggggtctgagatttcttgtcccactgagggtttcaagccccagttagaagtgtgtcctgcctggttactgggaagcaccatccacactcatgggcctacccagcctgggccctgtgtgccagcacttactcttttgtaaagcacctgtgacaatgaaggacagatttatcaccttgatgattatgatgatggggacctgatcccagcagtcacaagtcacaggggaaggtccctgctgaggacagacctcaggagggcagttggtccaggacccacacctgctttcctcatgtttcctgatcctgtcctagatcagcagttacactttcaggaaacttctctgggatcaaaggctagggggtttgtttagggccgtatggccctgactcctttctggcctctcataggacattttcttcccacagatagagtgagctactctgaagctgcaagtaagtatgaagtgggctgatccctgatccttgggatattgtggtcgggagcccatgggggagctcacccaaccccagattcctcctctagccgcatctcctctgggctctgaccaagtcctgtttttgttctaccccaggcagcgaccatgcgcagggttctgatgtgtctctcacggcttgtaaaggtgagacactgggggacctgatgtgggggggtgttgggggcaatagtggacgcagctgtgctatggggtttctttgaattggatgtattgagcatgtgatgggctgtttaaagtgtcacccctcactgtgacggatatgaatttgttcatgaatattttattttatagtgtgagacagctgccttgtgtgggactgagaggcaagatttgttcacgccttccctttgtgacttcaaaaaccctgactctctttctgcaaaggcacctgaatgtgcctgtgttcctgtaggcataatatgaggaggtggggagaccaacccacccccatgtccaccatgaccctcttccctcatgctgacctgtgttccgtctccaataattaatcattcctgctccatagaggtgaggctgagatgtctccatctctgtctcaactttatgtgcactgagctgtaacttcttacttccctattaaaattagaatctgagtataaatttactttttcaaattcttgccatgagaggttgatgggttaattaaaggagaagattcctaaaatttgagagacaaaataaatggaagacatgagaaccttccagagtccacatgtttcttatgctgatttgttgcatgagaggagagtagatggggctgtgcccagtgggtgctcaggccaccgtgcgctttatgtggtcactgctcagctgggtcatctttgctgctctgttgtccttggctgtatgatccgtccctacggggcttagcgggttttctccccgtgtgcggagatgagagattgtaataaataaaagcacaagacaaagagataaagagaaaacagctgggcccgggggaccactgccatcaagatgcggagaccggtagtggccccgaacagctgggctcgctgatatttattgcatacaagacaaagggcagggtaaggaaggtgaatcttctaaatgattgacaaggtgaagcaagtcacgtgattacaggatagggggcccttcccttttaggtagcatatgtca

SEQ ID NO: 120146 - DNA, 1041 bp, Homo sapiens
aaaaacaaaaacaacaacaacaaaaatctacacctccattcccagatcaagcttactctctggcaccaaactccatggggtgatttttcttctagaagagtccaggtggacaggtaaggagtgggagtcagggagtccagttcagggacagagataatgggatgaaaagtgaaaggagagggacggggcccatgccgagggtttctcccttgtttctcagacagctcctgggccaagactcagggagacattgagacagagcgcttcgcacaggagcagaggggtcagggcgaagtcccagggccccaggcgtggctctcagagtctcaggccccgaaggcggtgtatggattggggagtcccagccttggggattccccaactccgcagtttcttttctccctctcccaacctacgtagggtccttcatcctggatactcacgacgcggacccagttctcactcccattgggtgtcgggtttccagagaagccaatcagtgtcgtcgcggtcgctgttctaaagcccgcacgcacccaccgggactcagattctccccagacgccgaggatggccgtcatggcgccccgaaccctcctcctgctactctcgggggccctggccctgacccagacctgggcgggtgagtgcggggtcgggagggaaaccgcctctgcggggagaagcaaggggccctcctggcgggggcgcaggaccgggggagccgcgccgggacgagggtcgggcaggtctcagccactgctcgcccccaggctcccactccatgaggtatttcttcacatccgtgtcccggcccggccgcggggagccccgcttcatcgccgtgggctacgtggacgacacgcagttcgtgcggttcgacagcgacgccgcgagccagaggatggagccgcgggcgccgtggatagagcaggaggggccggagtattgggaccaggagacacggaatgtgaaggcccagtcacagactgaccgagtggacctggggaccctgcgcggctactacaaccagagcgaggc

SEQ ID NO: 120147 - DNA, 1030 bp, Homo sapiens
gggcgtctcctccgcgggtatgagcagtatgcctacgacggcaaggattacatcgccctgaacgaggacctgcgctcctggaccgccgcggataccgcggctcagattacccagcgcaagtatgaggcggccaatgtggctgagcaaaggagagcctacctggagggcacctgcatggagtggctccgcagacacctggagaacgggaaggagacgctgcagcgcgcgggtaccaggggccatggggagcctgctcgatctcctgtagatctcccgggctggcctcgcacaaggaggggaagaaaatggaaccaccaccagaatatcgccctccctcctgtcctgacggagaggaatcctcctgggtttccagatcctgtatcagagattgactctgagggcccaccctgctcttcctgggacaattaagggatgaagtctctgagggagtggaggggaagacaatccctggaagactgatccgcggtcccctttcaccccacagcaaccttgggcaccaggacttttcctcccgggccttgttctctgcctcacactcaatgtgtcggagtctgactccagctcctctgagtcccttggcctccactcagatcaggaccagaagtccctgctaccctgctcagagactagaactttccaaggaataggagattatcccaggcgcctgtgtccaggctggtgtctgggctctgtgctcccttccccaccccaggtgtcctattcatcaggatggtcacatgggcgctgctggggtgtcccatgaggaatgcaaagtgcctgagttttccgactcttcctttcagaccccccccaagacacacgtgacccacccccctctctgaacatgaggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctgg

SEQ ID NO: 120148 - DNA, 1110 bp, Homo sapiens
gccccgccgcgggcgcagagctggcgctctagcccacggagttggttaactcctctcaccggcccctggaaagggttccaagtcctttagtacccgacgctgtctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgcatgtctgtcatggacctcgccaatacttgctccagctttcagtcggacctggatttctgttcagattgcggctcggtcctgcctctgcccggggctcaggatacggtcacctgtattcgctgtggcttcaacatcaacgttcggggtgagaggcttgtacgcaggggtcctggcggagggcgcagggtcggaagcttggggaactcaagatcggttgggttgaggaggggatcctagagcaggacatcaggcggttgtacatttggtctagcgatgaaaactgagggaaaggatgtagggcctcctggcctaaccagccaggggaaaggggaggtttccggtgtcagctctctctggttgtctccataaccagttcttacttgcctgtgcagactttgaggggaaggttgtgaagacttcggttgtgttccaccaactggggacagccatgcctatgtcggtggaggaagggcctgagtgccagggacctgtggtaagctaatgagatcaagaactggctccataaggtgggtaggaaagaaatggaggagtgattgcaaagctctggagagttttgtgcccaattccaagagggaaaagagatgtaaaccatcgacgtttgagaggcgtgatcgcctgattcctgtgggaagtaaggggatatgaccaggcctccctaacccaccagtttcttcccaggttgacaggcgctgccctcgatgtggtcatgaaggaatggcataccacaccagacagatgcgttcagccgatgaagggcaaactgtcttctacacctgtaccaactgcaagtgagtattctttcccctccctctg

SEQ ID NO: 120149 - DNA, 1060 bp, Homo sapiens
tttaagacctcatttttgtctttggtgttctgcagtcactatagtatatcaaaatacgattttcttttattctgtttgggatttgttggactttctgaaactgagagtggacttttttttcatcaaccttggaaaattatcagccatcatctcttttaatattctctttcccccatgttctcagtcctcacattctggacctcgaattagttactagaaagaggtttctctcttctgtcctccatttctctcaccttcttttcatattttcaattgctgttctctttatgccaccttctgagtaatttcttcaggtccctcttccatgtcactaattctgtcttcagtttatttcaagtattattattttttactattgttattattttgagttctatttaattacttttcaaatctccttaatttttaaataattatcagttctttaatcatattttaaattgttccttttattattctttaaatatatatttaaaatattaaatatggttattatattctatgtcttataattctgatatctgcggattttgtgtgtctgatgctgctgtcttttgtttctgctgtctctctcatagtgctttttttctttgttttgtgatttttgactataaattcgagttttttagaacttgaactgtaggaattctttgaggccttgggcgagtgctgtattctcagcatttgtgtttcttttctaggtgccttgaagcactatcaagctggaattactttaaataaattcttggcttcatgttttttggagcagacagatagtatgaatttgagctgcaaatccatgtaagggctagcttacagttagaaattctcaggagagagttttctctctttctacctactgagacagtcaaattccccttctatagagttgaattttttcttttcttgttcacttttacaagaaagggcagccttttgcagttcccaaatttatgcacgggatctcctatcagaccttatacattttgtccctcatttcctatgcttccagtgactgtcaaaacagtataaagggcac

SEQ ID NO: 120150 - DNA, 1068 bp, Homo sapiens
aaaaaaattttttttaaataaaaagaagattttttttcccagcgtgtggcttgcctattttcttaaccctctttaaatgagcagaagttttaagtttttataaggttcagcttatccttttttttttcttttacagctagtgctttctgtgtcctaagaaatctttgctttgaggttataactcattggatatatttttaatcccagaatttttagttgtcttggaattagaattggaagtttgtttaggggagccagtcctcaatgatgtcataaataaaagtccttccttgattatttgattgcatatcttatcttatactactagaaactcatcttttggtgaatataacaagtcctttctttcctcataggttccaggagaaggaagactcttgacctttttcctgggcaactctacagtccctccctcctttcggaaggtgaaggatactgggtttttagatgccttgtccatcctgtctggttgcaatgttttgctcccagaagagaatcagatcatcatgtggggattaccattgttcctggagtactcctacccttagttgaatttccttattaaagttatatttttctataagaccctgacatatgtatgttacttataatctgtcttattccaaaaggaatttaaatgagtttccagagatatatttatatgaaaaagaaaagggggaaaaattaggacaaaaaagtagagtcaggaatgaggctaatataaacaaaaagcaattgtaagtattgccatactatttaaatctatttggttcctgagtttaggttaagaaaaactaggaatttggatagtgagacatttaacagaaattttaaccagatctctttagcatataaatttggacaacaaaaaatctgatactaagtaatgccactaagtgatcactataggtgagtattttattagtattgagataaatacaatacacagttgacccttgaacaacacaggtttgaactgcttgagtctacatatatgtggattttcttctacttctgagacccataagatagcagcacatttaagccctc

SEQ ID NO: 120151 - DNA, 1027 bp, Homo sapiens
gggagggagtgggaaaggttagtaagaggggactagataggtatgctcatccttaaccttctaggagaaccggagccttaccatcaaacttcggaaacggaagccagagaaaaaggtagaatggacaagtgacactgtggacaatgaacacatgggccgccgctcatccaaatgtgagtaattgttggcccgcagtagccctggagttctggctcccttcagcatatcttgtatctactcatatccactggctttccagaagcccccagatgttcatagttctgtcacttttttggtggtgctgtggtatcagggaaagaggtagggaagggctagaactggaattgcctaggtctgacagcaagaagtgtcagaggtgggagaagtggggctttgaattcgtggctctctaagaggacaagaggggtggggcctgagtcccagagggtgggcctggggaagctggatcctggaaggtaggagaaaataggaattttcactgagtttgagtgggaatggaactgactatatatcttacccttcctcctctttaactgggctcctccctctaaatctaggctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgacccccaccacccctccccagcctcctgacccttcccagccccctccagggccaatgcagcactaaatccctctctcctccagcattcctgtgtctgtctggccctaaatgtatccatgtggctacttctccagccccctccttccctctcttctgcctgatagagggaagaggaagaggaggacgaacagagatcctgaaattctgacttgctgctattccagaacccagcctcctgggtttccccagtcctcatttttcctcccaatacccacccttctctctcgagggatctaggcaccttggtcccag

SEQ ID NO: 120152 - DNA, 1068 bp, Homo sapiens
aaaaaggctgtgagcatagaaagcagtcataggaggttggggaactagcttgtccctccccacccccagatcctgcaaaagaggtacaaagcttcccagagggccacagggcccagaccagagtcaagcctcttgttttaggagaaacctcagtggacaggcagggtagcccagtccttagatctgtggggaaggccctgagcccttctggagctaggagtggcaagagtgggagtcaagtatttgaccagcagagcctctatgtaggaatcatggtcactttaccaatactgatggggagggcctgttccccattgcaggcctagaatggtttgaatgggagaagtcaggaagtactgtagtagctgtaggggagagaagattctgagagccagaaggcaggaatggatttggttttgagcagggacgtggaaacgtggagaccaggtgaggtctcattattttggggcgaaaatgtgggttgctattaatactcctgcaatgggcgtgtgaatgtgttcccagaaatgagtggggaattccacccccaaaaagcagctgcagggccagtggccgggccaaacttctagttggagacgagactcagctttccgctggtacaatgcggagcggagcacgagggtcgcaggtgcagaacagcgggaagatgcgctcccccagggggccaggcgcctggaaggcgtaaagcaggtcgagtgagcggccgtcgtagaaggccacgcggccccgctcccagtccaggtccacgcgaatgcgccgcggcgggggctcaacaccgcccagcagggtgggttcgggtgccgtgagggcccacaggcggccgccgcggccctccacggcccacacggcccccgcagggcacagccttacgcagcccttgcgttgcactgattccccggccgcgcccactgcatagtggctctcctcgtcgtccgcatcctccccagaagagtctctgcaggaggcggcgtccgcagtctccacctcccagcagtggcggccggccccgaagccctgcgcacccagcacagctgggagctgatcgaa

SEQ ID NO: 120153 - DNA, 2649 bp, Homo sapiens
tttataaagcagtttagttatggtgatttagcagaatacaaagccagaaaatgtgtcacacttataccaaattaaggatgttgagttatattactaatgtatgcaactttaattttgtttaacgctatctgccaaaataaattttattccctctgacttaaaaaacaaaacaaaacagtgatgctgtttttttttttttcccttgtccccacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacagcctggagatctgtatttgtaggtctatatctatattatatctcaaatgccaccagacctcagtctggctacagagaaattccactgatagcagtagccgaaggttttccttctgtgccttctgtaacagtgtaactttgctttctgttctctgcacacatgctgtcatttctggaagtccctcaaaaagagcctactgcggaacacagacgagttgttgcgtggctccacctttttattcctcctgcagtggtgcccttgagctgaggtccagcgttttggagcaagtgatgactctccctgagaagggagacctccagtatagcaca

SEQ ID NO: 120154 - DNA, 1525 bp, Homo sapiens
cagaaatgtgctaccagtctctgggcacttgcttcatagcggggggttgggatgtgcctctgacttcttgtcttattcctctggagtaaagctcacaactcttcccaaacttttggaagcagtcatcagcagccacaatttgttaattccatttgtttcccaaatctcaccctctccaggaagccagcctgcaccccaccggcccctgctcccatcccccttcactctgctctcttttcccgtggtgcgtatcactcacgtagtatgatgtatttgctacattgattattgtctgcttccccctgctagaatgtcagctctacagaagtagggatttgtctctctctctctttttttttttttttttttaactgttctgaggcttctagatgagtgcctggtacctaggaagcacttaataaatatttgtggaatgagtgaaaggaaggcaaaaatcaattaatacagggtattaaggaggcttttgactcacaaaagggaatctgagcatgtcagaatagccctcttcccactcaccctgccctaccacctgtctgtcacagagatagcaccaccattctcccccctgtacaaaccatgctctgttcttgtttatccttgaccagtatgtccagttgaatctgtctctaaaatacctggaatgtattgcttctctctttttctccctactgccaccaccttagttcaggccatctttagctctcccctggtccacggcaaaagcctccggaccaacctccccatgttcctcttgcctccttagtcccttctctgtggggcagccaagtgagtggtcacttagggttttggctcactgctgtacagtgacgcaaacagaatagaagtttatttctgcctcagttaacagttcagaggtgcagggtctagagctatcacagtagctgtacataagcttatccaagggactgggttacttccatgtggttcttccaccagcttctagggatgttgtcctctgctgcgtggtcaaagttgggctcaccaccaccatgtccaaaattcagttggggtaaaaaggaagtagaaagcaattttctttttttaaaggacaatgcccagaattatggtcattgctttctatcacattccattggctggaacttagtctcatgaccagaccttgtcgtaggggatctggaaaatgtagtcttcccaggtggccgcctgaccagcaataactccgggggttctattattaaaaggaggaaggggagagtggactctggaggttacacagcagtctcagccacatgtagagcggatcacacatatcatgcccctacttgaaacccttggtgggtttccactgtacgtggagcaaaagtgaaactccttaccatgcatatccagccctgcgcagtctggcctctgccgttctcaccaagccctttcctgttttaccttacctctcttcatccggccagtacttcttatccgtcaattctctgcgcaggtatctcccagagaggttgcccatgtcatc

SEQ ID NO: 120155 - DNA, 1083 bp, Homo sapiens
atctgaaacatggagatgataatccttactgctgccaattagtctgtagattgcatgagcataaaatgaaataactggcatgctgtcacttcaaaaaataaactttttacacaaaactgttcaaaaaactaaatggtatagtagaaaatggaagggaagattattaatatcatttaccatcctccatcctcatcactgccatcacaagccctcttaacaagtcattggcagacacttagcagctggtggaagctttttatggtgttgtggttgggggtggctgagggagggctgaccagcagctcctctcaaagacccagaggatctggaagagatagggtaactggggaagggagacagagatggccaggttttctttggcccatgggattaccacacagagaacaagatggaaagcagacaagggggcctcggggcacctcctagaggagggggctttgatagtgagaaagggagggtttggggctgaagaactggctgtgaagctgaaatggcaccacatctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagactgcagaaggaggcggccacctgctcctcattgttgtgaattcagatgtacagaatgaggactggcagggattttagaccttccagttcagcccctactgatgaagtcactgaggtccagagagtgggaggagtttgtcccaggccatggggtgggtgtcaggtcacagcttgagcccagatgtcctgactcctgggctctgagctcttgttcttattttgtccagaatgtctctctggccccctcttttcctccagatgtcattctgttctctcaga

SEQ ID NO: 120156 - DNA, 1741 bp, Homo sapiens
gtgaaggagcactgtgtccacagtagacattgtagatttatatgtgtatcattatgagtttcccagcaggtagtgagagattttttattacagttggtgcattacagcgattttccaacagatagaaggaaagggtgttgaggctctcccaacagcaaggtataggctagtggctgtcctgctcttcactctaccaagctaatctttctgggtttccatatccttatctgtacaatgaggaagttggactagatctataaggtcctcttctcgttgacattgtgtgaaccttgtaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggtaagccctcttcacccccgagggtgccttgccaccttctctggatgctccaccttgcagtcctcagaggactcagcctgagtctcccttcctgccccagcccagagcatccacctgttgccactgcttgtttttccacaggaaaaaatcctgaaccacctgagtaccctaaggagggacagagacaaaattcagggcttccaggcaaagggagaagctgatatcctggccgcgctggtaagtgaggctgtttcaggaagccctgaggcggtgcgcccgtgtagggcagggtgagcctgggcaagtaggcggcagctgggaggtgtttctaggcgctgctcacagggaggatgggtgtcagcctggcagtagcagacctgggttttagcccaagtgctgtctttctgagccgtgtagtcttgggcctgtttcttgtctgagagacaagtgggctgcctggatgtcagctagagtcccttccgttttctgtgactgtcaccttgaaggcagggcccatgtccagctgctggttctcttctgccaggggactgaagaaggtgtggcttcattcttcctttcaaagagagagagagagacaaggttgcctgagagtggagagggtttagaaggagggagctggctccagggtaagaactgagagggaagggctagaaaacagctaaggcaggtctgccaattctgatggcactgtatgtagtgaggtccaggcccaggatcatggttgccagtacagtgggacctcctccatatctgtgggttccgtagcggcgaatttacccaaccatggatcagaaatattcagaaaaaagaaaaagcgtctctact

SEQ ID NO: 120157 - DNA, 1020 bp, Homo sapiens
aagaggcatgataaagggcttgaaagcccacagacacgcccagtaccactcctttttcctctttccaaacacttgcagtatgttacaactgaaaaactgctgagccaggcttatttcctcaacagtaaagccaaggagttggaccaggcaattcctagcatttctttctttttttttttttgagatggagtctcactctgtcacccaggctggagtgcaatggcacgatctcggctcactgcaacctctgcctcccgggttgaggtgattgattctcctgcctcagcctcctgagtagctgggactacaggtgcatgctaccacacctggataatttttgtatttttagtagagatggggtttcaccgtgttagccaggatggtctcaatctcctgacattgtgattcacctgcctcggcctcccaaagtgttgggattacaggtgtgagccaccgtgcccggccaattcctagcatttctaccagcattactaacatgtaggaacttgatattactttcacttgacagttaaattccttgaatccttcatttgagctttgaaggtgcttgattttcccctcattatgtctcttaaagtcacacatacctagatccattagtgcttccagttggaatttattatcagcactataagaatctcttatatttatgtagtccttttacgttataaaacactttttatgtattattgtactagaccctcaatgagtggacgttatatccctgttttgtttactcttgggtcttatagactgggggttttatttctgtcccattaatgtcactactgacagaggccactgaactctgttgtgatggactttcaccatacataatcattaatagtattgatttgcctgtaattcaggttgcttcattccagcctcgcagtcacctctgtgccctgctggttgtcttcccagcgctgctgtagttgccttccatggatctataggagagcaagtcctccaggtactgccctgtgacgatgttgttga

SEQ ID NO: 120158 - DNA, 1049 bp, Homo sapiens
tttacctcttattgtggaaacctgttgagatcacagagaatatactgacggcataaaagggcagaaccatagcagggtgcggtaagttggggaagagtttttggagagggtgaattttgcattggacctgacagaattgtgtatggggaaggggagcggttattctggtctgctcacatctctcatactcaacctcatttctcctaattctgaaatcttgagatcctctatcactaagaaggaaaactactgtccaacagggacactttattgctcaccccatatgtgaaagtttgtcatagctaaggctagggtgcttttggtcagtatcagcagaatatatgccccctttcttttgtcagcattactccgcttacaaagcccttccatgtagatgacctcatctgagcttcctaacaaaggagctggtattagaccccattttacagtgtgcctgggtagggaagagagtgtagtggattgagcagaggccttggcaccagacactgcttcctagccatgtgctcttgggcaagttgcttaaccctgctgagcctcagtttcctcagaaggagtctgtataagcaagggaagggattggtcatagaagtggtactgtgtttcatttatctggttatggcagactctcaaaaacaaatggttctatacaactaacattgtctgcaattcccctgaatccattcacttgttcagtaaatgtgtattgagcttctacaaggtgtcaagcaccatgatctctgtatcagtgatttaaccatttttgatggttactacagacctctttaagaatgtgatagaaaactgtagctccctccccagaaaacttttctagctttttattttgctttgcagtgagccaagatagttccactgcactcgggggacagagtaagaccctgtctcaaaaaaaaaaaaaagaaaggaaccatttcaaattaggtgggagacatggagctctaaatactacagcatccattgcctagaaatacaggtattctcagccgggcgcggtggctcacacctgtaat

SEQ ID NO: 120159 - DNA, 1634 bp, Homo sapiens
ggtaactgggaggaagaccacagaggtagattgccattatcatcccatcgtatcaagggcatgtactaacatgatttatgacttaatattgatttgggtgagatagtgtttttcaggtttctccactgtacagttagtctcttttccactctttgcgtgtattgtcctctttagaaggaagtcactaagtgcagcccatacctagggagccaagagttatattcccccttcttgagggcaagtatctacatattattgtttgcagttattctgcatggaagatttgtttctctcttcccccaatttattaatttattcaatcattaatttcagtgtagactcagggacatttattttatactttggtttataatccaatactacttaattttgttgctcaaattactgtggctttggctgttgggagctcttttcacattggctcctgtgctctttcatagtatttttatagagctttttgctaatgagacactcgtacttatgtgaccttgcctcaacctcaaatagcctggtaaacttggcaaaatattttccccttgttaagaggtaaggagactgaaggcctaaggcagtgggtgacttcttagatatcacttcctgcaggggagtaacaggttggactcagattgtgtgtgaccaccacagaagacactgcaaacccccgaagagagtccatggtctgtattgaggcttcttggaatgacttcagacttggacccccccaggatcagaatagaaaagacacagagaatgggaaattggtttgagaagacaaaaacataaattggctggcatcaggatgaattagattttgccagctttatagaaatggaattttgttcttccccccaaaattgtgtgtgtgtggagggaggccaagagatatctaggtaatgtgtgtgggcaagaatgtctaatctaaagagagccctggaagcctgctgctgaagcagaattttaatgtgggaaaggggggtgtgtagtgaaagggggaagaatggagatggcagggctctggaattagaggaggtcattcatttcacaaacatttgcagaccccctactttgtgccagatattggagataaaaaggtcagtgaggcatgacctttgggttcacattctggtgggagagaagacagataaaaatatcaattacagccacttatccatagcttagttttccgtggtttccgttacccatggtcaacctcagcccaaagacagtaaacagaaaattccagaagtaaacaattcataagttttagatgtgcattgttctgagtagcatgatgaaatctcttgccctcccactgttccttcatcacaagaagggtaagtacagtacaagatagtttgagagagagagagaccacatgcatataacttttattacggtatattgttattctgttgtgttattattgttaatctatttctgtgcctactttataaactttattacaagtgtgtatgtgtaggagaaacaggtttcagacatccactgggggttttggaatgcatctcctgaggattgaggggactcctgtatgaatgtatctttagcggatggggggtgctactgtatgaagcactgtgatagtgctattgtag

SEQ ID NO: 120160 - DNA, 1004 bp, Homo sapiens
agaaattttgtatctctcagtcccactcaaggcagttgtctcaagctacaggagaaaataatcataaacaaatccagggcagtcactgtacctggtgacactctgaacagcctaccacatggtcaagatgtctaaatccagagaacccctcaacagaatcatgtcccctctgcctcacccccacccacttcaggcccccccatgtctcacctttacaagtatcatgagatgcatcagagtactgagcacaattgctgcctggggtagaacaaaaataggaactggtcagagcccacaggagatgtggctaaaggaggaatcttgtctacactgtcccaacgatctcagggagcagccctctaatcccccatactaacaggcagcccgagcatagctcctccttgttctatctgtgagaaaaaaacaacctgtgagaggtcagggaggacatggggcatgaagtccttaaggaaacagcaaatcctggaccccaggaaaatttccagaactgtgactgcagacccagggcaggatcaggaaacatgaggaaagcaggtgtggtgactggaccaactgccctcctgaggtctgtcctcagtagggatcttcccttgtgacctgtgactgctgggaggtccccatcaccacaatcatcaaggtgataaatttgtccttcgttttcacatgtgcttcacaaaagagcaagtgttggcacacagggccccaggctaggtcggcctgtgtgtcgacggtgcttcccagtgatgaagcaagtcacaattctacctgtggcttgaaacccacagtggaacaagaaaacccagaccccacctctcaccccttccctacctgagcttttcttcctccacatcgcagcagcaaccacagctccagtgaccacagctccaaggagaaacaggccagcaacgatgcccacgatggggatggtgggctgagaagacggctctgggaaaggagagggaggtgaggggttctgaccccca

SEQ ID NO: 120161 - DNA, 1082 bp, Homo sapiens
gcagcattcagatattttttcattctgctgagctgtgagccacttctcaatcttccatctggctataccccatgatagagaaaatgacatttatctctcagcatcctgtcttataattaaagaaacacatcctccttaaaaataaataaataaataaataaaaaacccagaataaagcaacacttaaatgtgggtctgagacccctccccatcctgggcattctccaactactgatctcagtgatatcaaatctggctgagcaccaggtttgctgtgggcttgttgtagaatactcaggcctctccacagatgcccctgtgtcagaatgttgcgcatggagtgcaggaattgcttattaacaagcctcacaggcgaggctgatgcatagcctaggaatcctggtctgtgttcttgctaccaaaagtgggatctgaagaccagcagcatcagcgccaacagcaacattatataagtaggaaatctcattctcgattccagatcagcttagacttaaggtgatgtccaggtgattcctgtccacaggaaagtctagaactccctggtctatgtaccttctagatgtggggtcaggactgtgcagtctgatctaggtgtgttgtctgatcagatcctttagcaacagaggcctagtgttcagtccttgttcctgttctcttctacagccaatcactcccttggagacgtcattcagactcaaggctttaaataactgttatatgacatcacctcccaagtctatttctcctaaatgtctccagattcatctgtccaactgccaacccgactacctcactggtatttctcagcggcatctcagatcccacgtctcccatagtgactgcctgcgacgtcccctcctctcatatgctcctgctagtcttctcattctcagctgatggcaactctttttagtcacagtctgacatttttggtatcctttactcttctttctcataccccagatttagtccattagaaaatgcggtataaagtgattggaaatagtaggaatccaatcacgtcccactatttccactgctcacaccccagttgaagtaac

SEQ ID NO: 120162 - DNA, 3082 bp, Homo sapiens
cctcctccttcttccgcaggcaccgctagacccggccgcggccgcccgccgacaccccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaaggtaggtgctgtcccgccgccgcgcccgagcctggggcctgcgctcgccggccggctccgcaagccgcgtcccagcgccccgcgactgcgtcaccggccccccgcacgtaaccacagctgcctccgcccgcctcgggcccgggcggacgttttgccgccccggcgacgtcagcgcgtccggcgttgcttggctaccccgccgttcccccgtcccgctgctgctcacctccccgggtgaaactctgacgcagtcaccgcgggtctcggcagcgtcatagcggcgggcatcccatctgcacgtcacacctctttctcacctggacacgcatcccttcctaccctgccagccacgacgtttcctctttcccctctccaatgccccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcaggtgaggaggccacttaatttgtaaaagactgaggaaggggtaggatcaccacaagtcaaagttggattcccacagatagaaatcatctgactgaacttctctcctattgctgacagaagaaattcaaatccaaagaagttatcagttcctactccaaatcaaacacatttgtgtgtgccaacaatatatacaggaacaattgttgttaacctacctcattacatggccacttatctctcagcacatagatctaccaaatttccttccttccagtaggtccctggagaaggatgggggtcgggaggagaaaaggttatggggatagttaaatcaacttacccatggctaaaagtatggatgttttaaggatggagtagggggccagccttgtgttttataaatctctcctatgcatttccaattcttctgaggctgcgcttgagggagatctcattgcctcttttgtgtctcttaattcgcaaccactccaggacctataagttggagacacactatgcccagggtgttagttatcaatagctatattgaaagattccagtcactacaaatagactcgttgctctcttttcaagaagtcgttggcctgagctcagcaatatttaatatggttgccataatttatcagttttcagcagttctgagtgtccagatgaacacaagagaaatggaatgttgcgtgaaatgtcattccaagaagagagcagatttcctttaggctagtctgatggataaaaggaagaataatttcagattttcctgaaaagaggaggttgcctttgcctcattcattccatttgttagcctttagagcagtggtatctaaccctttcaatatgaggactctctttgcttatctgtggtggctgataaaaattatgcatggaccttctgtggtggtgatagaacaaaagttatgcatggacttttttttttttaagcttatcagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacttttttacttctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagaggtaagagacaagatagatcaattgggggttgtgtgtcagtttactaacaagaaaaaaaaggttgatggctgggagtcacaagttttgaaaatggagaaacaaagaggttgaattgattggaagagaagatggagaataacaagaaggggcaaatctggagttaggacttaacatagggataaatgtcgggtcagggatgcaaaaaaaaaaaaaagaaaaaacctccaattaatatttttattttctctgtcctcttccccactcccaagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggtggggaagcagacacacgatgtcagtgtgggtaaaaagggagaagcggcagaggatgagatactccctaggtagagatcgtaagctcctactactcact

SEQ ID NO: 120163 - DNA, 1105 bp, Homo sapiens
tggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgatctctgtgttgtgtggtaatttggtgacagccttgtactgatgtgtaagaatcactgggtgttagacatgcatgttcctgggtctcacccttagtggttagtcaaggtctggggtgggccggacatctacattttatttatgagacagagtctcgttctgtcgcccaggctggagtacagtggtgatctcagctcactgcaacctccgcctcccaggttcaagcaattctcctgcctcagcctccagagtagctgggattactatggactatagccatgcaccaccacacccggctaattttagtggagacagggttttgccatgttggacaggctggtctcgaactcctgaactcaagtaatctacctgcctcagccactcaaagtgctaggattacaggtgtgagccaccgtgcccagcctacatctacattttaaacacaccactctcatttgagtccgaaaacccttgtgaaactagttccagaggaggtttcagccatgtccttcctcccagctggagccctgcttgtctgtccccgcctggcactgggtctgaaattggagagaagtcatcctctcctgacttatgctgccctccccatctcagggttcattgatcttctac

SEQ ID NO: 120164 - DNA, 1093 bp, Homo sapiens
gatagaagaggtcagagggaggggtgtgaggtgaatgtcagtgtggggagtggggtgaagtttcaggggcaggggatgctgttgacagatttctgtgctgtacctaagcctaggagttagaaaccattcactcagaaagtgaggatcacctactgtgtgtccagcactgcataacaggaagtgtgtttctttggtaggtggaatagtaggagtaaactgtgctttctgaggaccgggagtccttttccctccctccagcaccctcatgatccttcccactttcacccccactggcaccagtgcttttttttaatgtattacctctgtgccttccgtctgtagatcttacaggcatctgcctcggacctcaggagagtagggcagaagctctagctgggtataaattgcacataaccatctccccaacgtagctacataaagagaccagccttctgtcctgaaaatggccgatttaagatcctcacctgctccactaggtctctaggtgatataattggtcatgagcttgaggaagacaaaagcactgaaaattcataaagggaccctgggcatggattgctggggttgtgtttagaaaccgatgagtttgtgaggcctccgggaggctcccgagggcgcggggactacgtttcccaggaggcctcgcgcggacgcccgggcggggctgtgcgaggggtggggctgcgggaggccctggagcgcggcggtgatggcggggccggtgaaggaccgcgaggccttccagaggctcaacttcctgtaccaggtgagtctgcgacaagggccccacggggacggtgctcggcgtcccagagtgactgctcccctcccgcaggccgcccattgtgtccttgcccaggaccccgagaaccaggcgctggcgaggttttactgctacactgagaggaccattgcgaagcggctcgtcttgcggcggtgagacagccacggggcgggcggcgggcgggacgcgggaggaacgcgagagggagcgcgggcgccagaccactatcctcctccgcccccagggatccctcggtgaagaggactctctgtcgaggctgctcttccc

SEQ ID NO: 120165 - DNA, 1104 bp, Homo sapiens
gacaattatagtaggagaagaggacaaaaccttgacaccagcctggacttagggatctgggatagcctcttattccttggaaagttctagaatcgggatgagctagcccagggtagaaggtgaaaagggatttctggtcctggcctgtgtggatgctgagtgactgagaaaagctggagtcagacctccaaaaactcttggtgtggggctgagaatcaggcacgagagaaactcccccgtgattcctaatactgggagtcaaagagaactgctcatcagttcatctgaaggatggaatctccagcgagactagattccttaattgcccctgagagaggtctggccctttaagagagtcactctgtggtataggatctcctgtacctcaggtgacagctccctctcctgatccaagggaggagtggtattctggcctccatccctgtttcttctactgtttgaggtctgtcagctgtgggcacagtcctagcccaagaaggagatgggagagtagccctgtggaccctcttacccaggtgaagcagcgtctccttccccttctccaggtatttgtggagccactccacgcatgtgtcttccaggtaggctctctggtgctccgcctcagaggcatcatttgacttttgctcggagatctgagccgccgtgtccaccgcggtccaggagcgcaggtcctcattcagggtgagataatccttgccgtcgtaggcgaactgttcatacccgcggaggaagcgcccgtcgggccccagctcgcagccatgcatccactgcagggtgtgagaccctggccccgccccttagtcagtcccgcccaccaagccccgcccccgtcgccaccaccctgtgggcattttggcctaaactgaaaaagaaccgggtaaaggcgcctgagactctccccggtctagggtctgggcgggttccgcagccttggggtgaatctgggacccgaagattcgaggggacccgcgccgtccgtgggggatggggaggggtcgtgacctgctcccctggccggggtcactcaccggcctcgctctgattgtagtagccgcgcagcgtccgcagattcactcggaa

SEQ ID NO: 120166 - DNA, 1046 bp, Homo sapiens
aggctaacagctgtgggaggcttctctcctcttctcccttcttttttcatgcattctctttgcaagggaaagttctcttaggagtttagtaggttctcagtctctgaaacctgcttcctctacccattctcccactctgcaccttaggaatcccgttatctacatggggaggggaggtctaaatccagctcccttttggagtttgtgccattctccgatttgagcagcagccctgtgtgccccctgccgccagacctgctcattccaggagcttctgggagaaggaacagtaagagaggaactgtgtcccaagctgatgtctcttaatgagatttttacaggaattgttcaaattcagcaaatatttattgagggtctattgtgtgtcttgacctgtgctgagcaccaagcatataaggatgtaccaccagagcctgacctaaatttgaagcctggccatgatcaaaaccccaccttcaggcacccaagtttttggattaagaagggtgaatgatgttctccaaatcctgggggctcatgcagtataattctaggacttcatgttgatacaaatttttagttaaggcaaaacgcttgtgaaaatgttgattaaatgtgtacgagtagttttaattactggtgaacaactagcgtgcacatttatgatttgagcagaacagccctttaagtacagtgttaagtttcattgtttaaaagcttggcagctacgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgt

SEQ ID NO: 120167 - DNA, 2455 bp, Homo sapiens
agtctgctaccaccagggccttgtctctgagctacacctgctgagtggggagctggaggcagagaactctgggttgactttcactgctccatcctcttatcaactctgtcctaggttgtgaatttcccgccagcactttatgagtatgtgactggagaacttggactggccctggtgctggttttgaacaaggtggatctggccccgccagctcttgtggttgcctggaagcattatttccatcaacactatccccagctccacgtcgtccttttcacctcttttcctcgggacccccgcaccccacaggaccctagtagtggtgagtgggcaatgagagagggcaacttgggagaggtgagttggcaggggacaaaggggagaacagagaggcttattgacaagggggcacctggtcttgggcctaagggtggtgggagagatgagaggcctaagcccgtgtgcccatccttttgtgccctctgatctcagtcttgaagaagagtcggaggcgggggagaggatggactcgggccctggggccagagcagttgctgagagcctgtgaagccatcactgtggggaaaggtatgtggcccttagaggagggctgtaggaggacatgggggagaccaaagatgcagaatcattttgctcacctttcctgaagccaacccctctatggtggatatgtgcaagaggccaggggaagggacagaataaggagcagactgacttggtgggacgagaggcagcaggtagtcaggagcctcagtggcttgctgcctttagccttcccagtacttttcagaagctcagagaaacgtgcgtgattccagggagggtagggtcaaatgacttttgggagattctctgacctgctcttatttaggttggcactgtacaactccagagggtgccagttacataatctgtgcagggcacagtatgtgccatcatgcacagcagccctggggagaacctctttaatcttctccttctttgagcagtggacttgagcagctggcgggagaagattgctcgggatgtggctggggccacctggggtaatggctctggggaggaggaggaagaggaggatggcccagcagtcctggtggagcagcagactgattcagcaatggagccaactggcccaacccaagagcgctacaaggatggggtggtgaccatcggctgtgtgggtaaggaagtggcagcttgtgcgtggtggcctccaaggaggtacagagttttcatattcggagaagagagagggcgatcaggtctcattaggccccagggtgtctgaggggtgatctctgccagtggcggtgggcaaggcagaagaggcgtctgctgcagtggaaggatcatgacagcctgagttaaattccacctcttctcagctgtgaggtcttgagtaagtgattttgctactctgagtcttagttactttgattttaaaaataaggacattgatacctgagtaaaagaatggatgacggccatgtgtgagggctcatgcctatatagtcccagcgctttgggaggctgaggtgggaggattgcttgagaccaggagctcaagactagtctgggcaacatagtgaaaccccatctttacaaaagataaagaaaactagccaagtgtggtggtatgtgcctgtagtctctgctacttcagaggctgaggcaggaggatcacttgagcccaagagttcaaggctgcagtgagctatgattgtgccactgcactccagcctggctgatagagaccctgtctttaaaaaaaaagaatggatgtgaggaatgatgggaatagtgttaagagagtgtaagaatgcctgacaaatagtgataacaataataacaattattattgttaaaactcagtatttatatggtgcttactatgtaacaggcactgttttaagtggtttatataaaccatttgaattgtagtaattagtctgtagtacagtgattatcaaatcatagtaggagctcagcaagaattagtattcttctaggttttaaccctttaagtttgttgccaaggagaatctcctcttaagggctttgtctcagctcacagtggaggaaaaaggaatgtatgattaggacccagggcccgtcttcatttagggtgggagaggtaagaagagaccttggacaagttatggtatctgaggtgatattggaaccaaaaagggcccaacccagaataaatttgggagtgtggagtaggtagttgggttccttggaagtgccctgacttatctctgtgtcctttttgtctttggaagaacctgccttactgctgagtgattgctcctctttccagtcatttcacccggctgtcccttccctgacttctgatcctagtctccctgtcacaaggagcctctgttccctctcttagcagcctctgctctagctgatctctattcca

SEQ ID NO: 120168 - DNA, 1093 bp, Homo sapiens
gaaagagagcagcccgggagcaagttctacagccggtcagtgctgagttgttggagctggacatccgggaggtgtatcagcctggctcaggtgagtgagagcaagacaggcattgggctggggaaggagtttggaaaggtaaaagccgactgtgaggaaggaggggtctgggatgtactcttgaatcctgaagatttcctcacacttggactttttcctgaattcccagttctggactttcctcgacgtcctccttggagctatgagatgtccaaggagcaactaatgagccaagaggaacggagcttccaagactatcttgggaagattcatggggcttactcctctgagaaactcagctactttgagcacaatctggaggtgacagtgtactctagggacaggagtggggcatagtgacctatggtcaaattggtttgggatcaggctggagagggactctgttttcagtttctcttcctgatcctgtctttttagacatggaggcagctgtggcgggtgttagagatgtctgacatcgtcctgcttatcactgatatccgacatccagtgagtactagggataagggtgggcaaggaggagggagaaaggtttttcaggggcaaaggtcagaggcaagagttgggagacagagaggtatctatcttcctgtctttctaatctctacctagtgctgatgtccgcagttaggaactcagttttttattctcttatagcctgtcattcctcccttggccagctcactcttctcttcaaaacagccatgtcctgtcctttagctcatcacagaccaatagaaaatccaagtgttggagctccagggattctatgaatgcagctggggacttcctcctgcccagcccaaagatgccctttcttccttatctcatttctctagcactgccacatcagttgctacagaacccacctggaatgctagagtagtagttaaggctgtagactgctgctggactgccctgtgtgaatcctagctctgcaacttcactcttgtcctccagtgggagaaagggaggtctgtgaggaccatttaggttggaggtccttaataat

SEQ ID NO: 120169 - DNA, 1251 bp, Homo sapiens
cccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggtgaggggtctgggagggatgtgcacatgcctgtcaagcccgtccgggcaaggggctaggggctaataaggtgcgaaggagggggctgtaacggaaggaggaagggcgcacgcgctggggagggatggaagtggggctctcccaaatggagccttgaaccaggagttctcttactggaaccatcaacctcaatacggccccagacctttctggagaaggcgggggtggagagaataaagagctcttttgcgcagccgcagaacagtaggggaaaggggtagtagagatgttgcagattgcgatgactgggatgacagtttgtatccagactttgactgaaaaggtacaggtgcagctttctctaaactagtcctctggccagcagttaaggtgagggattggttcatgtctggagacacttaggttgttttggatagcgacggtacggtgaagaaaaaaagttgtcagtatcttttcctgcattatcccctttgattgaatatctactttttgcaaaccctgaaacagctttgcagaaaaaagggcagatagatggggtgagaactcccaagactgctgaaaatatacctgactttactggttgaattaagaaataagtaatacaagaaaaacacctaagaacagaatcatcagtcctttaatccattctgatgaccatattttcatgtctgctcttaggaccacccagccttctgggccctccccccatggccaatggaaaacctggcgaccctaagtcaggtgaggaggaaggggccctgatccttgtattaggtcgtagagaagacagcaagggaggggataaaacccaggaaggacttaaaaataaaagatcagggattccatccctaaatgaatggagagaagttgtatatttgctgatttaaaaactcaatgttgtaaaaatgtcacttcttcccaaattgataaacagatttcatgcattccaagtcagaacacccataatgtttttgtggaaatacacattattatagggaaatgcaaaatatcaaggcgactatcaagacaatcttgaagtgggagggcttactatgaatatcaaga

SEQ ID NO: 120170 - DNA, 1011 bp, Homo sapiens
ctataatatataaagaactcttccagacaagccatttgaaaaattgacaaaaacacaggacaccttattaaaatggagatctaaatgaactaaaggtctaaatgaacaagtactcaatatcattaattgtcaagtaaatgcaagataaaaatataccactttgaaattagaactcttgtgtactgctgctgggattataaaatggtgaaactactatagaaaacaatatgaagaggttcctcttaattaaaaatagaactaccagatgacaaaaaaattaaaaatagaattaccccagaactcctgcttccaggtatatatcaaaaaaaaaaaaatggaaagcagggtcttgagatatttgcagactcatgttcatagcagcagtattcacaataacaaagaggtggaagcaacccacatgtccactgatggaaggataaatgtggcgtgtacatacaatggaatattattcagccttatgaaggaagaaagtgctgtcacatactacaacatggatgaactttgaggactttatgttaagtaaagacatagtgtattattccacttatctgaggtgtctaaagtcaaattcaggggctgggcatggtgcttcacgcctgtaatcccagcactttgggaggccaaggcaggcagatcacttgaggtcaggagttcgagaacagcctggccaatatggcaaaaccctgtctctactaaaaatagaaaaattagctgggcatggtggtgcacacctgtaatcccagctactcgggtagctgaggcatgagaattgcttgaacctgggaggcagaggttgcagtgagtcgagatcacgccactgcactccagcctggatgacagagcaagattgtcaaaacaaaaaataaaaataaagtcaacttcaaagaaacagtagaatgatggttaccagaggctgggggaaggaagctggaggaaggggagttttgtttaatgggtacagagtttcagttttgcaagataaaaaacttt

SEQ ID NO: 120171 - DNA, 1121 bp, Homo sapiens
agctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaag

SEQ ID NO: 120172 - DNA, 1679 bp, Homo sapiens
actcctcattacttcagttatttgcttaaatgccatcttcttagagaggccgccaccagagatgaagccagcctctcccccaccaccaagtaggctttaccttttcttttggaaccttcagtacacctggaattacctatttaaaaatctctcttcctatagcctgcaagctccagaggagaccacatttgtcttgttcattgctatgatcccctacgctagcacaatatctgacacatggtagctgtttagtagatacttagtggatgaatgaatagagatgggaatgattatttctgcaggagttgtgagacagtacaaatatttaaggagtgatagttaagctagaaaaataataaaataggatagaggctacagagatctttgcaggggggatcagactgctttggaatttgcagataagcattcacgatgtccgcttaactttctagacaaagtggtgaagaaagggaagaaggacaagaagatcaaaaaaacggtgagaaaatgagggttgaggataagaaatgactatggatgtttccaagctaaataaatagccatgtgaaggaggtgggaggtccaagggaggagaaaagatcttgtcaagagaggagataggcagggcacggtggcttacacctgtaatcccagcgcttagggaggcagaggtgggaggatagcttaagcccaggaatttgagacctgcacactccattctccacaaaaagaaaaaaaagagagagacaggaggtaaggtgagggtggagtggagggccagtgggccaatgtgtggcagagcacagcctgcttggattgctcttggaaacatgtttacctgtagcttaactccctttatagttctttgaagagctggcagtagaagataaacaggctggggaagaagagaaagtgctcaaggagaaggagcagcagcagcagcaacagcaacagcaggtacaagtgccacagggcccaccaatcctgggaggcatctgggttccaccaacccctttccagcccatgttgctccattcagctgatggggaaccctctgtgaggcagaaatacagcaggggcctgggcttcattttctcactgttcttttgctctcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaaggtaaatgacctgagggggaatgggtacctggaatccatgagtcatggagagtgatacctcataccctgatcttcaagttggattcaattggggggccagacattgtaattctttcctatctcatgttctccccctgtcatttcagtacccgccccaaaaccccgcggagggaagaaaaccaaggtaagccatctgtgtggtaaacggagactccaaggatgcaaccttgaccatcctactgacttctgtggccctttcattctctagggtggtaatgtttttgcagccctgattcaggatcagagtgaggaagaggaggaggaagaaaaacatcctcctaagcctgccaagccggagaagaatcggatcaataaggtgacagtggtggctcgatcagtcactctcactccatttagcaccttctggccatggt

SEQ ID NO: 120173 - DNA, 1050 bp, Homo sapiens
tccaagtaaaacaatcggagtaagaaaataattgtgttctgtgaaccttatctcaatgtctgatgacatgggctgtttcactttggggttttttgtttattttttgagacagggtctcacactgttactcaggctggagtgcaatgacgtgatctctgttcactgcagcctcaacctaccaggctcaagtgatcctcccacctcagcctcccgaatagctgagactatgggtggcaccaccatgcctggctaatttttgtattttttgtagagacagtattttagcatgttggccaggctggtctcaaactcctgagctcaagagatccacctacctcagcctcccagagtgctgggattacaggcgtgagccagcatgcccagccagcatgggctgtttcatggtgatgggaaactggtagactgtggcttcaaatgtagtttttcctaccttctcagatggagtatgagcgccaagtggcttcattaaaagcagccaatgcagctgaaaatgacttctccgtgtcccaggcggagatgtcctcccgccaagccatgttagaaaatgcatctgacatcaaggtaaggtctcaaggggccccttccagtccacttacctagggaagagccagttctctcatcttccctgagtggctgtggtgtgtgaatgggttagttcagtgggaagaaagattggaggcattttccacaccttaggttctgccaacttgagcaagaagatagaaaaaccagtagaagtggggtccacccttggcagaaaatagtgtgggacagactagactagctgaggatgcatggggctcccattacaggcagcgaacagggcggggaccggctgtggggagaggaaggggattatgctggaggtagcggtttgtcagaggcttccctgcagggagaaagtggccgctcctgtcccaaagggagaattttcatgtgatcatcccttccctctgccacctctttcctgatggctgcagctggagaagttcagcatctccgctcatggcaaggagctgttcgtcaatg

SEQ ID NO: 120174 - DNA, 2502 bp, Homo sapiens
ccagccaagaatagaagaaattgtggctatggagttggaagggatgtggagggagactggagaccgggaaagggatgctaaggaaaggaggggagggtcaatgaggaacttgagagtgttttatttggaacaagtacaaagagctgggcagggtcaggcaaaacagaaatgtaattgaagggaaagaaagatgagactcttggctcttgaggctgcctgactgttctccctctgcctcccagaggtggtagcagatgagacaccagcagtccaggctgttcttcgagctgacaccaagcgattgaagctgctggaagaggagcggcggcttcagggacagctggaacaaggggatgacacagctgctgagaggctagagaaggtagaggagatggcgcaggggacacgggcaaagacttgggggttcctgggaccctcagacgtgtgtcctcttctccctcctcccaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccaggtgggccattcacctcactgccctcccttccagcctcagaccaccggggcccttttcctctttcccttctcattcttccaaggccaatagggaggctcaaggcttacctctccctccttactatctgtgttgtgagaacttagggtctttctctatttatctccctacttggtggtgagttctcatcaacataccctgcagctgggtgcaatgggtcacgcctgtaatcccagcactttggaaggcagaggcaggaggattatcttcaacccaggagtttgagaccagcctgggcaatatagtgagactctatcttcacaaaagggggaagaaaacatatcctagcctgggcaacatagggagaccctgtctctacaaaaaatttaaagatcagctggatatggtggcgcacgctgtggtcacagctactctggaggctgaagtagaagtatcacttagacctgggagatttagactacagtgagcccttattgtgccactgcacgacagcctgggcaacagggcgagaccctgtctcaaaaaaattaaaccgtatcctgcccgagaacttctctgaggagagcttgggaaggagtgttcatggtctcaggctctatctccgagttttctctggggttgtctgagcaaggatctttctctccctgaccctgccctctgctacccaccctctagggcactgttcatggagcccacactgctgatgctggatgagcccaccaaccacctggacctcaacgctgtcatctggcttaataagtgcgttacggcctttgcatcattggttcccattctgcactttcttccccttccctccctgccctgttttcctttagcccttctccactgtgcctgtgagtggagctctattcagacccccctttccctcccagcccccgttgtctgcctgcttcctctgaattctctctcacttgaccactgtgacacttacaccctgttctctgaaacccagctacctccagggctggcggaagaccttgctgatcgtctcccatgaccagggcttcttggatgatgtctgcactgatatcatccacctcgatgcccagcggctccactactataggggcaattacagtaagtaggattgtgtgtggatgcagggaagagatagaacctcgaaaagaggcctgagtgggagggcctatttagataaactgaatcctgtcagaattccagacagtgatgcctaccccatcaccaccagtccctggttgtccctttgctgggaagaggagcaaccactgatgcctggtcccctcttctgccccagtgaccttcaaaaagatgtaccagcagaagcagaaagaactgctgaaacagtatgagaagcaagagaaaaagctgaaggagctgaaggcaggcgggaagtccaccaagcaggcggtgagcacctgagggacttctgggctgggggccactgttctctcctggcagtggaggaagaaggagactctggaacgctggcctacatttcaaggactgccgcgcagggctcaggtttctcttttttcctcttcctctccaggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgagtgccgcgggcctctgctgctccacaggaagcaccggaagcatgtatgtgcaccctaaattctccaccaaggctgagattgctcctgttctccaaggccagcacatgagagggactttgcagggactgaaaagaatataaat

SEQ ID NO: 120175 - DNA, 1074 bp, Homo sapiens
caaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaacatgggtctctttcctttttttttttttttttttttttgacagaatcttgccctttcactcaggctggagtgcagtggcatgatcttggctcactgcagcctccacctcctgggttcaagcaattttcctgcctcagcctcccgagtagctgggattac

SEQ ID NO: 120176 - DNA, 1045 bp, Homo sapiens
aagtggtggacatcgtccccatgaaggccctggacacggggggccccatggccaccggcctcatgatgtccctggtcaccgaggccatgaccatcgagggccgccacctcatgagcaccgtggccatgatggtcctggccacgggggagggggccaccgagggcacgatggaggccacagccatggaggaggtgaggatgctccctgtcccccatatgccttttggttgtcccatacaagcttttggggagtgggtgagagtcactactgttggtagctaggcagaacgtgaggtacccgtctctttgatgtcctagtatgcatagcagttcctactctatgcccttcccccaaatccccaagattgtctctgaaagacagttctcaggatgtcatggacaaggggtggtgagggtggcattgccctcagctatttcctgtctaactgttttgccatcgttcccacagacatgtcaaaccgccctgtctgccgacatttcatgatgaagggcaactgccgctatgagaacaactgtgccttctaccacccgggtgtcaatgggccccccctgccctagggaccatttgcctgccctgttcacacaacccctgtggactgcagcctcgctctttccaccctgttatggcttctgtgaggcccattttcccttttccccagctgatgaggagccggccccctcagttcccacttgcttgggttcctgggggttttctgatcactggtgcgcattgatgtacatattttcctccagtctggggaggagagagactggaaacgttcctggactgctgaagaggagacccagttggcttcactttttgagaagattcgccctgtaccccaaacccctttccagtattacccttaatgcttgagaacctaaagctggttatcctggcgaacacccctacccttctattgcgggtccccacatgcacacagaactctgacacaggatcagctgcacttaagaaatcatcccagctaagttcattattcctcatggggtggggagatgctgaa

SEQ ID NO: 120177 - DNA, 2167 bp, Homo sapiens
acgtagctgctccaggagatgccactccccctgcagagaagaaatacaagccactcaacacaacacctaatgccaccaaagagatcaaagtgaagatcatcccgccacagcgtgagtctaaagtggggaagatgtactttgaattaggagcaaacttttttttttttttttttggagacagagtctcactctgtcacccaggctggagtgcagtggcacggtcttggctcactgcaagctccgcctcccgggttcacgccattctcctgcctcagcctcccgagtagctgggactactggtgcccgccaccacgcccggctaattttttgtatttttagtagagatggggtttcaccatgttagccaggatggtcttgatttcctgacctcgtgatccacccacctcagcttcccaaagtgctgggattacaggcatgagccaccgcacctggccaggagcaaactcttatgggaatgaatgtccctgggaacgagaagttttttcccttctcttttattatttccctccattttcctttgatttcttggtatcccttactttttgtacctctggaactcccgtttcaggggtcacttaggagtaattttagagataagatagggacgtgtgccattctgtgactggtcaggggcacctggtaaggtgatctgtcatgttcacaagggctcacttcgtcagctacctgagctataattcacatccaaagctatggcttgcctgccatgagaaacctagaataacaacaagaatatcctgtgtgaatcctcctgcatgtgcttcctggtcctcttgagcttatcgtgtcctaagttgaggcagggtcttcactggctcattttatgcctggactgtgtttgcaggtgtaggattatgaaggaggtctgatgatgccatttggtgctctttctttttgtagctatggagggcctgggctttctggatgctcttaattcagcccctgttccaggcatcaaaattaagaagaaaaaaaaagtactgtcacctacggctgccaaggtatgggctcccagaagtaggtttcagtgacagagtataaaaggtaaagtagaagaaagggcacagcagctaggagttgtcggggaggacaacaagaggcgttttgccttggatatagactggtgcaggtgagacattgtggagacagagtcttcctttatataggaactgttgggggactgtgcctgggaccctggactaattgccttgcccttggctttccagtcagttcattaacttccttttctttcacaatagccaagcccctttgaagggaaaacgagcacagaaccaagcacagccaaaccttcttccccagaaccagcaccaccttctgaggcaatggacgcagaccgtccaggcaccccggttccccctgttgaagtcccggagctcatggatacaggtaatctagaaactggttcagtttggggggttttctgaaaggagggatctgggtctgaaacctcttctgcttccagcctctttggagccaggagctctggatgccaagccagtggagagtcctggagatcctaaccaactgacccggaaaggcaggaagaggaaaagtgtgacatggcctgaggaaggcaaactgagagaatatttctattttgaattggatgaaactgaacgaggtaagaggtcatttcctacgtaataggtgtgtttaagggattttgaaaggacttggttgtgcttactttccctcttgcttttcttcccctgccgacagtaaatgtgaataagatcaaggactttggtgaggcggctaagcgagagatactgtcagaccgacatgcatttgagacagcgcggcgtctgagccatgataacatggaggagaaggtgccctgggtgtgcccccggcccctggttctgccctcacctcttgtcacccctggaagcaatagtcaggagcgatatatccaggctgagcgggagaagggaatccttcaggagctcttcctgaacaaggagaggtgagcagagtggggttcgtgccctgggatgttgagtgcttggacactcctgagggaacatgagctggggtaattacggggtggaggttagaaattactttcagggtctgaattaataacttgactatcattcttttttct

SEQ ID NO: 120178 - DNA, 2276 bp, Homo sapiens
gtctaggaggacctgcttgatttccatgcatccatttgtctcaatctctggcacctactcccagatctccttagggagggattctgttttcaagttttgttttgttctccatcatctaccacttcagctgatacatatcttgccatgtgtagtgattatgactcttaatgggctaagataaaaaggactcaagtcttataagacatttagctcaaacacccaagattggcccaatttctatcaagctataggctgtttttcaagccaaatttatcagcaactagggaagacaggacttaacgataggtgtaaatgccctggagagttgaacatcttgttatgggaactgatcttagctttaatacgatctagtgaagttcagccatcctaggaaggatgctgctgggagggagggacaggtgtgctgccctactcctccaatcgaattgctttcctgttcagtcacatatgctccccatgcttaacttgccagggctattttctcagtagtggcaagtggtctgtgtcgatttttcatatctaaaaaatagcatagttgaataattagtcattatactttgtcaaatatagagatgtggtttattagagggcctactcgggtagtccttgccacccatttattctgtgggtttgtttgttttgtcctcttaccatagaaaccaccatcatgggttcgggtcccatagaccccaaagaacttctcaagggcctggacagcttccttaaccgagatggggaagtcaaaagtgtggatgggatttccaagatcttcaggtgagtctttacccctttttgtattcactgtgagtagagaatattgtgtgttaaaacatggctgcagttgaggcacactggaatgatcctggaaaggaaagggaaagatagtcagtgcaataggattaaaatgtaacaattttaggataagggataggaaaagatgatcacttgtttctgaccataatggaaactggagatttggacgtccacggtcccaagggagtcatgctttggaatgagagcagggtagcctggtaacagaattctagattgttttggttcgtgttccacctacccataatgttattttccttcagggattctcaggtttttcaggggagagtaaataactaagccagtcttgaacagactattagggacagttgttgagggatagccttatcacctggaggcagaatggaattcatcctgtgtgttacggaggcagcgatgctctcctccccaggtcagagactgcggtgtctctgttctcccataagtttccatgtcacactggatccatcccatcttcctagaggtatatgtgactccccttctctggagcaaagtcccaagtcattaggaatctctaggcagttcacagagaggcgcttttgctaagagaagagatactggctgcttcatttctaaccctaactcatcttctgcagtttgatgaaggaagcacgaaagatggtgagtcgatgcacttacttgaacattctcctgcagacccgttcaccagaaatattggtcaagtaagtggggatctggatggttggaatgggaaggtgtagcgaaaagatggggcggtgaggcatggggttcctcggtcattgatgggagactgggattgtaggatgtggtactgtcaaaacctagaaagggcattactgatagactctcctgcctgcctgcagatttattgacgttggcggctacaaacttcttaacaattggctgacgtattcaaagacaaccaacaacattcccctcctccagcaaattctactgaccctgcagcatctaccgctcactgtagaccatctcaagcaggtacctttagtctttaaaccctgattcttccttttttggtttagtctaatggatgaaaaactcaaactgactgatgtggctgtaatcttgggcctgtgaggtagaacagcagaaaaaaaataggaatttagaagaagaagacttggtttgaatttatctcctttaataggtgtgtggcggctgggcacggtggctcacgcctgtgatcccagcactttgagaggctgaggcgggcggatcatgaggtcaggagactgagaccatcctggctgacgtggtgaaaccccgtctccactaaaaatacaaaaaattagccaggcatggtggcatgcgcctgtagtcccagctaatcaggaggctgaggctggagaatcgcttgaacccaggaggtggaggttattgtgagccgagatcgcaccact

SEQ ID NO: 120179 - DNA, 3171 bp, Homo sapiens
tgtgtagttctagtttttatagaaccagtttttattttcactttccttcactcatcacaactgcttgtaatttttccccacttcagctgccaggggtgaaaaaacaggcaaacctaagactgggaagctttgaggatgtgtgtgagcgtgtgtgtatgtatatatgtgtgtagagggagatgggaaagacacaagggcttgcaagagtaacttggagataaacgggcctaatgacactgaagtgtgccatttctgcttaggaaccagtgggcctcctgcatttggtcgctttgtgtaatgagaatcgggggaaggtgggtacttttaggactttcttctaaatcgccctcattcccacctctcagtttggggataaactgtattcagtgctgtatcacgttctgcacttgattagttcctgtacattggtactaggataagaagtgaatctttaggaaaggaggcggcagttgtaaactcaaggcagggggaatcaagctacggtttctggtaagcaaaacctttctggtattacatttcacaactttcattttttttttttccccaaagagccaccttttttgaatttctttttccttcccttctaaaagaaattcctaaaagcattaatgaaaaaatgatgtcctcttcatttttcaactcatgcagtgctgtggcatttggtgcatgttcagaagccatgccctatctgagggtggtattgggtgtctggttcctttcttcccccaaatttttcaaagtcaaatctttatcagactctccatataattttaatttttaaaagtcctgcactgaagcgtggaggttctaggcagaattggaaagtataactgccctctggtgacctgggtgagacttagggctaacttcctactgggtacagattctcaaattattacttaagcttctggattggatgggagggactcttcacatgtctgttgactacaagctttttttgttttgttttgtttttttcttttaagcagtttgccatgtgcctctgcagcatatcttccttgggagctgaacattctacccactggggttcctgatctctagtgagccaggggattaataaagaagatcttccttaacatgggagatgggaagccaggtctactaggggaaccacatccattcagaaaatcttggaaaacctgatccttgtagtttgtggccagagttctagtctggggtctttttctatgagtcagggtggtatatcattttgcatctttattggaaggcagataagcttttgaggagctcatgtatcaggtttgcaaaatgactgaggggtaggggcttactacttggaagaaagctatgaccttgtgatgaatcacctgagagacataattcagtccactattgtgtcaaactaggaagtgcctaaaacactgaagaaaggaaggggaacataaggggttaggtacaaatcattttcatttccagaagtgcctctaaattaaggtaaatttgggacttttttctccttttgttagaagacagttattttttaaagagctctgacttgcacagaatttttatcctgaaccaattcagtcctgtttcattggtgatgggtgtggaataactttagctatgctggatattttttcaccctatttaattgaataaccctcaagtaaaattcattttgaaggcaggagttggtgtcacagacgtttatctctggtaaaaatggtagaaaattccccaatgccttgtgccagtagagtatggctctgcctgaaacattctccataaggaacgcatagcttaggatgaggtggaggtaggccagggggttgctacctcactccccaccttctgtatgttctgcagtcaagaaaatagcagctcattaaaagaagacataatcatgccgtggattacttgtggttccagaaagctttcttaagctttcattctagactccagatcttgagtaggtaatgttacaacacttagtcacggcccctgcctgccttcatcaactcagtttgccttctctgctgtagccctgtgcccgaaatgttggactttacattcctttccacttgagcgccttggaaattgtttggtttttttccaaaatatactgacttcaaagcaaggaaactaggttataagacacttggggtccttaattttaaataagaactaatcttcctgaaggaaggccatcatgagaaaacccacttacattttatcaagattggtgctcatgagacaaaatttcacttatatttccaaaatataagtagtggaaaatgaatatttaacgctaattttgctttgtctcttagcttccctttgactattaatgtcttttattcttgtttatacatgtgggaataaaaaagtccctggatcccatttccagcagagggcactggacagaatttagctttgtactcattggtccatttttctaagactggctcttctttcttgtctcccatcctcttaaggaacacttgagctcagatgacagtttatttagtgtctgaaggaaataggggtagtaggtctatttattggcttagcttgtagttggatatgcaaaaaggaattctccagggttatatatattcaactctgggtttgaatcagtcaagggtaactggtttgaaatgatgtttaattcaaggccttttgtcaaattgcatatattttgctttaggaatctaatggtaggtatgtgtgtatatatagagagagggagttttaaaaatttcttagtctcttgattgcttatgatatgttgttattggaacccatacattgcttttccagtctccaacagatgtgatatctgttttatgtgtccctttatcgtatctctttatagtttctatagatcactttatagtatctcactacatgggaagaatacctttatttctgtgtctgtctctgtgtgtgtaggaatcaccacacttgagtggatttggcccacggacatctaatcttttccagtattctccttgaatgttttttctctgacctcaggttccacttgtatttgtggaggttccagggcagcagcgacttctcaacatttcttgcctcatctctccctctgttcagcccacaggttatgatctccagagccaagattatactcctacccttcctggc

SEQ ID NO: 120180 - DNA, 2431 bp, Homo sapiens
gctcttaggtttctaccaatcctgggtgagaaatgttctccagggcggaagtggcggaagcagaggaaagggaggtgctaggctcctggtcacgcgcacgcgacagggaggcaggaaggaggcggaagagagtgccagggaaaggggcggagcaaaggtgaagtgagagtagccaatcagttggcgagttgtcatttgggttgaccaatgagttcacgcctcgcgtataatgtctcgcgacaagggcgtttcactagcacgtttgggcgcgttgggcggcgtccgggtataaaagactccacccgagcgggcggccgccattctggggttcgtttagaggtaagtttgcctactttgtcgtctagtgggtaaaattttgcggagagcgttggatctgggaagcgggatagggatggatgggttcatttgagagccacggcttaaagcggttgcgatcaggatgggacacaggtttgtttggggacaacaaagatggcatttgtgagtgttttgaagcaacccgtactgattacatctttctcccttgtgttccttttatcccaggtttgaattttctcggagaaagacaggccggccacgaggaaaacagaaacaagccgcagcaacatctaagcccttgaaaggatcctgagagaggggggaaagggaaaacagcagccaccagcccaaccacttgtgtcttctgccccttcccacctatcttgcccaccccaccagcccacgctgcttgggacttgaaatctgtggccgaaggaccgtcactacataacttcaaaaataatcaaccaccctcccttcccaaaccacccaaattcactcatccagcgtttacttttttgaatccactcagaacttttttctgcgacccccctccctaaatggagttgggtgggggggaaatgaatactgagttggcctttattttttaaaagactttttgatccaatgaggccccctaaataattgagttttgggtcctggttggttgttttattttttttcctccaaaattttaccccctcccccctgagcccgaggtgctgacgtcgcaaaaaaattggatagtaagtgtcgaattttcaaaaaccagccttgcaacaagaaatcaacgtttcccgttgtgaaaccaaaaataatgagaggaagaaatgagaccatagaacaaatagagaactggagaaggaccaatctggtcacttaatctccattaaaaagggcctgtgggtctaaacagtcttgttctctctcccctaccacctatctcttccctgccttgctgcaggcaaagagagggtggagggagggccagcaagtgaggattttgatggttaacccttggtaatccagccaatttccagactgccaaagccatatgtgtttatataaggaggaatggttaccttcctctggttagcagcagtcttcaaaagggttaatgagctcacatacaagagatggtggatcttgtggcccagaagtaccacttctttgtgtgtgagacaagcagggtgcctttcaatttgccagattaataagcaatctgtacataaagattgcagggtaaggagatgggcagagagaagtaatagctcgctataactttttaaatgactgttaaatcctctcaattttaatgtaatttgcttggggtatatttgtgtggttaaaataggtggcaatctaggaataaagattgcaagacacttaggacaaaatataatcttagtgccagtacatacaagataatagttggggaggtaaagaatgtcttataattgttgcagattgcataggtatttaaaagcaaaagagtgattaacattttaacttgatattttttggtgggggaggtacagttaaatagagggtggaaaggttgggaaatgtggaatttaggagtataattttaaaagccatttagtgcaattgaatgctagctttctaaaagatttgtgtcgttaaaaggaatttttttcttccctgcttcaatatggcgactttccttgtccttttgtcttccaagcggcgttgcaggttgtgtcttgacccattttttttcctgtcctcccacctcaaccctatttgttgagaggggtccaagtccttcctccccctttccctctatagggaggatgggggtggtcgatggtagccggttgaacctccgttgcaaattcagttcttccctgcagaaaattgttctttttaatattttaattgctttaattttcactacgctcttactgatcaaaataggtcaaagattattcacgatggggaactggtttttgattttttttttttttttttttactaaaaaggtgttttataatgtaactgaagctaccggcagagccgggtggctttttagtttaagtcctctttctccattacaaaatggcgtccctcc

SEQ ID NO: 120181 - DNA, 1034 bp, Homo sapiens
caaaaaagtaaacgctggatgagtgaatttgggtggtttgggaagggagggtggttgattatttttgaagttatgtagtgacggtccttcggccacagatttcaagtcccaagcagcgtgggctggtggggtgggcaagataggtgggaaggggcagaagacacaagtggttgggctggtggctgctgttttccctttcccccctctctcaggatcctttcaagggcttagatgttgctgcggcttgtttctgttttcctcgtggccggcctgtctttctccgagaaaattcaaacctgggataaaaggaacacaagggagaaagatgtaatcagtacgggttgcttcaaaacactcacaaatgccatctttgttgtccccaaacaaacctgtgtcccatcctgatcgcaaccgctttaagccgtggctctcaaatgaacccatccatccctatcccgcttcccagatccaacgctctccgcaaaattttacccactagacgacaaagtaggcaaacttacctctaaacgaaccccagaatggcggccgcccgctcgggtggagtcttttatacccggacgccgcccaacgcgcccaaacgtgctagtgaaacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcac

SEQ ID NO: 120182 - DNA, 1072 bp, Homo sapiens
tgacccctgtccaccctcagtcatgcataaccagctttttaaaaattatttaactaattaaggggccatgctaatctctgtatcgttgcaattttagcataacatatgtactccccaagcgagcgccacaaccagctgttaactatgcaagtggtgactaaatctgtgttgctctggaatgtccttggggaaattagggatcccaatttctaccaaccttgctatttctcaataaggtcaggatatattcttacgacctgaggacagtttctcagctctctttattaaatcagtttcttatcggagttatgagagcttaactccgtcctttgaattgaggtttccctccagtcttgtgtactcacctctctggaggttcttggtggggcacggtgagataggaaggcttgcccagctgccactccctaaagtgggactgaagagtggtgacagaggtcaacacagaaataataacagccttggtagctttaaaactagcgttaggactcaagtttgttctgccctgtagaatgttgaccttcagcttttatgaaaatgggcaactcagtgacttcattggattgatttggagactcacctgtcttctgcatcccctccccaccacacatcttagttccaagaacctagatatccttcctcttactttattcttccaccagagtcaatttatttccaaaaagcaagaataccttttatgtactagatttttttttcttttttctttacacgaaatctcactctgttgccaggttggagtgtagtggcgcaatcttggctcactgcaacctccgcctcccgggttcaagtgattctcttgcctcagcctcccgagtagctgggactacaggcgcatgccaccacgccgaactaatttttgtatttttagtagagataaggtttcaccatgttggccaggatggtctcgatgtcttgacctcatgatccgcctgcctgggcctcccaaagtgctgggattacagacgtgagccactgcgcccggccttgtactagactttttatttgtcttctgaaataagattgttttttaggc

SEQ ID NO: 120183 - DNA, 1444 bp, Homo sapiens
gagaccagcctggccaacaaggtgaaacgccgtctctactaaaaatacaaaaaaaattagctgggtgtgatggcgggcgcctgtagtcccagcttctcaggaggctgaggcaggagaatcactggaacctgggagatggaggttacagtgaaccaagattgcaccactgcactccagcctgagcagcagagcgagactccgtctcaaaaacaaaacaaaacagagattataattaattacataactgagagagagaaatgttacaaatttagtagcatgggtgattctgcttgcattctactctacaatgtacctgcttttttttcaagagtctcatttcctagttaatttgctgagagagagttctatgtaaattgtaaaattattcttagtatataaattatattcagcatactattaaatacattagttgtttatacatacacattacaatatcattttttgggtgatttctgggatttccaatgaccagccccagtttttcacctaaaggctgacgttagaacttaacctctgcagcccaggcgcggtggctcatgcctgtaatcccagcactttctgaggccaaggtgggtgtatcactaggtcaggagttcaaggccagcttggccaagatggtgaaaccgcatctctactaaagatacaaaataattagccaggtgtggtggcaggcgcctgtaaccccagctactcgggaggctaaggcagagaattgcttgaacctgggaggcggaggttgtggtgagctgagatcgcgccactgcactccagcctgggcaacacagggagactctgtctcaaaaaaaaaaaaaaaaaaaaaaaaaagaacttaacctctgcataagagatttctatgggagcacagtgacagaatatgggatgtgcaaggatggattcagtgaattgatgaagccaaactgggacatgaaggaggatggcatctggagagctgtagaggggtgaaggtggtccatgtgggtgtgtagggattgtgtactttcgatgtccaaagatcctgctgctctccctgcctcttttcctcacgtttctctaccactttcccccacagaacgtgaagctcttggagcaatttgtctgcgcccacacgggtatcatcttctatgctccatacacaggttagcccatcatccctgcaccaccagagagcttttccttgtggcatgccttgtttatgtagttggccaataggtatttgttcagtggctcctgcttatagcctaaaaggtctggctgaaccttttggaaatcttggcttgctgggggctaaagtaattaaatgtggacaaaagaaaacaacaaatacagccaggcgtggtggctcatgcctgtaatcccagcactttgggaggccgaggcggctggatcacctgaggttgggagttcgagaccagcctgaccaaca

SEQ ID NO: 120184 - DNA, 1825 bp, Homo sapiens
gttacattgtcccctgtcctttctcctgagtgtcttactttatcattgtcctgtctccttgttctttgtctttccatccttttccctcctattttacaactgctggtctcaatgccttaggaagttctttatataaatgtctggccctggactacatggcactgctgcataagttagtaaaaagtatacccctctgctagggcagatgcagcttcatagtccttgttcagcactgcacagctttgtaagcaagagccccagcagtatgtcagcccacacttgccctctgggccggtcacctgtttgcagtatacaacatgcataaatgtacctggtggctctgactggtccttccctttataatcctttttcttacttcatctaaaccaccctcctcattgcctcttaaatttcttttcttttttaatcccttaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgctttgggctgtttccgatgaatgccattagcggggggtgggctgagtgatggtcttttcatataagcaattgggtgatgctgtggggagataagtggtcaggcttaagccagccttgcctgtgacgcctgggactagaagccggggatgggcagctgtgccactctgtcaagatgccttgtgggcccccactccacagcatggcccactgttcactgaggggataaaaggttggacagtgagacactgggccaaggaagactacgttgccatggcactcactgccgtgggatgcagggatggaaaggagtggcactgctaggggcacagctggtttggcaagaaaaacgggggccctgtcagttgccaggacgctagggggcaaggtctacaggcggggctcctggaaataaagactccgagaggcggtgcggcgagaggaggggcggaagtgacgtcgtgtggggcgggtccgaccgcgcacaatgggccatggag

SEQ ID NO: 120185 - DNA, 1661 bp, Homo sapiens
ttcctcacaataaccttaagggaggagggagtgtgccaccttgaaaggtgtgacagaagtttgggtttcagaagggtggggtgggaaatcagattggaagactcccaggcaaaggcagggagccttcagtgttaaacctgggttggagttgtggcccaggttcccaggactgactgcctaggacccgctaatttagtgagtatctgactctttatttcttctctttctctagtgttgatctacagcagcaaattatgaccattatagatgaactgggcaaggcttctgccaaggtactggagagtttttagatggagtaaagggaggacctctgtggggatggtatataagggaggcctgggtccttcggagagacttgcagaaagtctgacttaatcttccctgcaggcccagaatctttccgctcctatcactagtgcatcaaggatgcagagtaaccgccatgttgtttatattctcaaagacagttcagcccgaccgtgagtgccacatgctcttccatcccatacttaattccttccttcctcagcccttcccccatctttgactatctcttgcagatagataccactagcctgttcattattttccccgtcctacagggctggaaaaggagccattattggtttcatcaaagttggatacaagaagctctttgtactggtgagtgttattggatgctaggagttcgtataccttggtttctgagaacaaaagtgctggaggttagggggcagcagagatgccggggttcctaaaacatttttattgtttctctcttaggatgatcgtgaggctcataatgaggtagaaccactttgcatcctggacttttacatccatgagtctgtgcaacgccatggccatgggcgagaactcttccagtatatgttgcaggtatcactgacctcttcactggttcatccaaactaggggctcctttgccctgagcccttccagaagccctgcctcccaccccccatgttcccatgtcattctattcccttcccaggcttctggcttcctgttggcatgctttccccatacttcctcctaccctgagtctccttttccctgcagaaggagcgagtggaaccgcaccaactggcaattgaccgaccctcacagaagctgctgaaattcctgaataagcactacaatctggagaccacagtcccacaggttagaggtttcagagaatagatccccactgagcattcccattgaatttatttgttatttatggcaaagaagtagtgacttatttcctatcacataggtttcattttctacaaccaggctctttctttctcttgtggtaccatctctcatcctgtagtgacttctttctcatctattttgatttttttttttgagatggagtctcgccatgctgcccaggctggagtacagtggcgcaatctcagctcactgcaacctccacttcctggtttcaagcgattctcctgcttcagcctcctgagtagctgggactacaggcacccaccaccacacccagctaatttttatatctttagtggagacggagttacaccatactggccaggctggtctcaaactcctgaccttgtgatctgcccgccttggcctcccaaaatgctgggattacaggtgtgagc

SEQ ID NO: 120186 - DNA, 1026 bp, Homo sapiens
tcaagtgatgtgcccacctcagcctcccaaaagtgctgggattacaggtgtgagccaccgcacacaacccttatgcctaatttttttttgagacagagtcgctctgtcacccaggctggagtgcagtggcacgatctcagctcactgcaagctccgcctcccaggttcacggcattctcctgcctcagcctcccgagtagctgggactacaggtgcccaccaccatacccagctaattttttgtatttttagtagagatggggtttcaccgtgttagccaggatggtctagatctcctgaccttgtgatctgcccgcctcggcctcccaaagtgctgggattacaggcgtgagccaccgtgcccgaccccttatgactaattttcaacccaaacatagccagctcattttcacctccttgttttcacatagttcattactcatctggtcagtcagtatttattaagggtccagaataatatgcattccctgtcctcatggagctttggcctaatatagggaaggaagtcttgtttataactaagtgcagcaaaatgttactaatgctacccattcatccaataaacattgagtgcctggcagtgttctgggcactaggaatggtttactcaatgaaacagacaacagcctgggcaacatagcgaaactctgtctctacaaaaaatacaaaaaaaaattagccaggcgtggtggcacgagcctgtagtcccagctacttgggaggctgaaatgggagaatcgcttgagcctgggaggcagaggttgcagtgagccaagatcgcgccactgcattatagcctgggcaacagagagagaccctgtctccaaaaatgaaaacaaaaacagaaaaaaaggccaggtgcggtgcggtggcccatgcccgtaatcccagcactttgggaggctgacgtgggcgaatcacttgaggtcaggagtttgagaccagcctggtcaacatggtaaaaccccgtctctattaaaaatacaaaaattagcggggcatgat

SEQ ID NO: 120187 - DNA, 1102 bp, Homo sapiens
ccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagt

SEQ ID NO: 120188 - DNA, 1044 bp, Homo sapiens
catttttgtaaaccatcccagcactttgggaggccaagatcagcccaggcaacatagtgagaccccaactatacaaaaaattaatggtgcactgtgatgtgtgcctgtagtctcagctacttgggaggctgaggcagtaggactgctttgagccatgatacgccactgcagtccagcctgggcaatagagcaagactctgtttcaatttaagaaaaaaaaataacaacaacaaaagatctatgttggaaagaagggaactccattgatcttttctctctcctaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtgatatgtgaaattctatctcatatagtcagttaaactttattatttacaagttaaattacacagcagctttacacagcatgagatggaaaggaaggaaggagagaaacgaggagaggaagctggctcctgagattcttggctgcctccacctccttctcttgggcgtagcagtcttcagtgctgcctccactccaaggtcaaggatcagggcttggaacacaggtttaagtcaggttctggctctgacagccccagggccaccagggctcccactagcagcttcttcacaggcgttggaggtgagtgtgaaggcatcagctgcagggagaaaggttaatgccagttgggggaggcacacaaatgttctaccctttaccccacccagccctacctaggactcactttatctagacgatggcgacaaatgaggccactggaattcaggtagaaagtggagtaggcatcataggtcctggggaatagagggaggcttactgagggagaaggtg

SEQ ID NO: 120189 - DNA, 1035 bp, Homo sapiens
acaggcatggaatcgctcactgtcacaccctgcagcaaggtcagcctggggatgcatgggagtgggggaggtggagttggcccacagagaaggtccaactcagaagcagggtgggggcttcctagggaaccgggatgagcagtttgcatccttccagatttcttgcataaatactgcctttttcttttccctgaccaaattgtcagccagcctgttcccctttctttccaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttaggtgattgggctacctgagagaggagggaggggctggagtcactgtcctttgaagggactctgttccatccatcacacctctttctagggatccatgacctaatgcactttgatttcctggaccctccaccatatgagacactgctgctggctttggagcagctgtatgctctgggagccctcaaccaccttggggagctcaccacggtgagtcgggggacagcatgggtggaggcaggatgataggggtcaggatggctccagggacccctgtagtagtagcgggaaacctgagggaggactgggctcaactctctctctcttctccttagtctggtcgaaagatggcagagctgccggtggaccccatgctgtccaaaatgatcttagcctctgagaagtaagccctcgcctccacctgggcccccagcacacaaacaggccaggcctcctctgtctccagggtcccctttgtctgtctttttctgttcatcatactatcccttaacacataataaagtattagataactctgattgcccccttttgaggcccacaagggtaagacacttgatcctatccttgattccactgcgcccggccccttgaggaacttacttgttcctaaggtttccaactaga

SEQ ID NO: 120190 - DNA, 1955 bp, Homo sapiens
gactctgtctcaaaaaagaaaaataaataaagtccaaactttcctgtcatcaaaggccctccctaatcttagccccaaattgtttttagccttgtctcctactccttcaccacatgaacctcccactaagcctactagctcacactctgacctcaaacataccttgggccttcctctgatgacttctcagccatttttcttttttgagatggagtctcgcattgtcacccaggctggagtgcagtggcacaatctcagctcactgcaacctcctcctcctgggttcaagcgattctcatgactcagcctcctaaacaggtgggattataggcgcacgccaccatgccctgctgatttttgtattttcagtggaggcagggtttcaccacgttaggcagcctggtttcgaactactgacctcaagtgatccgcccacctcagcctccgaaagtcctgggattacaggcgtgagccaccgcacctgacctcagacatttctcttaaaggtccatatcaaatcccacctcttagcacatcaaggacttcccttctccactgaatctactgtgcatactttccagatcacatatttggctctctcttggttcacaccatatttctcctctcttcagtcccaggaacaagggactggctgctcctcagctgtgtgcagcagtgcgcaggactcaccttgcatggggcaggcacacagctttttcactactagttgtgggaagcataggggtgaagagtgtgggtttctccaactgacctttcgtgccccaggtggtgtgggctggaagatacgggcctgcatgtcagagggcagattggcataaatgggcagcaccaggagctcccggattttggagcccaggcggcggcagcgatcctggagcatctcacaggcagcctcaatctcctcctggatagagggtagggagagcagcaggggtcccagagtcacagaaggccaacatgccggccctgtcttcccctgggatacatcatcccctctccccaccatgtcaggcacctgtcctgtcaggaacaccaggatatccccagggggctgggtcacatggatctgcaacacagatactacacaagcttccaagtagtcagcctctggagcctggagagcagaaagagatggggtcacaggagggccacctgcttaggcaaacctttcctctcctcccaattcaacatacactttatcctagttcccctttgaaccttccattccatctttccctccacaggataaccttctccaaaggcctcagcttttctgccacagacttaagcccatcctccctgagggggcaccttggtgtagaagatgtccacaggaaacctgcgtccggggattcgaaacacaggggcgtcatcaaagaaggtggaaaaacgggcagtgtccattgtggctgaagccaccaggaccttgagctcaggtcggaagcgagcaacatccttgatcaatccaaagagaatgtctgtgtgtagggtcctttcgtgtgcctcatccaccatcaccacgctggggagggaataggagagcaatgagggaagagcgctaggcaatgcagtatcagacaccagagttaactggatgagaggggagtaatggacacaaagagttcaagaatgactgttgacggagggggctctaaggagaagtcagccatcccacttatgtagagcaacagaaagtcagagaaggccagggccccatgatctgcaacctatcccagcctcagcagataataggagacaagatgtagaggctgcacactgaggccaggacaagttagccataccctctagttcagtcaagagtctgcttagactcagcagctgctcttactagaaaaagttgaaggatatgttttaggctgggcatggtggtagctcacgcctgtaatcccagcaccttgggaggccgaggcagg

SEQ ID NO: 120191 - DNA, 1068 bp, Homo sapiens
caatttgtgtgggggggaagggtgggcagaaggcagaggctctcactcattctctaacattattgccccctctcccacagatgagtcctgccggcggtgaccatcttccaacatagggatatacctccctccttcttataactgaagatcctggagcccggaagattcagggcagacagaccctgataatgagcctggcagggaagggcaaccaacatcttgtaacttgctttccccaccctgtttctgggggcagagccaattgcccaatttctaccctaatccaaagtccctggtgtgggtggggttaaacgtgctggtgcatcctaggtcatccaagagtgagcgccaagtcctgagaaggggcacagaactccctggagggtggagatggagcacctgccccccatggcagggtacactctccccacagccttcctccccaccatcccgtggggactctcgggatttaagcactcgtctctctgggaggcccagaccccactccatttataggcacatctccttcatttcctaggtcactgcccctttgtttacagctcctgcctcctcccttgaccacagcctggtttacaaattccatcagctcccagccccacctgccaaagtcccaggtttacaagccacgcttacttgctgtgtctgcgtggaattctctcctctgtcccctccagtctcctcattggagtgacctgaaggtgtggcttcctccactttttctcagtattactttgccttagttttccccaagagggaaggctggaactcttaactctgtaccccttgatagttatttaattctgtttctcctagtggttcacaattgaactgaattgagatggtgtcgggtggctaaggagacacctcacctctccttccccattgtgccgcctttatcaattgcctgttttgttttgtttgttttttaactttccataataaaatggagttctcttcaactcgtctgcttctccttctttgggaaaaaaaaagggtatgtgaggggaggctctggtggctgggggagaggaaaatgatgggggatga

SEQ ID NO: 120192 - DNA, 1002 bp, Homo sapiens
acatttctctcttctccctcacgccaactttccttttcgcccttctctctctttctcacatcctagagacggtctttaatacgcattaaccctgtgctgccacatctggctcctgccctcattgcctccaatccggactcttcctctcacatcacccccaccacccccaacttgggctcacaacttctcttcactttttccatttccccagttctctgccttccgtctttccctctgtcctcatccttagcccctctgccctgctttgtgtcccacctctccccctccacttcctctcctcccaccctcagtctcacccccgggctgtctcactctctggagcctctccttcctgttctctgtccccagtgctccctaccctcacctcaagacgaccatggccaccatcccagactggaagctacagctgctagcccggcgccggcaggaggaggcgtccgttcgaggccgagagaaagcagaacgggagcgcctgtcccagatgccagcctggaaacgagggctcctggagcgccgccgggccaagcttgggctgtcccctggggagcctagccctgtgctagggactgtagaggctggacctccagacccggatgagtctgcggtccttctggaggccatcgggccagtgcaccagaaccgattcatccggcaggagcggcagcagcagcagcagcaacaacaacggagtgaagagctgctagcagagagaaagcctgggcctctggaggcccgggagcggagacccagccctggggagatgcgggatcagagccccaagggaagagagtcaagagaagagagactaagtccgagggagaccagagagaggaggctggggatagggggagcccaagagttgagcctgaggcctctggaggctcgggactggaggcaaagcccaggagaggtgggagacaggagctcccgactgtcagaggcatggaaatggaggctgagtcctggagaaactccagagcg

SEQ ID NO: 120193 - DNA, 1050 bp, Homo sapiens
ggccacctgggtgccgctcctctgctttgtgctccatgtcatctcctggctcctcatctttagcatccttctcgtctttgactatgctgagctcatgggcctcaaacaggtgaggctccgagatccctacctatgacctctgacccattttagaactcctcgttccctttcaagggtttccctcctcccatgctcttctactgtctccctgcttctccctcgtggcccttccctttgactttccctcgtaagggcagcaagcatgggcctcctgggcctggggaaggtacatggatcagaagtcaggatcagggatccaagtctcagaaggggggttcctgggcctgagttctagaagggtggtgcctggaagaggaggaaagaagtgcccaagatgagaaaagggcttgactccatttctaagctcttctccctctcttaggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggca

SEQ ID NO: 120194 - DNA, 1011 bp, Homo sapiens
tatttcttttttttttttctttttttttttcttttgagatggagtcttgctctgtagcccaggctggagtgcagtggcgcgatctcggctcactgcaagctccgcctcctgggttttcacgccattctcctgccccagcctcccgagtagctgggacgacaggcacccgtcagcgcgcccggctaatttttttttttttttttttttgtatttttagtagagacagggtttcaccgtggtcttgatctcctgacctcgtgatccacccgcctcagcctcccaaagtgctgtgtaattacaggcatgagccactgcgcccggcctagcaagagtatttcatagacagtatgcggtgtgcttcacttggcttcatattaggaggtattattttagtgatggtaagactggttagtgggtcctgaacccatttctaggattctttttcacctgattttgcctttgctctgtcttccccagcctcagagagttgtgatcacatgccctcaggacttccctcattgctccattccactacgggttgggctgcccctcctctcgcctgagttcctgctgactggagtgctgaagcaggaagccaagccagaggcctttgtcctctcccctttggagatgtcatccacctgagaactccactacccttttccctcccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattg

SEQ ID NO: 120195 - DNA, 2831 bp, Homo sapiens
acatctcaggttactaggggaagaaaaagtagatcctctgtcaagacccctgaaacagttgtgcccacagcccttgagctccagccttccacctccaccgaccgacctgtcacctctgaacccacctctcaggctactaggggaagaaaaaatagatcctctgtcaagacccctgaaccagttgtccccacagcccctgagctccagccttccacctccacagaccagcctgtcacttctgagcccacatatcaggctactaggggaagaaaaaatagatcctctgtcaagacccctgaaccagttgtgcccacagcccctgagctccggccttccacctccacagaccgacctgtcacccccaagcccacatctcggaccactaggagcaggacaaatatgtcctctgtcaagacccctgaaacagttgtccccacagcccctgagctccagatttccacctccacagaccaacctgtcacccctaagcccacatctcggaccactaggagcaggacaaatatgtcctctgtgaagaaccctgaatcaactgtccctatagcccctgagctcccaccttccacctccacagagcagcctgtcacccctgagcccacatctcgggctactaggggaagaaaaaatagatcctctggcaagacccctgaaacacttgtccccacagcccctaagctcgagccttccacttccacagaccaacctgtcactcctgagcccacatctcaggccaccaggggcaggacaaataggtcctctgtgaagacccctgaaacagttgtccccacagcccctgagctccagccttccacctccacagaccagcctgttacccctgagcctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatggattcaccaccacatcaaaaacagccccaaagaggggaagtctcccagaagacagtgattatcaaggaagaggaagaagatactgcagagaagccagggaaggaagaggtgaggagagggttgggaccacaaagctgggaaaaatgacttcagggctctgaaactcccaccaagatttttctcaatctcaggatgtcgtgactccaaaaccaggcaagagaaagagagaccaggcagaggaggagcccaacagaataccaagccgcagcctccgacggaccaaacttaaccaagaatcaacagcccccaaagtaagagacaaaggcatgggactttgtgggagacagagatgaggggaggatgcaaggagacctagaggattgtagagatgggtgctgatggcatgggttgccgtaaccacctcaggtcaacccttccacaggtgctcttcacaggagtggtggatgctcggggagagcgggctgtgctggcactggggggaagtctggctggttcagcggcagaggcttcccacctggtcactgatcgcatccgccggacagtcaagttcctgtgtgccctggggcggggaatccccattctgtccctggactggctgcatcaggtgagaggccaagggatgatgacagaccgatatagtggcaagactgctcatatagtgccctagaaagtggtggaagggaagaggcgttacaggaagacaggggcattggtgagccagaagcctgcattgatttaaaagacattttgtgagctctctctaaatgctaggcagcagagctgattgaggggctgggctgagctttgatgctgactgctgccgtccttagtcccgcaaggctggtttcttcttacccccggatgaatatgtggtgaccgaccctgagcaagagaagaacttt

SEQ ID NO: 120196 - DNA, 1178 bp, Homo sapiens
aacgttaaatgttataactaccacccttattcccagcttacctttaataacctgttcagatttattattcatgagtttatctaaatcctttctcatcatatttattatgtcaacctgtacttccctttccctcttcctctccctcttttctctccctctccctctctctctcttccttcctccccttccaggtaccctagatgaaccatgggaggtcctggctacacagccattctgtctgagagagtctgaggactctgagacccagccttttgacacgcaccttgaggcctatggaccttgcctgtctccacctagggcaataccaggagaccaacatccagagagcccagttcacacagagccaatggggattcaaggcagagggaggcagactgtggataaagtcatgggtataccaaaagaaacagcagagagggtgggccctgagagagggccattggagagagaaactgagaaactgctaccagaaagacagacagatgtgacaggagaggaagaattaaccaaggggaaacaggacagagaacaaaaacagttgttagctagagacacccagagacaagaatctgacaaaaatggggaaagtgcaagtcctgaaagagatagggagagtttgaaggtagaaattgagacatctgaggaaatacaagagaaacaagtacagaagcagacccttccaagcaaagcatttgagagagaagtagagagaccagtagcaaacagagagtgcgatccagccgagttagaagagaaggtgcccaaagtgatcctggagagagatacacagagaggggagccagagggagggagccaggaccagaaagggcaggcctccagcccaacaccagagcctggggtgggggcgggggaccttccgggacctacctcagcccccgtaccttctgggagccagtcaggtggaaggggatccccagtgagccccaggaggcatcagaaaggtaagtgaaggcagaggggaacccaaggtgatacacaggcctcgtgataatcaacccctgggcaaccagctgcttggaactcagccacctttgtgtttactttctgtctaggcctcctgaattgcaagatgccacctgctgagaaggcttccaggatcagagctgctgagaaggtttccagggtgagagctactt

SEQ ID NO: 120197 - DNA, 1844 bp, Homo sapiens
gaaccccagacttctcaattcctgtacccccaagaactgctcactttttgtacaaaaacctcaggcatagaggaaaggaatcttgcgcaaggtcgtttttcatttacaaaacaaaaaccccatgaaaaccaaaccggtacccacccattcgtcacttcattttgcagcatggacaacaataggggactacaactcccaaagaggactgcgctcgtccactggctcagaggccaatggacgcctggtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaaggtaagaattttacacctcttttatttctttttacaaggaaaaatccaggtaagttatgaaaaaatggttgtggggcatttgcacccgctatccttaatcaagatttgcccctctcaagtttgttacatttatatatataacaattgtagctagcatttgcctttggaaagctgggaatcatttttcttggcaggcacattttggagaaactagtaaaagggctcttcgggtttgggggcgggaagaccgaggacttataagatgttacttaaaagggcttctaacggtccgagaaccgggcagggagagagatgcggaaacggtcgcagacaaagcggggcgaggttttgcccatgtgcatcccgcccaacccccctgcggggtacttagggccaaaccggagcgggaaggggtgaggccatcgggcggctgcagagagctccagcgcaagggtggggggcgatgcgccagggtgggctgcgctgggcgctacctttcacaaaagaccagggaccccaacgcgcccgcgaccccagagggccggtcctgtatttgttcctgggtggaaggagaataagaacgggattaattttacttgctttcatggcccctaagagagacttttttagggcgtgaacagatatgtcgagaaaatgggggtgtgtggttttctttaatgagtccctcaggacttaatgggagagaaagaatcctttaaatcaaggggtagaaatgtagcgaaggaataaaaattccgaggccaagggggattttttttttttgcgcgcggttacagtgtagcgggggaggggcgggaggaagtgcggctgctacgttgtagcagaagggcggggccctgcggggcggggccggggcgccgtgggcgcgcggggacaatgcggcgttgcccgccggcaggggcgcgctaccttgggccccgcccctcgcgcgcggaatttttgtccctggccccgcccacgcgcgaagtcttttgtcggcggctcgacctgcgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcg

SEQ ID NO: 120198 - DNA, 3795 bp, Homo sapiens
gatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatggtgaaacccgtctctactaaaaatacaaaaagtagctgggcgtgttggtgcgcgcctatagtcccagctactccgggggctgaggcaggagaatcgcttgaacccgggaagcagaggttgcagtgagccgagatagcgccactgcactccagcctggtgacagagcgagactccgtctcaaaaaaaattaagaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctttactgtagtct

SEQ ID NO: 120199 - DNA, 1056 bp, Homo sapiens
ttcccaatatccagttggttgaatccgtaggacagggactcaatattaagtgtcaatttaaggagagcagtgcaactgaactcaggccccatgcctccatcagccagccgtgtttccctaaataagcacacatctcgcagcttttttcaattcccatttatttttggctcttggggcgatgtcatcttttcaatatgaaaaaaagcagcaagttcaacataaaatagaaatctcaaatgtaggatagaacaaaaccaagtgtgtgaggggggaagcaacagcaaaaggaagaaatgagatgttgcaaaaaagatggaggagggttcccctctcctctggggactgactcaaacactgatgtggcagtatacaccactccagagtcaggggtgttcattcttttttgggagtaagaaaaggtggggattaagaagacgtttctggaggcttagggaccaaggctggtctctttcccccctcccaacccccttgatccctttctctgatcaggggaaaggagctgagtgagggaggtagagttggaaagggaaggattccacttgacagagtgggacagactcctccagagtagagcttggagggagattgaaagtggagataatactgctgacacctcccttgaagctgagatgggaaatggacatacttagaaatttagtgactttaatagcctggatttccctctccaaaacttttagaatggaaaatcccatccccttccttatatagtgacttctacccactaccttctaccattttctactttgggcttaggatgatggccattatctacatgtgttttcagcacctggttggttctaaatgggatctggagacccagcttcttggagatttttaagaggaagtattaactggacaaatggaatgggcaccagaaagaaatacagggtcacccagaatggcagaaacctaggtttcccagagtggaaagagagaggagacattcaacaaacaagtatttattgagcgcctactatgtgccaggcactgttctagaccccccccagaagaaaa

SEQ ID NO: 120200 - DNA, 2066 bp, Homo sapiens
gcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctgcgaggtagagggttgggggttggtgggctgtcacggagcgactgtcgagatcgcctagtatgttctgtgaacacaaataaaattgatttactgtctgcagtcttgagtgtatctttgcaagcgccgactccccactcctcccggccttcagatggcaaggaccggcgggaggcgccgtggccgagtccccagcccgcgcacctccctgggcccaggagccccttttcctggagtcacagaacccagcatccggttgccggatgtagtctttcattgcccagtctgcggttttcccaggtagttgccccgcggcgaatccgagatgtggcaatcacccttacgccagggtgccaggcggaggtcaagtccctcacccgggggcggagcgtggcgcggcgtgggcgggattcccggctcaagaagggcggtgactggggcggcagggatgtggccctccccgggctaaccaggcagcccggctgggcccgagagccagcgggcgggcgggctgcggactctagcggggcctgccgggaaaggggcgggccgagcgcactgggccgaggcggggcgaagtgggggtgcttagtccgttgcggggggcggggtcgcgtctgccgcagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaaggtctgcaggcctctgggcgcgggggacctttatcaaagggagcggcgaggggaagggagggaccatacgcaggcggagaagaggtagctggggatcttaaggattttgtagggaaaagccttagcggacccatgggtgtagaagggacgggccgtggcggatgcagactgggagggcctgacgggaaagggaaaggatgggcccctgtggacgccacagcgcgccttccccatccgcaaaggctttccctccctctcctccagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgctgtcccctcacccccgccagttcctcagtcttccacattcaagctctgccaccgttcctcactgccccacaccttgcagggttctgccgaagccccccagtcatggtggctggagggcgtgtctttgtcctgccctgcatccaacagatcc

SEQ ID NO: 120201 - DNA, 1026 bp, Homo sapiens
cctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccaggtattgctgatggtccagggaccaccctgggcctagagggctataggggacagtaagactagaaggtgctggggtcccctctgcccttctcttagaattctggactcctatgtgggagggcagcagggtgagctggtccaggcttatctgatgtttaattctatcatatcctcaacaaggaattgcccaacctttcctgggacatatttattttttaaaagtcaaaatgattttcatattcttttacatatcttatgattttacataaatgcatttatgttacaagatttagaaaaatagtacaatcaacctgtctttttaaatttgcttttcttttgccccgttcatgttaactcttgttatattgtattctattgttatattctattatatattctctccttctagacgtacacacaggtatatatacaaacatgggtgcttgtttattctattttcaaaaggtgggatattttttatacttctgttgcttgcttttcatattcaacagatatacatggaaatcacacaaagttaggaata

SEQ ID NO: 120202 - DNA, 1602 bp, Homo sapiens
ttagagcatgtaaatcagatacgtcacacctagctgacacccccatgctggctttccactctgccagaacaaaagctgagtccctagctggtgcaggatgctcagcctgacctggctcctgcctgcatcacttgtttcttggcgcctccttggccacgctgcctttcttcttgttgctggaacaagccagggctcgttcccacagcttctggacattttctctgtgcctgcaaagctcctcccctaaataaccacaggctctccctcactccattcagttctctgccaggtgtcacctccttagagagccttttctggccacccacctcactgctctgtccatacttcctgcctcttgttcttcgcagctgttttccctgctgggatctcagtcctacaagggtggggagtgacgttcaccactgagaacgcgcctggcacagagcgggcactcagccaacttctgctgaatgaacagagggaatgggctgaaatgaaggggaagctgaggcaggggtgcagggctgtgaggattggggagaatctgggcacaatgggatgataggcttggagacaaatggatggagccaggcaaggagaagagggcagctgagcctgaagtctgaggatggaacatcagagctgcgacagagccagaggtctcagctgcagatcttcatttcacccatgcctggctgcgccccacagtgctgtgtgctcggtgccacccctcatgggtctctaagtggccactgtgggctgggccagggagcagctggtgggtgggaagtaagatctgacctggactccatcccacccaccccctgtttcctggcccacaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatgggggatggagccttagtgcctctgacccccatcctctcaccctgccccagatggactcctgtcttacaccgcccctgtggggcagacaatgtatttatctgaggccgtgtacctcaacgactccacctatgacggacataccgtgggcgggtaagaaaggcccctgcaggatatggagtttggggtgggagggaggactgtgtgtgtgtgtgtgtgtgtgtgtgtgtgagagtgtgtgtgtgtaggggggctggtaagtagggtggggagtgagatggaagagctgagaagagggatgggttaggtggggcctcaaagggtagcactagggtgaccactagcccgtatgacactgtatgaaaaaggcacccctttgctaacacacattgttggaaattgctgc

SEQ ID NO: 120203 - DNA, 1108 bp, Homo sapiens
gggccttgctcagaattcccccaggggatctcctcctctcccctcgcttcagcctggaggaaaagaggggagcgtgggggtgggaagggagagaggttccaggagggcctgggataaggaatgtgtgacaagttaacccaggaacatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagggaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagag

SEQ ID NO: 120204 - DNA, 1066 bp, Homo sapiens
actaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttc

SEQ ID NO: 120205 - DNA, 1033 bp, Homo sapiens
tgagtcaccgcgcccggcctggagtgtgtattatcccaattttatggggagtaattgtgctcactcggctcaccaccaagtcgccagagcgcgcctccgcaaggaagccctccaggcacttctactttcccggacccgcctcccgctccagccggttacacgcgccgttagcagcgtgggcggagttggttctgccttcgcggaaccaactggtccagcttctggtgtctcccctcgctcaattaaaagccagctcctctcctttcggcttccccacggtgcctttcgggatttgtagtcagacgcgcttcagccggctctaaggagagcaaaggcaagactccaattcccagcatcccccgcgcccggagagtgcagcgtctattctcatcctcttcacttttccactcctccccttacctcccttctcttctgaattctccattctgggctcttgcctgtgaaatctttctttgctttccccatcttttcctcgcattttttcaccatctttccctcaatctccaggagccaatgcgagactttggctccgattaagcgacggcccgagactcggggtgcgcgaggaggatcgacagagtggtgaggggacctaggagggcgggagtggcagaggtatgagagagagagaggtgagtgggaggcgaagagtgagaggaaggcagggagaagctaggagatcggaaggcgtgggtcagggtgaatgacgtgaagtagacttgggaagggaaaagaggtggctttagatttgggaagcatggaggggagaggttaccgccgtacttagcagaagtgggctaagagatagaagataggaaggacgggcagatttggagcttgtagactggtctgaccaggatgggatggaagagagaggtgtgggctcaattttctttgtccctgtttagccaaagatgagacaagtcattgaaatacaaaatgatcttgcaaacactggacagttaacaattctgtcacttggtaattgagggaagactggagttgaagggca

SEQ ID NO: 120206 - DNA, 1072 bp, Homo sapiens
taaagttatgatagctagcagtgcggtcccgggcgcctccccgtggggtttgccttcgcggcggactcgctcctctggtctacagcctttggaccggtagggagagggtggggccaaagccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggcgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaaggttaggggtcagacagcttgtccttgggtttctgagacttgagaggggctggaggagaccggctgaaatgcagtctggggtatactggatcccagcctcttctgctttctcttctcagtca

SEQ ID NO: 120207 - DNA, 1049 bp, Homo sapiens
acatttggtggagtttctaagccttatgtgtgtggatattatatatgcattagaatattcgtgtgtgtgtgtgtgtgtgtgtgtatttatatatatatatatattttctttctctttacttaccccaatttctcttgtctaaatctcaccttcttccactcgcccattcccacctttcaattcccatggaattaccctcattcttctgggtctgttatctcatgccatctctgtgaagcatccttggatttcccacaatatggctatccctcctctcttcctatagaatcttttgcctcttttaatatcttagaaaaccccatactgggtttgtaagtccatttctattagcctctagaggctagatcaatgccatcctcacttgattttcctccaacacctggcattgctgggggcatcgctgggcctggtacataggaagtgcttgggaagtgtttgctgacaaggatctctctgggcacaggaaaggtggagagatctgtgagcagctgcgagctctgggtgcctccctggactgggatcgagagtgttttaccatggatgttgtgagtgttctgtgccttggtccctgtgagtgatgggcgatgtttagggatctgtgtggggcagggaggaagcaatgcctgggtccctgagcagggtgatgggctgagaagtggctcttagaggtggacactcaggtcattccagggctcctcagtggctgtgactgaagcttttgtgcggctctacaaggcggggttgctgtaccggaaccatcagcttgtcaactggtcatgtgctttaagatcagccatctcggacattgaggtgaggcggagagagggaagcaggtttgtgagagctctgaggcagagtggtcaatgattaagagctcagactctggagccagggtgcctggattcaaatctgatgcctgcctgttacagctgtgtggcttttggcaggccgtttagtctctttaagcctcagcttcctcagtctgtaaattagagatgatggaatgcttgcatcgtgggggtgttgta

SEQ ID NO: 120208 - DNA, 1024 bp, Homo sapiens
aactggcagcactggttttcccatattgggtaagggtagggtaaggggagctcttgtggagatggggaggggggactgactggttattctaagacttcacgaatgtcctcccggcagggactggtgtgtctcccggcagctgtggtggggccatcagattccagcctacctggttgtagaggaccatgcgcaggtgggtaggaagaagcacccggagggccgagtgtggcacagagcacctagcccaggagtcagagctccgcagggccaagtcccgctcctgcctggtcatgtgcttcatgctcatagtcatgtaaccttctgcgcgatcaaggctccctgaagtggcatttctttatctcacccctgggggaacctggccactctaagaccacatgaggacgtgaaaaccaagtgacatttacacctgtcagctgttcttcctcactctccccaaccccttcctacttttgcagggagaagaggactgttgggtggttgggcggtcagaggctgaggccagagaggtagcagcggaactgacagggaggccaggggcagagctgaccctggagaggggtgagtgcctgagctggggagggatgtacaggggagcgggggcctgggcatctgggcctttgaggggaacagatcccaagatacagaaggtagggtcaggaaagttgggaatggagccaaaggggacagccctggtctctgggggtgggggttggcctagaatggtggcagcagtggtctgaggtcctagaagccaaggttccaactgtccccattctttttctgtttcccagatcctgatgtcctagacacatggttttcttctgccctgttccccttttctgccctgggctggccccaagaggtgaggtgggttgagagggcgaaagtgaaggggaaacgataaggaagggatggctgggcccccacagaggcttgaggggggcctggggcctgggcctcttactgctcctcttccccctagaccccagaccttgctcgtttc

SEQ ID NO: 120209 - DNA, 1041 bp, Homo sapiens
gaaacccccctctgttgacccctccctgcccccaggtgcttcttcatcccatggttcgggacaggcagggccggaagatgagcaagtccctggggaatgtgctggacccaagagacatcatcagtggggtggagatgcaggtgaggacgaagcacccactagagggacaaggtttgcagggtttgcaggagagaggaaggcaggctgagggaggagtgaggccagcaggtgtgacccttatagaggcagggccttcgacctgggtcgtgaattgcccccttccatccccaggtgctgcaggaaaagctgagaagcggaaatttggaccctgcagagctggccattgtggctgcagcacaggtgagtcatcgctgcctgccccccaccagctctagctcaccacctctggcttcctctgcaacccaggtcctggccctgcagccacaaaggcatctgccacccttcttcttcctctggttgcagaaaaaggactttcctcacgggatccctgagtgtgggacagatgccctgagattcacactctgctcccatggagttcagggtaagcctgggcgaggggtgtcggggtgagcagagggcagcgggcacctgtgcaggggcagggcaggggcaggacttctggtgctgctgccacctacatgcagactacctcgattcttcccttccagcgggcgacttgcacctgtcagtctctgaggtccagagctgccgacatttctgcaacaagatctggaatgctcttcgctttatcctcaatgctttaggggagaaatttgtgccacagcctgctgaggaggtaagagaaaacagaggtgcttgggagtagggtagtcaggtgtcagagggccaaggtggcatctggaaggaaaggaggcaggggagggggagtcaggccatcctgccccctctgcctgcagctgtctccctcctccccgatggatgcctggatcctgagccgccttgccctggctgcccaggagtgtgagcggggcttcctcacccgagagctctcgctcgtca

SEQ ID NO: 120210 - DNA, 1019 bp, Homo sapiens
gggatctcggaatctttgctagaggccaatgtagtcacagactgcagtggttcctgaggttatgatggaagccagagtgatctcagagcctgtggtggtttcaggcgctttgataaagactgcagtaggcacagatactatcttggagagagtggtgctcttggaggctatggtagagtccatggtgggcacagacttggtcacggagtctatagtattctgatagagtgtggtggaggctgtggtggacacagacgctgtagtggtcttagcaggcattacggtggctgtggagaacccagactgtgtggttgtcacaggagctttggtggagaccacagcagtctcagaacctgtggtcatggctgtggtcatggctgtagtcacttcagtggcagaggtggaagctctggtggtctcagagcctgtgctgctttcagaggctgtagcgaagactgtggtgggcacagatgatactgtgtggtgtccggtgttctcagagcctgtggtagaggttgtggtgggcacagatgctgtggtggtctcagcaggtgttggaggggctgtagagggcgcagactctacagttgtcccagaggcttttgtggagattgcagtggtcgcagagtctgtggtggaggctgtggggatctcagagcctgcggtgattttagaggttgtggtgaagactgtggtgggcagagatgttatcgtagaggtcgtggcggtcttggaagctgtggtcatggttttagaggctgtgttgggagctgtggaaggtgtagatgttatcacagagggtgtgttgttcttggggactgtggcggacacagatgctgtggtggtgtcagtaggtgttttggtggctgtgtggggcacagactctgcagctatcacagaggtttgagtggagactgtggtgtcctcggaggctgtgatggcagcaatggtagtttcagacatggtggcctcacaggctgttgtgttcttagagcctgaggtggaagctgtggtgggca

SEQ ID NO: 120211 - DNA, 1106 bp, Homo sapiens
atctgcccatctcggcctcccaaagtgctgggattacaggcgtgagccaccgtgcccaggcttttttaaaaaaattaattaattttttggtagagacaggttttcaccatgttgcccaggctggtctcgaactcctgagctcaagtgatccaccctgccttagcctcccaaagtgctggattataggtgtaaaccaccatgcccagccctggacaagttccttaacctctttgtgcctcattttcctttactgtaaatgaggataatattagtaccacctacattcaatacacttaaaatagggcctggctcataacagtaagcactagatgaatgttggctactatagtctaataaccataacactcctacagctgactttaccaagaggcagtggcaaaactcaaatgtgaatctaggctttctgaggctaactgcctcaagtcacggagaaagacatgcccagattattaaaaacattattcaacatagaactgccctaacccaggaacagagtgcctcagcaaagctggaaactgaatcaagtctaaacttggcctctagtggcctcagaacatccccactgtgatatctttctgatgatatcccaggtcctgtatgagctaaacgggaccaaaaagggtcagtctggcagagagcttctgactgtgcacacttctggtgggaagatgaaggtctggaccacgaccatccatccaatctgatgggagtatgggaggcaggcagcagggtcttgtggagaccttactcattccagcctggcgcttcaaccacccaggggcaaagctgccctgcttaatgctcaccttggctgctgtggtcttccaggctgaccctccagtcatcaccccggggctcggcatgcagttcggcgtggatcccagagatgaggccaggctcctgctggggccgcagggccacatcacacaggtcggccctgtggcccaagcgataggtgcagccagccccggcgggggggtggaaggtgtagagatcaccgcccctgccgccccctatgcgcagcagttggaagcagggcagcatgggcggtgccccctctgcaccacctcttccacttcaggcat

SEQ ID NO: 120212 - DNA, 1157 bp, Homo sapiens
gcctggccaacatggtaaaaccctgtctctgctaaaaataaaaaaattagccagacgtggtggcacatgcctgtaatcccagctactcaggaggctgaggcaggagaattgcttgaacctgggaggcggagtgcagtgagctgagattgcactactgcactccagcttgggcaatagagcaaaactccatctcaaaaaaaaaaaaaaagaaagaaagaaaaaaaaagaagaaagaaagaaaattggaccttaggacagtgagggcagggatcctttgtaggaaagcacaagaaacacagacttgttcctagctgacaaggagtgtactgcctggtacctgtcacctgctgaggggcttaggatgtgagggagaatctgactacagtttcatattcttccccagaaatcatacagatttctccactcctgactctggtcatttctgtttttgtcctccatatttgcctggtgccccaccatcaacaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactgggtaagtggagtcctcacttggccctctcagtgttttactgcttttcgattccttgtatccctaggctgtgaggaggtccccctgcctggggggatgggcacgggaggtggaa

SEQ ID NO: 120213 - DNA, 1041 bp, Homo sapiens
agcctgaaagttccccatccttaggcactagaagaatggggttaaagccatatgaatgtaaaaagcaggacatgctcactccggttgttttataagcactgccccaccccacctctcatgttctcctgcacatatttttcttttcctatcagagctaacccaggtcttgccattccatctattccacctcccgtgcccatccccccaggcagggggacctcctcacagcctagggatacaaggaatcgaaaagcagtaaaacactgagagggccaagtgaggactccacttacccagtgggagtcagtggggctttgtctacacggagtttcttcctgggctccataaggaccggtggcgggttctcaggaggctcactctcatcatccagttccgccaacactcggtgaacagatttcctccgattgcgttgtggtggagcagaaggcgtggtccccatttccccaggtggggcgggaacaggcaggctctttggtccaccccaactaggggagaaggtgaggggctggggccggagcttgctgaggctgcctatggagtttaggatcagtgtggccttgggggcaggggagaaggtgctgagaggccgctgtggagccccctgggagggcagcataggccggaaaccagccccaacccgggcttctcccctagaccgtgggatggtaatggcagcaaagtcctgaggcttgactcgtacttgttggaacatgaagtagaactccgaggggctggttcctgggggcccttcagggccaaaggtcaggaggtctccatcactcaattccagcctgtgacctcttgggagtcggacattattgaccaaagtacctgttgatggtggggcaccaggcaaatatggaggacaaaaacagaaatgaccagagtcaggagtggagaaatctgtatgatttctggggaagaatatgaaactgtagtcagattctccctcacatcctaagcccctcagcaggtgacaggtaccaggcagtacactccttgtcagctaggaacaagtct

SEQ ID NO: 120214 - DNA, 2219 bp, Homo sapiens
aggtgcgtgccaccgtgcccagctaatttttgtgtttttagtagagacggggtttcaccatgttggccatgctggtcttgaactcctgacctcgtgatctgcccacctcggcctcccaaagtgctggaattataggcgtgagccaccgcgcccagcaaagaacttctaaccttcataacctgacaggtgttctcgaggccagggtctctctttctgtcctttcacgatgctctgcatcccttggatgtgccagtttctgggggaagagtagtcctttgttacatgcatgagtcagtgaacagggaatgggtgaatgacatttgtgggtaggttatttctagaagttaggtgggcagcttggaaggcagaggcacttctacagactattccttggggccacacgtaggttcttgaatcccgaatggaaaggggagattgataactggtgtgtttatgttcttacaagtcttctgccttttaaaatccagtcccaggacatcaaagctctgcagaaagaactcgagcaatttgccaagctcctgaagcagaagaggatcaccctgggatatacacaggccgatgtggggctcaccctgggggttctatttggtgggttcccctctgcagattctgaccgcatctcccctctaaggagtatccctgaacctagtggggaggggcaggggcagactaccctcacccatgaagaggagtagggagagggagaagatgctttgagctccctctgggaagaggtggtaagcttggatctcagggtcacaagggccctgcgtgctccctcactttgcttctcttttgactggcctcccccagggaaggtattcagccaaacgaccatctgccgctttgaggctctgcagcttagcttcaagaacatgtgtaagctgcggcccttgctgcagaagtgggtggaggaagctgacaacaatgaaaatcttcaggaggtaagggtgggagggggatacccggggaccttccctttcttggcctaatttccattgcttccatcactggctcgtagctctccgtctttggtgcagtggttctcagtgggatggagtgaaattcctcagttctgctgggataaggtccagagccaacccttccaggatcctgccttttcacaccaccacctggctctgctgacacatctagtcacagacccctgtgatgctgttactcagcaagtccaaagcttgcccttgtcacccccttcccacctgcacagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtgagtgccatgtctctctgcgggctccatctctttcccctgtcaccacctcgctttccctagctctggctcctccaactgctctagggctgttggctttggacagaatgtccaagcagtcaggcctgtctcagctcattctctaatgtcctcctctaactgctctagggctgttggctttggatagaatgtccaagcagagtcaggcccgtctcagctcattgtctaatgtcattctcctttctgtcattcacttgcaggtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttatcttggtttgtccttcagtt

SEQ ID NO: 120215 - DNA, 2040 bp, Homo sapiens
aaggccccatctctactaaaaataaaaaaactaacagggcacagtggtccaagcctgtagtcccagccacttaggaggctggagcagaaggattgctttggcccagtagatcgaggctacattgagccatcattgtactccactgcactccagtctgggcaacaaagtgagaccctgtcttaaaaaataaaaataaaaaaagtttctgtgggggacctgcactgaggtcctggaggggcgccagttgtgtctcccggttttccccttccacagacaccattgccaccaccattaggcaaacatccttcgcctcagtttctccccccacctccctctcctccacccatccagggggcggggccagaggtcaaggctagtgggtgggactggggagggagagaggggttgagtagtcccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggaggcaagtgagcttcgacggggttggggtgtggggaggtggtcatgacagggcagcctgatggggaagtggtcacctgcagctgcccagacctggcacccaggagaggagcaggcagggtcagctgccctggccagggaggggtgtgtatcaactgctggcagccctggcaggcaggggccaggtgggaagtggaagctggatttcgaagagacaactgccggtgagggcagagcagcctgggagagtcggaagctggcccaggctggcctttgctctggcccagcccttgtcagggtctctcacatctcctaggcctgcccagggtctggtcactcattactggcccagcaccagacccagcttggggttggtttgagccccttttcccacccttagtcctgcttgaaaatttgacccttatcagacccaagattttggccttagggttaagcatagcctgagggtaaaaacagtgctcattccaggattattgttcctgaaagtctagggtgtgactcgtttctgataggatctcctgtttgggctgtgtgtgtgcgcgttgtgagctgggtttacctccagtcaagtatagggcttgtcttccccggatctctgcctcaggccaatgactggccactgtgttaaggtgcacaccctggcaccccttgtagaaagctggattttgattgacttcagcctcagttccaaagttgtaaacaagaaaaatggtgagagatttctccaggccatttgcaaatatagagctgctgcgggattgaaggcatccagccctgctgaggactattaaagatgtatcttccagtccttcaaggcgacaagtgtaagcaattagagattaaatactaagccttgagacctcacagaaaggtgtgactggtttctggagtgaccgagaagccccaacctcttcgcaggaggtcactgctgagccttgaatgataatggctggcaattgtggtccacttcctaagtgcctggctgtgtgctccgtttatacatcattatctcattaaccagcacaaaatctcctagggggaggtattattatcctatttaacgggttttaactgctaaatgatgaagcgaggatttggaccagtgtttattccaaaaccccaaaacagaatttggaaaatccaagatag

SEQ ID NO: 120216 - DNA, 1107 bp, Homo sapiens
acaaaggtgccgtgatggttctgtcctggggattgagatggctggggaggggcctcctcctgttccgaagcatgttcctcccacccccaccaggccccataatctacctgccttttgggcagttaaaggccgagaagtgaacacagctgcaaccccactgccttgtagaccttccggcagacctgtggcaggtattgaaatgcacgcatacaattaggctcaaaaagtctacacagacaggagatgggcacacgaacagaggcaacataagagtgggggaaaagtctcaaaagactcacggatgccaccaagatgaagacagctggccacgggacacccatccccttagaaggcagatagagccactgaccccagcagacaagcccaggcagggctgagcctggagcctgcaatgagaagccttacttaagtcgacagaggtcagcgtgcccagtccagacctggccttctggccttcgaagctgtggggagccctggcccagagccccctctggagcccccagacttaccccaggccctccactgagatcaagttttgggagcagacagacaaacatcatccctcacagacaggcattccgttggctattctcttgcaaacagaatcaagcactagaccagcagcatgagcctcaggatactcaggccaggcccagaaaaacagaccctgaaggggagcttagggcagccttcctgcacgcctccacaaatcactctccacctcctctgcgtctttctgccagccagccccactaaacaaagcacatccctcaatctgccaggctcggggagggacgcacgatgaagctggacgcctgagtcccccagaggaaggaggaactagatacctaggtccctgtggggggcccttggtgcccgtctgaggctcagtctttgaggggattgcagaggggggttgctggagctccttttagcgtctctgaaggggattctgtgtgaggggattgggactggggggttggggagcaggaagcagtccccaggggagccatccaggcccattcaagggttgagcacttgtttagggttagagctgccccctctggggaccgggattgtccagcc

SEQ ID NO: 120217 - DNA, 1016 bp, Homo sapiens
ccagggcaggatcaggaaacatggggaaagcagttgtgggttctggaccaactgccctcctaaggtctgtccttagcagggaccttcccctgactcatgaatgctggaatcaggaccccaacaccataatcatcaaggtgatacatccgtccttcattgtcacatgtgcttcacaaaagagtaagtgctggcacacagggtcccaggctgggatggcccatgtgtggatggtgcttccagtaacaaggcggggcacacttctacctggggcttgaaactcccagtgggacaagaaaacccagaccccgctcttcaccccttccctacctgagctcttcctcctacacatcatagcggtgaccacagctccaaggacagctaggacaaccaggacagccaggccagcaacgatgcccatgatggggatggtgggctgggaagatggctctgggaaaggaggagaaggtgaggggccctgacccccaagcctcagccctgacccggctgaagggctccagaaggacttctgctttctctgataagagatgtgaccccccattcccctccttaccccagctcagggtgaggggctcttgcagcccctcgtgctgcatatggcacgtgtatctctgctcttgtccagaaggcaccaccacagctgcccacttctggaaggttccatctcctgctggcctggtctccacaagctcggtgtcctgggtctggtcctccccatcccgctgccaggtcagtgtgatctccgcagggtagaagcccagggcccagcacctcagggtggcctcatggtcagagagggggtggtgggtcacgtgtgtctttgggggttctgacgggaagagtcagaaaattcagacactttgcatctctcttgggacactccagcagcgcccatgtgaccatcctgagaatggacaggacacctggggtggggaaggcggcagagaacccagacgccagcctggacacaggcacctgggataatctcctattcattg

SEQ ID NO: 120218 - DNA, 1048 bp, Homo sapiens
gggagccttccccatctcctatagatctcccgggatggcctcccacgaggaggggaggaaaatgggatcagcactggaatatcgccctcccttgaatggagaatggcatgagttttcctgagtttcctctgagggccccctctgctctctaggacaattaagggatgaagtctctgaggaaatggaggggaagacagtccctggaatactgatcaggggtctcctttgaccactttgaccactgcagcagctgtggtcaggctgctgacctttctctcaggccttgttctctgcctcacactcaatgtgtctgaaggtttgattccagcttttctgagtcctgcagcctccactcaggtcaggaccagaagtcgctgttcctccctcagagactagaactttccaatgaataggagattatcccaggtgcctgtgtccaggctggcgtctgggttctctgccgccttccccaccccaggtgtcctgtccattctcaggatggtcacatgggcgctgctggagtgtcccaagagagatgcaaagtgtctgaattttctgactcttcccgtcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggggtaaggaggggaatggggggtcacatctcttatcagagaaagcagaagtccttctggagcccttcagccgggtcagggctgaggcttgggggtcagggcccctcaccttctcctcctttcccagagccatcttcccagcccaccatccccatcatgggcatcgttgctggcctggctgtcctggttgtcctagctgtcct

SEQ ID NO: 120219 - DNA, 1062 bp, Homo sapiens
atgggtcacttcaaccccatgactccccagtcgggactgtggcaaatgcaatagacttcagtccagtctctgtgcctggagaagaaagggaagctggtcagagcccacaggaggaggtgacccacagggagccagtagtaggtgggtgtgagggtgagtatgacagagcagttacttgggctcagcagtcagactgtctccttagagtcatgagtcagcccattgacagttactaaacttcctagtgacctcagtttccttgtctgtaaaatggggctgatagctgtctctaggtcatagggctcttgtgaggtttaaatgatttaattcatgtaaatcccttaggaacgtgactgacactttttttaaggtacaattctgtaaaagagtgggacccatccatttaggtcctgtttccttattccaggtgtgatgaaaccagctctccccaacacttatcctgacccccgttctatgcctgcaggtggagcgctgttctgtcccctacaacctatggtgtggggggcaaccaggaaaaggccagggtggtgccaagtatgaggaagtcacagagtaacacacacacatacacacatacatacccatacctgcttatatacataaatatgtacagatacatacatatacgcacttataaacacgcacatacacatagatgcccatacctgtttatacatccacatgtgcacagacagacacacacacattacacagtcccaattccttgattcagtttggggcctgggtaattccagttcaatctcttttaagaaatttaagaatctgaaagagaaagacctgagaatttttgtcccacaagagacagacccacttcctaggcactgtgggactttctgagccccatgtggccctgctcctggaagctcatggaggagcgggaaaatctgacttaacatcaaggttctgaagtccagaggcagccctaggaactggccttccctgggtaccaggcctccgggagtccagcaggtccccttcctcctatctcacctatgacgtctcagcctgccttccacagcc

SEQ ID NO: 120220 - DNA, 1035 bp, Homo sapiens
cctcctgtcccacgtctcctgcgggctctgaccaggtcctgtttttgttctactccaggcagcgacagtgcccagggctctgatgtgtctctcacagcttgaaaaggtgagattcttggggtctagagtgggtggggtggcgggtctgggggtgggtggggcagaggggaaaggcctgggtaatggggattctttgattgggatgtttcgcgtgtgtggtgggctgtttagagtgtcatcgcttaccatgactaaccagaatttgttcatgactgttgttttctgtagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttacgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgcatgttcgctgtgctgagtctgttgcaggtggggtgtggagaaggctgtggggggccgagtgtggatggggcctgtgcccatttggtgttgagtccatcatgggctttatgtggttagtcctcagctgggtcaccttcactgctccattgtccttgtcccttcagtggaaacttgtccagtgggagctgtgaccacagaggctcacacatcgcccagggcggcccctgcacacgggggtctctgtgcattctgagacaaattttcagagccattcacctcctgctctgcttctagagctccttttctgctctgctctt

SEQ ID NO: 120221 - DNA, 2014 bp, Homo sapiens
accactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagatcttaattctagttttttatcactttttcatgaggtgatctcatcctcatctcctagcatgtctggcaattttgatttctgaactctgtgctacctcagaggccagcttccttagggaaaaatcagtgctgaagtaaagttatatttccttttctgctctaaatatatagtgggggaataagagaaatgaagaggaattcctgagaacgtaattactagaaactcccctctcccacgtaatgtctctcacacaccatggacccctattcccccaatttgcgaccccccaccccaccccacaacaggtggtgatctttgtgaagtctgtgcagcggtgcattgccttggcccagctactagtggagcagaacttcccagccattgccatccaccgtgggatgccccaggaggagaggtgagctgaagatgggaaagatattttgtgtccttgggagaaaaagacagttgagagaagggaatctcaacatgttttaaatttcctttctcacaaaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtaaacctcacaggctgaaaaaatcccactctcccattcccttgttttctgtttgtacatcttcattcctgcctctgggtctctttcctcttcggtcttccagtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacagtgagtactgatctcatgaaaccctttaggtcctccctgttccttagtgtgtttgtccgaaatcccatcacataggtcatgggcatctgatgcataatggacacttgactggttcatgccccctggtctttgatgctgtgttgggatgtttttctgacctttatgtggggtgtcttgtcttctctcatcatattacatcccttccctcacccccacgtccgtcctctgaacccaggcagtacaccagtgtctgcatgtgtgccgtgtgttcctgcctcactttccccttttcatgccttattctgaccatgctacgttttcttctcagttgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataagtgcttcgtccctttattgtatttggggtgaggttattttagggcatggtccagggtgaattcctataaggcctgggtgccctgcctgctgtgagatcaaaggggaatgggactaagactgcagagccctggctcccccactgcctgccaattgcctgcgctttgtggtctcttccactttctctggcctgggaagacgctggggtgtttatgatcccaaggctcctggtgggtggtgcgtgtattttcagcgccggagggtgctgtgggcactgggggaaacttaggcgcctcctccaaggctctcttggtgcctcctcatctgttccttcagcttctggatcttgagcaccag

SEQ ID NO: 120222 - DNA, 4822 bp, Homo sapiens
gggcctggctttattttatttttatttattttatttctttttgagatggagtatcactcttgttgcccaggctggagtacaacggtgggatcttggctcaccacaacctctgcctcccaggttctcgtgcctcagcctcctgagtagctggaattataggcgtgtgccaccacacctggctcctttattttttaaatgaagcctggcctcataaatgaaggaagttggttagattaagtcagtagaactgaattattgtcctgactgctccgactagccatgtaactttaggcaatcaccctcagtgtttggtgggggggacataaaatttttaaattaggtgccctctaaagttagttttagtttggaaacatgctaaaaattggtttagctcaaacagagtgggaaccctggggggattggactctttccttcctctgttttgagactctttgcttctggctcggcaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtcatcaccaccaccaccgttttcattatagattcatatactgggagtcatagcggagattctaaactgaaagagaagacagtacccttctggcatctccagcacagcatttacagtcagaatttatagctgaataagtgtctagactcaggtctgggattaatgtagagagtgtttgtagcagtttgtgtgatgtggtattctagtgtgccaggtggggttaatggaagatttttctgtaagaattgaatcttggtgaatgagagtggggttggacataggccccataagtcattacaaatgatctttggcaattctatatggtgagctataaaggtgggctccaggtagggatgtcatatttgcctgacttgatagaaaagtaatccagagagtcatagatggactctgatatctggaatataatatgtgcttgatatttgtagtctgctgaaggctggctggggcttgggcaggaaagggttgggagaaggtcccataaagcatgttttgaaggccttgagagcctctgcactgggctttatccccatttcatagttgggaactttggggttttaccttatttcttgcttggttaaaacaaacagctggaatctgatcccacttcttgattccaagtccattgctctttccattgtgttgttactatttccagcaatcttcacctcactgggaagtctacctctaatctttgtttatcatacctgcttattttctcctacaatttttttccttgttcttgtagacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgagagcgggtagtgttcgactttttcataaatcacaacatttttgaacctcttctccctttgggggagggcaggatttttctgccctaccacccacccatccatcgtctcttacatgcaccctacagccacgcaccctcaaggtggcatcgagcgtacagctggagccttctgctcaccaaaactcctacttcccggtggcaggagagcaagagagggacagacagatggcagggcatgtccaaaagaagagcatcagcacaaatgaatcctccccttccccacctccaggggtgggggcctttggcacctcaatccccgataccctactccttcccacccacatctccttgcacccatctggaacctcggttgatgtgagccggcaacagagaagcaccgtggcgcggcgagggaatgcagacggcacccagcggtggatggcggcagcggaggccgcggggaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagagagaccctgtatcaaaacaaaacaaaaaacaaaacctgccttctgggattgggcttctggtttttttcccatgacacacgcatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtcccagctattcaggagactgaagcaggaggatcacttgagcccaggaatttgaggctatagtgtgctatgattgtgccagtgaatagccactgcactccagcctgggcaacatggtgagatcctgtcccttaaaagtgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtcggggcaacatggcgaaacttcatcactaccaaagaagaaaaaaattagccaggtgtggtggtgtatgcctgtagtcccagatactctggtggctgaggtgagaggatagcttgagccc

SEQ ID NO: 120223 - DNA, 3360 bp, Homo sapiens
gcatcaatgagaggcggcgctcggcgtcccttggtcttggtatttgcggagggcggggctcttctcaccttccttgtcctttcttgagctctttctcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcgtattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtggtgaaggctgtgctcgtgattaagtcttgcttttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacacagcgagactcctgtctctacaaaacgttcagaaattaagcaggtgaaggttgaggcttcagtgagccgtgattgcaccactgtgcaccagccggggcgacagtgaggaagaaaaaatcaggggataagtatcaaaaacaattttggatagaggaggcttatacaggcttattctttctttcgtgatagcaccaaagtgctaatgatccaaaagtgacttccaggtctgccattcattcttgtgactggcttttcttgtctgcttatttttaattttgtcacttgacttctaattttaaatttccagaaaggtcctgcttggacctgtagtctccctctgttgggccaggccaactgtggtctctggaaacctctatgactggtttagagatgactggcttctgggtcaggtaccaagtccttcattttgtccagggttgtagtagttacgtgacccgaagtatagcaacctaagcaggagaagtggtctgtggcaggtattcaaatgtcatgaattgttacagattaagaaaaataaggacagagctaggatcattgaaggtgagcggttggtagatgcaaggggtttgttactaggactgggaaggcctagatctggaggaggctaaagctaggaggaattaggagagtctgattttgaggtgaatgtaattgagcagagagaggtaaaatgggtctggaagttggcaagaaccaggtaaatactagactttgagaattgagtggtaagaaatgggcttggcatggtgaaaaaggtagagttatctggagactgaagtctaatttatcttcctccccccccaacttttagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggttaggactataagggaagggtgtttttgtcctagctacatgatgcttgcagagccatgagcacatgacctctgttacccttgacaacctgacagctgtgggggatgttctgtcgcaagcgtggggttcatgatttagatcacataattgaagtcatttattatcggcccaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccctctctctactaaaaatgcaaaaattagccgtgc

SEQ ID NO: 120224 - DNA, 1053 bp, Homo sapiens
cttctgccagttccctccctcaaagaaatcctccaatcaaaatcacctcccaccataatccctgtcttctttccatcccctagaaatcctgggaggcaggatccaataattttcctgtgacacttataaatatcctgctcacatctgaatctccttgttgttctttaaccctcactgggactttgtaaacttccaagtcattctcacctaaaccctctgtgaaatttgtaatatggggaagtaggaatgtggaaaacatcctgacttcagtgtctggccgatgtgggtccctctcttgaccctgtcacttgctggctgtgaaaccaggacaagctacttaacttggtagcctcgatgtcctcctctgtgaaactgggatgataataatgcctaccttgtgagggttgcttcaatgattaggaatcattctgtaaagtctagcacagttccttgcatgttgtagcagtgattcagtaagtagcaaccctgtgatactattaccaccacctgctcactggtcaaaacctacacagctgtttcctcacgtccatcactggctctctaattccacttgttcattctgtgaccctagttattttctgaaaaattggttcttctcttttcccagagaccttctgatctccaaaaagaggagatgactacatttagcccctctcttataattccaggtagataactgcattttgtagcctctctttgtttttcttttgctgatctttgtctttattagattttcctcctttcctatttccccaaagacttatcagatgctcattgctttctaagatctaaaatgatactgtgttccctcatatgcatgcccttcctttctatatccttgacaccttactttcccattgtaacaataaaaaaagtatcaataaaataattattggcaaataaattggtgagttgaagcagcctccttttgcctcatcatttctcattttcagtcactttgttttttttttttttgagatggagttttgctcttgttgcccaggctggaatacaatggcgtgatctcagctc

SEQ ID NO: 120225 - DNA, 3557 bp, Homo sapiens
ctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttgagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtgtttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattaatttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcac

SEQ ID NO: 120226 - DNA, 1358 bp, Homo sapiens
atgctctctctccaagacaaaaagctaaagtttagtaccattccttagtcatttaacaaggaacctgcaataggtaagaaagggacctcttcgtctctggctcagacgtggctggactaaaccaagccccaatgctccctgaagttcaagttaaaatacccatcactctaggtcccccaagcctctgtctacctcttggggtcggactgctcctgtttgcttgcccatcctgttccgtcttttggcactagtgagacattggggtcattgcctttgttctcggctttcaggcttggaaggttggctggaggtggcatacgccgggcaatggcaactttcccgagactctgcaggccatggcgaggggcaactggagaacaagacggagagagggtcgaaaatgcctcatgtgggagatctgatggcctcctatcctgggacacatttatacatgttgaatattttattacctacttcctccaaacttctcttagaagggattccttcccctgcccttaataatctctgaaatcgcgctgattgtggtggctcacactttgcaatcccagcactttggcaggccgaggcaggcggatcacctgaggtcaggagttcaagaccagcttgaccaaaatggagaaaccctgtctctactaaaaacacaaaattagccgggtgtggtggcgcatgcctgtaatcccagctactcaggaggctgaggcaggataatcgcttaaacccaggaggtggaggttgtggtaagtcaagatcacaccattgcactccagcctgggcaacaggagctaaacttggtctcaaaaaaaaaaaaaaaaaaaaaaaaatctatgaaatccctatcaagaaggctgagatatgtaacattcaatacttttatgtgagattggttgatcatgagcctgcaagaagcaagctggcctcaaagtttcccaaatccacatttattttcctccaattcttacgtgtccaaagacagggaaccacagacacgcctttgtaggaggataactggtgttcacccagagcccacaccccctttaaaggacccagtgtaaagttgggaaatctcctctagtcttttggtatttctactacagccacttccctttaaagagctctaaaacgtatgccccatgcatgcctagctttcaaccatcagaagcatctttgcaggactctcaccagcgggtttctggatctctaaggacttgcccttatacgtatcaaacaggttgagcgaggaatacttctttccatcctttcccttggcagtcggccccgagcgatcggacattgcgctggaagctcattgagtatgttgggtcctgcaggcacctccc

SEQ ID NO: 120227 - DNA, 3380 bp, Homo sapiens
gtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggtgctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcag

SEQ ID NO: 120228 - DNA, 1751 bp, Homo sapiens
gggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtaaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcag

SEQ ID NO: 120229 - DNA, 3210 bp, Homo sapiens
gggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaatccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcttccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctagggaccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggc

SEQ ID NO: 120230 - DNA, 2365 bp, Homo sapiens
tccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctgggttagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactgtttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttctggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaat

SEQ ID NO: 120231 - DNA, 1004 bp, Homo sapiens
atccggctcaccctttccatgagtcaaccactccactgagtctccatgctagtggagagaggggaaattaagagtccaggatgtggtttttacagcagaaatgccttcctaattctctttggcactagccaaaactaaagtgaatgtgcttgaacgtgctcttcaaaacgaaaggcagaaggggtcaagccatccgggattcagagctaggtaatccacaagaggaaacccaccttaaaggaaaatgggatctaagcacatggggattaggcagctgagcaactaatacaggactgctagcaaacagactaaggtcaagtcctgtatggttatgcaacaaccaagagcaagtctgaatcccagaaaaagtttcctcattaaacgaggggaggggagactgaataacaagagctcccaccatctctacatagtttgattccaggcatgacggggaaacctggatagagagagaggcttagggaagaggaaaaccaaccttgcgtctcttggcaggcataccactgaggtaggcatcactcagagggggctgcggtttcaccttccgctggctctgaatgtcctgctggataatagggacccattcctggggaggaaaagagaaaatagtaatgtccttgactttcagctgccatgacccactggattacttcctgacacttactggggggactgcagctgcccaaggttctgtctcagctgaagctccatcctgttcatcccgggagcccccctcaggagcaggaggtggacctcgggacatggcctcttctgctgttgttccaggggctggggaagcattctcccgctgggtgtcagatggcgggaagagccaggcttcagaatttttagcctccaaacctttctcccccagccctccactccacattatctggcccctcaacctccccctctctagagtacctgaggctcaggggaagctctttctgctccctgaacttccattggctcctcaggaagtggct

SEQ ID NO: 120232 - DNA, 2501 bp, Homo sapiens
accatacttctgctttaagcagtgaagatcagaatgtaactccccatcttcccagacccgttggtttgtgccctcttgatgccgtattatttccgtgtgtcttcattctcacctcactttctgttctttgttctttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtgttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcaaggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccacttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctatccaggtttccccgtcatgcctggaatcaaactatgtagagatggtgggagctcttgttattcagtctcccctcccctcgtttaatgaggaaactttttctgggattcagact

SEQ ID NO: 120233 - DNA, 2029 bp, Homo sapiens
ccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggagttctagtgcgtaacagtctagggagagactcctgtggtggtgcatggaagggcaggtctgaaattctcccttgctctctatccagcagggcgccggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagctttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaaagtgctgggattacaggcttgagccatcgtgcccggccagc

SEQ ID NO: 120234 - DNA, 1048 bp, Homo sapiens
tacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatgcagataactctttccctccctggaaaaacattgcaacagggccaggtgcagtggctcacgcctgtaatcccagcactttgggaggccaaggtgggcggatcatctgagattgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcct

SEQ ID NO: 120235 - DNA, 1043 bp, Homo sapiens
ggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctacggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgg

SEQ ID NO: 120236 - DNA, 1677 bp, Homo sapiens
gcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttatttttattgatccctttgttcgtattccagtagaacgttttctgatgttttgtgagtgaggctgattttgttctgtcctccacatggatagaacttaatgcagagggaa

SEQ ID NO: 120237 - DNA, 1135 bp, Homo sapiens
acacgtataggagactctccccgagatcttctagggagtgacccatctatttttgtttgggaagaggaaactccgaaatgggatcgcggaagacttaaagggccaggctgatttttttttcctactggtatgtcttacggggtgggaaagtggtttcagaaagaggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctc

SEQ ID NO: 120238 - DNA, 4025 bp, Homo sapiens
actgattcgcactaggggcccaacaggcaataaggacccagcggattggccgaggataggccagtcccctgggcagcagcgccgcgccgggactagaggggaacgtgaggagagctgcggaaagagatccagcctggctccctcctttccccgccctaagtcagcctcttcacccagtgagcacaaaactgtattgcccagactcccgggccccgaacgccatacctggcttccgcttccggtggcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccagttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctgcactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggttcaagcgattctcctgctccagcctcccaagtagctgggattacaagtgcctgccaccatgcctggctaatttttgtatttttagtagagacagggtttcactatgttggccaggctggtctcgaactccagacctcaggtgatctgcctgcctcggcctcccaaagtgctgggattacaggcgtgagccattgcgcccggcctgtatcttttgttactaaagtggcactgctagtacttgtctcaggtggcctttaggaaaactgaaatgctacacattgaaatgttttgttcagaaaccatgctgttcagcttccaccttccttagccagctgagaggacaaaactggttcctagagacgggatacaggagtggagtagggacaaagatcttgaaaagaatgtctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactatcgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctattccaaaatgcgtttcctcatgggtctggtttgttgtctgtttctcctgctttgcaccttccagtctagaatttcatcttctgcattgacattgttgcagttatgtattgaggagggagttgggagggagagcaaggagcagaggctgaaaaggtgtgaagggaaggcagagctgtcttcgtttgatgcaagggtcagaagcccaggtttctgggtcccatgcccagatgttggatggggtaaggcccaaaagtaggtgctaggcaaactgaatagcccgcagcccctggatatgggcagggcacctaggaaagctgaaaaacaagtagttgcatttggccgggctgtgtttcagatgaagaactggaagacaaccccaaccagagtgacctgattgagcaggcagccgagatgctttatggattgatccacgcccgctacatccttaccaaccgtggcatcgcccagatggtgaggcctctctgctcctacctgcctccttctgagcagtaagagacacaggttcctgcagcaagaagtcatgtttaagccctgtttaaggaagctagctgagaagaggggaagaaccccagaacttgggcctgggaattgaattctgattgggggtcatcctgaagggattgttttcagggagggagacagaccttgaatcagagagttgtgatagactgcctcttcctcaaggaacaaacaacaaatggctctgatggtttgtagcctgcctaattggaagaaaggcaacacagaagtttgagagcccatctagtccagagaaggggcctctggacagaggtgggaggagtgggggacagagtggtatgggttgggctgcgaagggagttgcctcttctttacatctacctgccaaccccttccattgtattcacctcagttggaaaagtaccagcaaggagactttggttactgtcctcgtgtgtactgtgagaaccagccaatgcttcccattggtgagtgttgaagaagggaaaggaaagcaccgtgtggcagtcttatgggaaggagttggggctcaacacattggagcctgagtcctgaggggaggttaggtaggaatagggggatacctggcctgctgagtctggctgtctcccaggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggtagggagcagggagagtcattaagggtcaaaggaaaggcccaagatcccccagagaggggaggacagggcatggccctttcttgaggtctgcttctcccagaatcagggcatctccctgctgagtgactgtgggaaagttatttgattatc

SEQ ID NO: 120239 - DNA, 1049 bp, Homo sapiens
acaggtttcaccatgttgcccaggctggtctcaaactcctgagctcaggcaatccacccacctcagccgactccattctttttttttttttttttttgagacggagtctcgctctgtcacccaggctggagtgcagtggcacaatctcggctcactgcaagctccgcctcctgggttcacgccattctcctgcctcagcctccctagtacctgggactacaggcgcctgccaccacgcctggctaattttttgtattcttagtagagacggggtttcactgtgttagccaggatggtctcgatctcctgacctcgtgatccacccgcctctgcctcccaaagtgctgggattacaggcgtgagccaccgcgcccggccaactccattcttttgagcaagatacttaacgtgggcgacaatgttctaatgtcctagatggagtctctggctaaatttctgtgtcttctccaaacccagtgcatgaagctcttcttgaaaccccagggcagaggctgtgtgtgcccccattagcgctgcaactccttaagggaagatatactgagtctccactggaagtggagatctgagacttaatcaggtgatgtgatgcctgaaatttggagttagaagaggcaggtgaccacagctccataatgctccaccgttagcaaacaggtggatagctgatactggtgccctctcctctatcccattccaggggggcaaacgatgggaagtgtggaacatgaagctctggagccagctgcacagttctgaatcccatcctcccagatccaacagaagagttaatcccctgaaaactaaatttttgttcagctaagggaagctccttaaatgcaaagaggagctgggcatggtggctcacatctgtaatcccagcactttgggaggctggggcaggaggatcacttgagcctagaagttcaagactggacagggcaacatagggagactccatcagtacaaaaaatttaaaaattacccaggcatggtggcatgcacccgtgttccaagctactctggaggct

SEQ ID NO: 120240 - DNA, 1046 bp, Homo sapiens
gctctgcccatctgttatgagagttcatgcaaatcccaccattcgtgggtttcagcttggggcgccatggcattacagtttatctgaccataagactggagctcagagagggatagggagagcaatcagcataccacacaatagcaatggtcacagaagataacagacccgaaaacgagaaaggaaaaacatctccatagtccccttcctgaaagagatccagctggtaatcttccaaggaaaagacatggctgggtggtcgagcaggtcagcctctgaggagtatttgtaatccctttgcttctcctcttatggaccctgtggaatgagaagcttccattccccttggagaaaacagaaacctgccctttcctcttccctgcaaagctcttcatgggctgccctccctgcccaaagggagtttttcagtcccaacttggccccccagcccttccttcctgcctccttcctaggtgatctgctgtgaggggaatgctgggttttatgaggtgggctgcgtctccacgcccctggaaggtaggacggtgactcagcctccttatctccgccctttgaaagggaatgtccctgcctcccacactgacctgacctcccctggcctctgctttctctgggtgaggttttgagtctctcagctttagggaaaagtccactcgccatttgctttgataaccttacatccctcccctggcctgtgtccctagctattatgcttttcattctgttccattcccccaccacacaccccacacaatcacatgctgctccctgtgctgcctcagaacctctggtgtcatctcctatttctgggaaggcttggagttatttgcatctaagctggggggtacttctgctcttccttcccccagggatggagaaagggctgtgggccacaaggtctcagtccctcctccccctgtgttacagctggatattcagtcctgggctggaatcatccaggctttgctggaagcacggtgagaccatctcaggaatcccttccttttcctgaattatgtctgttt

SEQ ID NO: 120241 - DNA, 1033 bp, Homo sapiens
gcctctgcctgccccacagggagggtttgcctctcctgctctcctaatctctgctgcctcaacaggtctcaccatgtcccctgcccggggaaggctccgctgctacatctgtggcttcaccaaaccctgccaccctgttcccaccgagtgtcgggacgatgaagcttgtggcatcagtattggcacttcaggtaggactctggtccaatggcccttctccaggaggctccctacctccatccatccggcctttcctgtggcccccgcctcagcatgcctctttcatcccacagaccagagtgagatcactgagtgaaaaagctgcctctcaagggcccagtgccctctgccaggctatgccacctactggctgcactcctacactctgtggcaccactgctgcgagcaggacctgtgcaacatagccgcttccccacagcagctcaccagcctcctcgcctccctgcccctctttgtggccagcttcgctgggagaggacacctcctccactagcttccgtggatctgcagcccccaacccaggataccccccgccatcactgcggccctggaaacacctgcacagacactttgagacatgcccgagaacctaattttgtacagagaccccagatctctcagcagacccctcacagacccctcacaaggcctggggaggcacctgcccagagtccaacctcataaagaacacctattctgcgtcttttgtcttttctagatgcccattgctgatgccccgtgtcagcccaggtcactggcaaggcaggcattttgatgacactgtggatctcaggcaaggggatcaaaggagcatcaggtatggtaaggaggagagtcttgctaggaaagactaatgtggtaggtcgggaactcaggatggagggcttgggggactatgaagagtacctttaataaaaggtctatctaggagtccagtaatactgcagatactgcagtgtgtgtgtgtgtgtgtgtgtgtgtgtgtgtgtgtgtctgtgtgtgtgtgctctaa

SEQ ID NO: 120242 - DNA, 1049 bp, Homo sapiens
agcataagggctttcatggcgagggtcctgagaatggtggcaaccacagcagctgatagagtagattttcaaggatccagctctaggagttgagtggcctttttggaatttataaacccaaaggctcctcccttccctgcctctggtagcccctcccttctcacttactacgcagctgaccagagaaaagacaaggggtgggaaggcactgagcaggactgagtggggagtagggatgggagagagggatgggggaaggcaggtgccactagtggccaatgccattgtggttcttggtttcaggccaagatgcccttcctggtccccagctaagagtcctgctgctcagtcctctgaatgagcatcatcaaaggcctctgtgatttacagtgtccatggtggcagcttctgctggttcctggaaaatggacaaaaggatgtggcccaaattaattgctgaatttgggtccctgggtccctgctgggcattgataggggcatgctggtggaaattgggggaggaatgggtcaaattaatctccattcagcccccactcggtctttccaatgcctgctcagcaataagtgactcactgatggcttctgtgatgccacagcagcagaggcaggggctggggctactcatccaggagagccaccacaggtctgctaagtagggctgcctcaggctcccatgaaggttctcaggatgtcacccgtgctccacttgcgcttggtgtggccttgttgctccagtccagcagcagcaattgtcctaggtgtggctgtgtgcacctgctccaaagcacctccccagtcaaaacctgccaacttgggcagggtaccaagccaggaggaacagcatgggcacagagaggtgaggtagaagctaaaataagaatagaaatagtaggccgggtgtggtggctcacacctgtaatctcagcactttgggaggccgaggtgggtggatcacaaggtcaagagatcgagaccatcctggccaacatggtgaaaccccatctctactgaaaatacaaaaattagtc

SEQ ID NO: 120243 - DNA, 3443 bp, Homo sapiens
aagacctgggcgctcttaaccacccccaacgcccttgtctgcatgtctttttctctgtctcctccttttctgtttcttctcccagacaggtgaagaaacaagaaaactaagaaatccgagcggttggagggggagtctgtgtggatgggatggggacgccgggggaggggctgggccgctgctcccatgccctgatccggggagtcccagagagcctggcgtcgggggaaggtgcgggggctggccttcccgctctggatctggccaaagctcaaagggagcacggggtgctgggaggtaaactgaggcaacgactggggctacagctgctagaactgccacctgaggagtcattgccgctgggaccgctgcttggcgacacggccgtgatccaaggggacacggccctaatcacgcggccctggagccccgctcgtaggccagaggtgagcgccgtggcgcgggtgtggtatggggaaaggcagaaggaactggatgtcggggctttggggaagaattgaggatgggggtgtcacagctccgtgccctcttctcctatcctaaggtcgatggagtccgcaaagccctgcaagacctggggctccgaattgtggaaataggagacgagaacgcgacgctggatggcactgacgttctcttcaccggtgaggctggggggaggcataggtcttggcacagggaagtagagtttgggagactcggccgtctggagccttgtttctaactcactcccgccctcaaacctccgcggcctcccggactcaggccgggagtttttcgtaggcctctccaaatggaccaatcaccgaggagctgagatcgtggcggacacgttccgggtgcggagcgggaccagcctagggagggagggggtgcaggtgggggtcggaagggcctgggcgcccgctgaggaaatgagaggcagagagcagcctatgtttgaagataccccatcacccctcccgcgcccctgaatacctcccttcgctctccctaggacttcgccgtctccactgtgccagtctcgggtccctcccacctgcgcggtctctgcggcatggggggacctcgcactgttgtggcaggcagcagcgacgctgcccaaaaggctgtccgggtgaggagggggcggggccaacgaaagtgggcgcagttctgggcccgggaggccgggagctgggaggcttaggaaattagccctaacccctgccctcaatgggctgtccatcttacatgaaagaacacaggagaaaataagaagttacaacagcaggactgggaacaggggtgattaatttgctcttccggagtttcaggaaaccccaaaggtggcacctaaactgtgactctaaggatgggtaggacagataggaggggctggggaaggtagggggttgaaaataactgcatgtgattccaaggtggaaattagcaaaggtaactaaagtacttagtgtctgacatatcgtaagctctatgtgcttgctgtcattattttccacaaatgtcagtccgtccccagcccttagtggtggttgagcaggcagacacagctgtggagaggttctgagactcgaacacttcctctttcctctaggcaatggcagtgctgacagatcacccatatgcctccctgaccctcccagatgacgcagctgctgactgtctctttcttcgtcctgggttgcctggtgtgccccctttcctcctgcaccgtggaggtggggatctgcccaacagccaggaggtgagagagggcaggaactccaacaccaagcaccatcagagaaaagagtttcaggctttcctagtgggaggaaggaagggtaccttctctagaagcctgggtggggccactctgagctggctggaagagtggcctggctcagcctgaggtctcactcccctctccccactccatgtcttccctgtgcaggcactgcagaagctctctgatgtcaccctggtacctgtgtcctgctcagaactggagaaggctggcgccgggctcagctccctctgcttggtgctcagcacacgcccccacagctgagggcctggccttggggtactgctggccaggggtaggatagtataggaagtagaaggggaaggagggttagatagagaatgctgaataggcagtagttgggagagagcctcaatattgggggaggggagagtgtagggaaaaggatccactgggtgaatcctccctctcagaaccaataaaatagaattgaccttttagactgggctgtgactggtgtcttactggggcaaagggatagggcagggctgaaacctgagtttggggtcagtgcagggaagaaggcctcttattcaaaaatcttgttaggtacttatcaactcattgcccaaccatgtcataggtacttgagcacaagatgaacaagacagaatttctatcatgggaagtgtgtccagggcagagaaaagagtgtatgggtggattgctcactgaatttatctaaatgttagatgattcagagactggtagattaccagtccacccctatttgataaagaaaaagaaatgacacttccagggacattcattttcattcattcatttaatgaggcttagcaatgatatcaaaagggtcagtctcctgacgttggggagctcacagtacatgcaaatttcttacaaattgaaatacaggttgtcatggaacaatttacagaaggctgtttctatgagggaaataaagggggtgcgccctagggcatcaaagtatatgcaaggggtggccaaggagggtcaccttcccagaaaaggccatacttgaactaaggataaataagaattagccaggcagatagtgtgaaggagggaaaggggtaatacaggaagaaggaattgcactgggcaaagacattttggggctagggagaattctctaaggctggcattttctaagatgtgcatgtggaatgacacaggtaagcctggagagtggacaaagtgctgtagtaccttgtatccaaagccaaggcacgtgggcacagagctgaagctaaggagagtacttcagttctgtaataagggctgtcaggagcagttatctcttgagtaggatctctctgacttcagggaggaaagcaagggtaggaggatgaggtggggctatgggtaatccaggaaggaagtgagcagagtacattcacgtggcagcgctgggcatggaatacagtgtgggtttgacagtgatgttaagatagaaagactggacttcatggctcattgtgtgggagtaagagagaaaggaggtctgcgtgactcccagtttctgggttgggcaactgggttgttaaagagaatacagaggagaattaagtgagcagcttcagagatgacaatgagttgggtttgacattcagagtgcgaaatgcctgag

SEQ ID NO: 120244 - DNA, 1025 bp, Homo sapiens
gatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactcccttc

SEQ ID NO: 120245 - DNA, 1645 bp, Homo sapiens
ctgtagggccctccacatctctagcgcgaggcccagggccccttgactagactccccacccaaagacaccttggattggaggtgtagagaaccaaaactctggctcccaaaccccacccacctctcctgtcttcagactctactcccttcaggaacccagaaatccaggcttctagcctacaactctggcctcactgaagttccacacccttccctctctaggattcagatcctcccaagttctccaggacctcctccctctacctacctcccacctgtcctcagtgtctggggaaccagaagcctgcctttgcaaaacagtttcccattgatctgccttaggtttgacccaggcccaagggcaaagagcccatagtgaggggacagtgtatgtgtcatgactaggcagaaaacagctggtctgggagtgggaatgcagggactggcctagggatgggtggggtgcatcaggcataaccttgggttggggttacttttcaggctggcagtgatggggccaagattgggaactgcccattctcccagagactgttcatggtactgtggctcaagggagtcaccttcaatgttaccaccgttgacaccaaaaggtaggcctgcttatgttccttgaaacacccctggtgtacacatgtgtgcaaacacacacccacccgagtccttctgtcatgaacatttttgccctccccctggagtccctttcttatcccacgtcctccattccccctttctggttcttcctgacccccatttccagtcctgattcctgatcctttctccaggcggaccgagacagtgcagaagctgtgcccaggggggcagctcccattcctgctgtatggcactgaagtgcacacagacaccaacaagattgaggaatttctggaggcagtgctgtgccctcccaggtataggggcactcagaaagtggagaggtggagcagggagattctgggaaacagacagtttgcagaaatggaaaacagagatggtggtggggctggggcaggagagctagctgaggttcctcccaggaagacatcttacctcatttttcccattggctttcaggtaccccaagctggcagctctgaaccctgagtccaacacagctgggctggacatatttgccaaattttctgcctacatcaagaattcaaacccagcactcaatgacagtgagtcttgtgggtcagaggcctgggtcctgggaggaatagagaggacccagcgggtaggagacattaggggcacctggacgttcagatatcagggagatgaagcagatgttcgtaaatttcccccagcttcccatttttgctttacctctatatttccctgcattttcattggccaagacttttaagcttttctcatttgttccctagcctcttctgccccactgaggacgttagttggctgctggcctgttttctggcagaatagggtcatgcttaagaacagtcatcactctagatccagactacctgagtacaaatccaactagccgtataattttgagcaatcatttcacctctctgtaagtccatttccagatccacaaaattaggatgacaatacctatttcatgggttgatataaatttttttttttcttttttttt

SEQ ID NO: 120246 - DNA, 1004 bp, Homo sapiens
gtcgggttgtactcagattaatgaagcagggaaactgaggcagaaaagagtcctgtgttcaggagaggtcggagaaacaaggaggttttcaggactcctccttaacacccccatccccatcctgtgggagatccgaggattccccttccggactcactccctacatcgtcgagtcccgcccccctccagtcccctccccaggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggtaagaacacttctctcctcagccacccaaattcctggaagccaactctcacctttcccccggtccagccttaactccccaatcccttccctccttgactcccacccccaatcccacgtgcactctttggttgaggggtggttttgagaggggaagacattaacttgttagcaagtaatgagaattctaggatcaaccctgaaaagtttgtaaaagtgcaagtttctagcagactaaaggaagggaagtggagaaaaaggagaattcccaaaagtgagactggggtggggttagagggcgagctggtgaagggacagtgggggcccagcagggtttagaagggacagaggggaacctcagttaggacatgtgtccctacaagatctgagggtgagtagtgcagtaggagaggtgtgtgtgtgtgtgtgtgtgtgtgtgtgtgtgtgtgtgtgtggatggagacgcttcagggaagacggtgtgttgagggaggcctgaga

SEQ ID NO: 120247 - DNA, 1033 bp, Homo sapiens
agttggagaccagcctgggcaacatggcgaaaccccgtctctactaaaaatataaaaattagccgagcgtggtggcacgtgcctgttatcccagctactgggaaggctgaggcaggagaatcactgtaactcgggaggcggaggttgcaatgagctgagattgctccactgcacttcagcctgggcgacagagcaagactccgtctcaaagaaagaaagaaaaaaaaaacagggttgggaagagctgggcaagtctcttacctcctgagtggctgtttcacattcactaaatgggggtgatgatgcctatctcagagatttgagaaaatgattaaattatataagacatggtaaaccctacacttatgagtgattctaatagtgatttcctttcttccttgctggacagatccatctgtgtgtgctgtggaattcaggatacttgggcattgcctactatgatactagtgactccactatccacttcatgccagatgccccagaccacgagagcctcaagcttctccagagaggtggggatggaaccatgaattcctctgctctctgggattgcagatgtgttacacacacacacacacacacacacacacacacacacacacacacacatattttttttttctagacagagtcttgctctgttacccaggctcaagtgcagtggcgcaatcttggctcactgcagcctccacctcctgggttcaagcaattctcctgactcaacctcccgagtagctgggactacaggcgtgtgccaccacacccagctagttttttgtgtgtgtttttagcacagacggtgtttcaccatgttggccagggtggtctcaaactcctgaccttgtgatccgcccaccttggcctcctaaagtgctgggactacaggtgtgagtcaccacgcccagccatgttttacttacattaactcacctcactgtctagcatattttgtgttgctgtaaggaaatacctgactctgagtaatttgttaaaaaaaaaaaaaaagttttat

SEQ ID NO: 120248 - DNA, 1003 bp, Homo sapiens
cctggaaaatagtaactttccctggtgctctgcagcccccaggagatttaagatttaccccgattccactgctgatcccctcccaggttcgagcacttggagggctgctgaagttcctgggtcgaagaagaatcggggttgaactggaagactataatgtcagcgtccccatcctgggctttaagaaatttatgttgtaggtgattcaccccaaccccaaccaaagtaatgtgggattgggaggcctgaaaagtaaagtgggggtggggtgtggatgtggctgtgacccagtgggtcaagtgctctaggacacccgggagaatctaagggctaatgagactttgggaagaagactgggacaatattcagagagggggacaaaggaagtggagttgtggaacgaactcagactgcttcctgcttttttgttttctgtcctcaggactcatctggtgaacatagatcaagacacttacaggtaaagaggtggaggcatgctgctgtctctggggagggagaaggattaagtttaatgccccaataatcctaatgaggctctagtttccctaatcctggggctattaagatctctctccttgaaggaaagggaaggggggttttgagggaaagagaggaagaaaagcataaagatactagctttcttttctatagggagaaactgaggcaaagaaaagtaagggacaaaccttacatcaagatatgatctcggctgggcgcggtggctcatgcctgtaatccccgcgctttgggaggccaaggcgggtggatcgcctgaggtcaggagtttgagacctgaccaatatggtaaaaccccgtctctactaaaaatataaaaattagctgggtgtgttgtgcgcctgtaatcccagccactcaggaggctgaggcaggattgcttgaatccaggaggcagaggttgcagtgagctgaaattgcaccactgcactccagcctgggcgacagagcgagactccatctcaaa

SEQ ID NO: 120249 - DNA, 1039 bp, Homo sapiens
ccacctcacttttaaatcttctgcatgtatttctgtcttccttcctagactgtgagcacatctgggacagggaccatatctttttttgtttatttgttttgttttgagacagagtctcgctctgtcggccaggctggagtgcaatggcgtgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgctgggattacaggcatgagccactgtgcctggccaggaccatatcttaattgtctttgtagtttcagtgtttggtacagtgcctctcactgtttctttttgcctttgagatcttccctctttgttactgtgatcttccctactggtctttgttcttctgagtctgtccctatcaccacctcaacccgagctggatgtggcctgtcctcctttttgtgtttctctcacagactgtgtacagtgccctgggcctgagggatgcctgccgctccctgccgcagtccatccagctctttcgggacattgcccaagagttctctgatgacctgcaccatatcgccagcctcattgggaaagtagtgagtagaaggaaaaagggagtgcacccagggaggtcagggagagagaatgcagtgtgcaagatggggaaacatggaagatattgaggtcaattggataaagaatgggatggtgggaggaggcagcagaacttcagggaagtatctggagggtgagagttaaaggaggactgcagggagaattggggcccaaggagagctgaggaacaggacagagggtgccaggtcctaagaaacagtacttatctcctcaggtggactttgagggcagccttgctgaaaatcgcttcacagtcctccccaacatagatcctgaaattgatgagagtgagt

SEQ ID NO: 120250 - DNA, 4790 bp, Homo sapiens
ctcactctatcgcccaggctagagtgcagtggcaccatcttggctcactgcaacctccacctcccgggttcaagcagtacttgtgcctcagcctcttgagtagctgagattacaggcacgcgtcaccacacctggctaattttttttttgtatttttagtagagactaggtttccccatgttggccaggctggtctccaactcccggcctcaagtgatctgcccacctcagcctcccaaagttctgggattacaggtgggaatcacggcgtctggccctgcttcatgcgtttttggtatctttccgcccccagcacctgaaggggaagaacgtgatccacccattcctgtctcggagccttcccattgtcttcgatgaatttgtggacatggactttggcacaggtgggcaaggggctggtcctgtggggagaggaaaagactggagctgcaccctagctgtccatcttctctcagagaaaaagaaaataagcttcagccaaatagacagagcttggggtggttctcaagggactgtattagacaagtgggggccaggagtggtctcggagctacatccttcagcaaaagaggtgagtgtaggaaggaactccgtggagtccctcatgacctgggcatcctgatgtacacccaggtgctgtgaagatcacccccgcacatgaccaaaatgactatgaagttgggcagcggcacgggctggaggccatcagcatcatggactcccggggggccctcatcaatgtgcctccgcctttcctggtgaggctgcctgaggcaagagtgcccgggtcagggagatggagggatggctgggcatcgccatgatgaggcctcattcctacccagggcctgcccaggtttgaggccaggaaagcggtgctggtggcgctgaaggagcggggactgttccgtggcattgaggacaaccccatggtggtgccactttgcaagtgagggtgggggcctgggacgggaggaagatggagggctcctcagggttttaccgcctggccttctcacctacgtgtacccccagccggtcgaaggacgtggtagagcctctgctgcggccgcagtggtacgttcgctgcggggagatggcccaggctgccagcgccgctgtgactcggggtgacctccgcatcctgcctgaggcccatcagcgcacatggcatgcctggatggacaacatccggtgtgtagggtcctcagtgtgggaggggcttgccgagggctgagcagggctcactcgggccaggctccatcaggccctccctgatttctcctccccgacatttgcagggagtggtgcatttccaggcagctgtggtggggccatcgcatcccagcctactttgtcactgtcagtgacccagcggtgccccctggggaggtgagcagagggccagagctagctgctgggacaccctgctggagtggtgggtttactgggtccttggtggggggaggggcagggtgagccagaagcagacacacccccttgggtaatcactgcacctgtggcaggaccctgatgggcggtactgggtgagtggacgcaatgaggcggaggcccgggagaaggcagccaaggagttcggagtgtcccctgacaagatcagtctccagcaaggcaaggcggggctttgagggtctggagggagttgtggggggcagagctccactccctctgacctctgacctttggcctctctcagatgaggatgtattggatacctggttctcctctggcctcttccccttatccattttgggctggcccaaccaggtgtgttcctggggccggggcttggcgggacaggggactggagggtgggtgttggctccccttcacaccctggtctgccctcagtcagaagacctgagtgtgttctaccccgggacactgctggagaccggtcatgacatcctcttcttctgggtggcccggatggtcatgctgggcctgaagctcacgggcaggctgccctttagagaggtgcggagacagccgagaccctcccatcgcccccagcctcctctcctaccgtcctgtgctgcagcgcagaccccgcgtggctggggcatggggttagctgtgggcaggcctgacccgggggctggtgtggggttgaaatccagcctgggccctgctcagtgattcctgtgcccagggcttcatcttcccagaggaaggagtgcttctgattcacataaaggcgctcaacgagctcttggggacactcagtgggacctgaggttcacagtggggtagaccagacacagtcctggtcggggcactgaggccggggaaggagaggactgagtctcatgggcctccccacctgctctgcaggtctacctccatgccatcgtgcgagatgctcacggccggaagatgagcaagtctctaggcaatgtcatcgatcccctggacgtcatctatggaatctccctgcaggtgggctgggtgctgggccagccaggaagggccgtggggctgtggtcacagccacctgactgctcccactccaccctcagggcctccacaaccagctgctgaacagcaacctggatcccagcgaggtggagaaggccaaagaagggcaggtatggagggttgggctgggctaagcaggagcacagcgtggatggggctggctgaggacgctcctccccctgcctcttccctgtagaaagctgacttcccagcggggattcctgaatgtggcaccgatgctctccggtttggattatgtgcctacatgtcccagggtatggcccccaaagcgtccctcccagccactccttcctccttctgtgaggcccatccctcttctccaccctgagcctctggtgggcatgggctgggaagagggtgatgaggactcacatctcacccccgacccaggtcgtgacatcaacctggatgtgaaccggatactgggttaccgccacttctgcaacaagctctggaatgccaccaagtttgcccttcgtggccttgggaagggttttgtgccctcacccacctcccaggtaagggcctggtgggcagcaaagctggcagcactcacacaggctgtacccctgtccggagcagcctccatgtagctggggggacagatagacacagagacagacagttaaagggaaagcccagcgcattgggggctggggcctgtcacttcttcccagatcctggcacataggtggttgctttggactcatcagactctggatgaagatttgcccatgactcctgcccccatggggttctggcaccctcccctggcccgccggctgatacaccctctctccccaagcccggaggccatgagagcctggtggaccgctggatccgcagccgcctgacagaggctgtgaggctcagcaatcaaggcttccaggcctacgacttcccggccgtcaccactgcccagtacagcttctggctctatgagctctgtgatgtctacttggtgagaaggagcacagcggggcaggggatggtgggggcaggtgggcagcagagccctgggctcagttttgccagagttggccttgagacctaagccaacccatccccttcccagtcctcacaggcacagcgagggctcaaggctagacctccagccgtgagccctgtacctctcgtcccctaggagtgcctgaaacctgtactgaatggggtggaccaggtggcagctgagtgtgcccgccagaccctgtacacttgcctggacgttggcctgcggctgctctcacccttcatgcccttcgtgacggaggagctgttccagaggctgccccggaggatgccgcaagctccccctagcctctgtgttaccccctacccggagccctcagaggtatggcatggcctggagaggggagtctgacctgccctccaggccccctcaccccctcctccaccccacagtgctcctggaaggaccccgaggcagaagccgcccttgagctggcgctaagcatcacgcgagccgtgcgctccctgcgggccgactacaacctcacccggatccggcctgactgtgagcctcaggcccccatgtccgccccatcccactgtcccctcagcctactctgggacccagtgtccggcagtgactgcttggtttcctgtctccatggagctaggcctcacctttctccctccctggcaggtttcctggaagtggcggatgaggccacgggcgccctggcatcggcggtgtcgggctacgtgcaggccctggccagcgcaggtgtggtggctgttctggccctgggggctcccgccccccagggttgcgctgtggctctggcttctgatcgctgctccatccacctgcagcttcaggggctggtggaccctgcacgggagctgggcaagctgcaagccaagcgagttgaggcccagcggcaggcccagcgtctgcgggaacgccgtgctgcctcgggctatcctgtcaaggtgccgctcgaagtccaggaggcagatgaagccaaggtgtgtggcctgggtgggcatttcccacaccatccccttcctccatcaaaaccctggtctgggctggtccgagtgcagtggtgttgacaactaattgatcgtaaccagttacagatttctttgttccttctccactcccactagccttaaaaaacaaaacagcctggctcagtggctcacacctgtaatcccagaaatttgggaggccaaggtgggtggatcacttgagcccaggggtttgagaccagccaacatgg

SEQ ID NO: 120251 - DNA, 1189 bp, Homo sapiens
agcggcaccttgacaggatagcccgaggcagcacggcgttcccgcagacgctgggcctgccgctgggcctcaactcgcttggcttgcagcttgcccagctcccgtgcagggtccaccagcccctgaagctgcaggtggatggagcagcgatcagaagccagagccacagcgcaaccctggggggcgggagcccccagggccagaacagccaccacacctgcgctggccagggcctgcacgtagcccgacaccgccgatgccagggcgcccgtggcctcatccgccacttccaggaaacctgccagggagggagaaaggtgaggcctagctccatggagacaggaaaccaagcagtcactgccggacactgggtcccagagtaggctgaggggacagtgggatggggcggacatgggggcctgaggctcacagtcaggccggatccgggtgaggttgtagtcggcccgcagggagcgcacggctcgcgtgatgcttagcgccagctcaagggcggcttctgcctcggggtccttccaggagcactgtggggtggaggagggggtgagggggcctggagggcaggtcagactcccctctccaggccatgccatacctctgagggctccgggtagggggtaacacagaggctagggggagcttgcggcatcctccggggcagcctctggaacagctcctccgtcacgaagggcatgaagggtgagagcagccgcaggccaacgtccaggcaagtgtacagggtctggcgggcacactcagctgccacctggtccaccccattcagtacaggtttcaggcactcctaggggacgagaggtacagggctcacggctggaggtctagccttgagccctcgctgtgcctgtgaggactgggaaggggatgggttggcttaggtctcaaggccaactctggcaaaactgagcccagggctctgctgcccacctgcccccaccatcccctgccccgctgtgctccttctcaccaagtagacatcacagagctcatagagccagaagctgtactgggcagtggtgacggccgggaagtcgtaggcctggaagccttgattgctgagcctcacagcctctgtcaggcggctgcggatccagcggtccaccaggctctcatggcctccgggcttggggagagagggtgtatcagccggcgg

SEQ ID NO: 120252 - DNA, 1189 bp, Homo sapiens; identical to SEQ ID NO: 120251

SEQ ID NO: 120253 - DNA, 1002 bp, Homo sapiens
cccttcctggctggcccagcacccagcccacctgcagggagattccatagatgacgtccaggggatcgatgacattgcctagagacttgctcatcttccggccgtgagcatctcgcacgatggcatggaggtagacctgcagagcaggtggggaggcccatgagactcagtcctctccttccccggcctcagtgccccgaccaggactgtgtctggtctaccccactgtgaacctcaggtcccactgagtgtccccaagagctcgttgagcgcctttatgtgaatcagaagcactccttcctctgggaagatgaagccctgggcacaggaatcactgagcagggcccaggctggatttcaaccccacaccagcccccgggtcaggcctgcccacagctaaccccatgccccagccacgcggggtctgcgctgcagcacaggacggtaggagaggaggctgggggcgatgggagggtctcggctgtctccgcacctctctaaagggcagcctgcccgtgagcttcaggcccagcatgaccatccgggccacccagaagaagaggatgtcatgaccggtctccagcagtgtcccggggtagaacacactcaggtcttctgactgagggcagaccagggtgtgaaggggagccaacacccaccctccagtcccctgtcccgccaagccccggccccaggaacacacctggttgggccagcccaaaatggataaggggaagaggccagaggagaaccaggtatccaatacatcctcatctgagagaggccaaaggtcagaggtcagagggagtggagctctgccccccacaactccctccagaccctcaaagccccgccttgccttgctggagactgatcttgtcaggggacactccgaactccttggctgccttctcccgggcctccgcctcattgcgtccactcacccagtaccgcccatcagggtcctgccacaggtgcagtgattacccaagggggtgtgtc

SEQ ID NO: 120254 - DNA, 1002 bp, Homo sapiens; identical to SEQ ID NO: 120253

SEQ ID NO: 120255 - DNA, 2354 bp, Homo sapiens
ggttttaccatattggccaggcttatcttgaagtccccacctcaggtgatccacccacctcggcttcccaaagtgctgggattacaggcgcatgccaccatgcccagctaattttgtatttttagtagagacggggttttaccatgttggccaggctcatctcgaactcccccacctgaggtgatccacccacctcagcctcccaaagttctgggattacaggcgtgagccaccgcgtccggcctccctgcttctttatttagtccactgactccttgcctgaagcctctgctttctttggtgccaggccccactggcctggctcaccctctggtcctccatgccccctaacaggcaccgcatgcgtggggagaccaccctgtggaaccctggctgtgaccatgcaggtattgccacccaggtggtggtggagaagaagctatggcgtgagcagggactgagccggcaccagctgggccgcgaggcctttctacaggaagtctggaagtggaaggaggagtgagtatgcagcatccctgtgggcatcgcagccctgcctccctgtcccctatccagaagacctctgtcacctgtaaccccttggccacagggtcagaccctcccacagaggcagagtcagttggctctagggcccaggtaaatttcagggggatgggtgatctccacactgcccagtcagccacctgatgtctccctctagcccaggcacgagtgctgacctcagcctgtctgcttccaggaaaggtgaccggatttaccaccagttgaagaagcttggcagctccttggactgggatcgagcctgtttcaccatggaccctgtgcgtgggaggagtgtcaaagctggggcaggagtaggagtctccccagggtgggacccccacaggagaaagcagaggtgttgtggccctctctcaggagctggcccatgtaaaacaccatggagggctcagctgcaaatgccacttcccacccctcgccatggccctttccatatcatggcccttcatgttccctgtcttggctctgggagctccagattcctccagatggcacatgatcaggaccccgtctcccatggagcctgaactcccagtgtcctctgcaccagtacttgtccccagctgattgtcttcctcgccatctgcagcattacaaggcttgttgcctgctcttgtgttcccttagtcctctctccccctcaaggaaagaaggaaagtactcccctcagaggggtctttgtgctggccagtgggactctgtatgggcaaggcctcactggagccctgggtgtctgcctgggcctccaggcacaaggcccatctctctgacttctccctcctccaccccagaaactctcagcagctgtgacagaggcctttgtccggcttcacgaggaaggcatcatctatcgcagtacccgccttgttaactggtcctgcaccctcaactccgccatctctgacattgaggtgcgccccccaacctggcctgtctccatctccaatctaccctggccctggccctggcccctgggccacgcctctaaatacccattttacaggtggataagaaggagctgacaggtcgcaccctgctctccgtgcctggctacaaggagaaggtggagttcggggtcctcgtgtcctttgcctataaggtccaaggctcaggtaggagccaggggcaccaggatcctgggctgggagtggcaggaaggggccaaggccaagaccacaaggccttctgtcaccccagatagcgacgaggaggtggtggtggcaacaactcggatcgagacaatgctgggagatgtggctgtagctgtgcaccccaaagataccagataccaggtgggggactgtccacagttagggaaggagttctggccaaaaagggctcccatccttatggggtggaggggttggacttaggcccctggctgaggagaggaaactgggttagaaactggtcttcagcttctttcccagctctgagggtagagctattggggactgtttgggggagttcaagtgttgggatagtcagggccctggaaaggaaggacttgggcccagcccttcgtgcatttttaaaaagttaaatagccaggcacggtggctcatgcctgtaatcccagcgctttgggaggctgaggcaggtgaatcataaggtcacgagttcgagactagcctggccaacatagtgaaaccccatctctactaaaaatacaaaaaattagccagttgtagtggcgggtgcctgtaatctcagctactcaggaggctgaggcaggagaatcgcttgaacctgggatgcggaggttgcagtga

SEQ ID NO: 120256 - DNA, 1138 bp, Homo sapiens
gccactacaactggctaattttttgtatttttagtagagatggggtttcactatgttggccaggctagtctcgaactcgtgaccttatgattcacctgcctcagcctcccaaagcgctgggattacaggcatgagccaccgtgcctggctatttaactttttaaaaatgcacgaagggctgggcccaagtccttcctttccagggccctgactatcccaacacttgaactcccccaaacagtccccaatagctctaccctcagagctgggaaagaagctgaagaccagtttctaacccagtttcctctcctcagccaggggcctaagtccaacccctccaccccataaggatgggagccctttttggccagaactccttccctaactgtggacagtcccccacctggtatctggtatctttggggtgcacagctacagccacatctcccagcattgtctcgatccgagttgttgccaccaccacctcctcgtcgctatctggggtgacagaaggccttgtggtcttggccttggccccttcctgccactcccagcccaggatcctggtgcccctggctcctacctgagccttggaccttataggcaaaggacacgaggaccccgaactccaccttctccttgtagccaggcacggagagcagggtgcgacctgtcagctccttcttatccacctgtaaaatgggtatttagaggcgtggcccaggggccagggccagggccagggtagattggagatggagacaggccaggttggggggcgcacctcaatgtcagagatggcggagttgagggtgcaggaccagttaacaaggcgggtactgcgatagatgatgccttcctcgtgaagccggacaaaggcctctgtcacagctgctgagagtttctggggtggaggagggagaagtcagagagatgggccttgtgcctggaggcccaggcagacacccagggctccagtgaggccttgcccatacagagtcccactggccagcacaaagacccctctgaggggagtactttccttctttccttgagggggagagaggactaagggaacacaagagcaggcaacaagccttgtaatgctgcagatggcgaggaagacaatcagctgggg

SEQ ID NO: 120257 - DNA, 1138 bp, Homo sapiens; identical to SEQ ID NO: 120256

SEQ ID NO: 120258 - DNA, 1074 bp, Homo sapiens
ggccatggcgaggggtgggaagtggcatttgcagctgagccctccatggtgttttacatgggccagctcctgagagagggccacaacacctctgctttctcctgtgggggtcccaccctggggagactcctactcctgccccagctttgacactcctcccacgcacagggtccatggtgaaacaggctcgatcccagtccaaggagctgccaagcttcttcaactggtggtaaatccggtcacctttcctggaagcagacaggctgaggtcagcactcgtgcctgggctagagggagacatcaggtggctgactgggcagtgtggagatcacccatccccctgaaatttacctgggccctagagccaactgactctgcctctgtgggagggtctgaccctgtggccaaggggttacaggtgacagaggtcttctggataggggacagggaggcagggctgcgatgcccacagggatgctgcatactcactcctccttccacttccagacttcctgtagaaaggcctcgcggcccagctggtgccggctcagtccctgctcacgccatagcttcttctccaccaccacctgggtggcaatacctgcatggtcacagccagggttccacagggtggtctccccacgcatgcggtgcctgttagggggcatggaggaccagagggtgagccaggccagtggggcctggcaccaaagaaagcagaggcttcaggcaaggagtcagtggactaaataaagaagcagggaggccggacgcggtggctcacgcctgtaatcccagaactttgggaggctgaggtgggtggatcacctcaggtgggggagttcgagatgagcctggccaacatggtaaaaccccgtctctactaaaaatacaaaattagctgggcatggtggcatgcgcctgtaatcccagcactttgggaagccgaggtgggtggatcacctgaggtggggacttcaagataagcctggccaatatggtaaaaccctgtctgtattaaaaatacaaaattagctgggcgtggtggcatgtgcctgtaatcccagctacttg

SEQ ID NO: 120259 - DNA, 1074 bp, Homo sapiens; identical to SEQ ID NO: 120258

SEQ ID NO: 120260 - DNA, 1158 bp, Homo sapiens
gagccaggcctctctctcatcagccaggtgaggaagggcgaggagttggaggataggggcttccctggggccttccatgcaactcactttctttttttcctagaaatggcagaatcactggggcagggtcctgcgggagaggagggagaggggggaggtcagcatgggcaagacctcgggcatctaaaataccccatctgaaacctagtatggccgtccaagagggtccccagctggctgagtctgaatttctgcacctctctctaggccccgaggctcctgccctcccaaagacagctgctcagctcaagaaagaggcaaagaaacgggagaagctagagaaattccaacagaagcagaagatccaacagcagcagccacctccaggggaggtgaggcgagggtggagctggaaggaaagttgatgtgtgcggtgatgggttggctgatgcctgggcctatgtcttctccctcccaagcagaagaaaccaaaaccagagaagagggagaaacgggatcctggggtcattacctatgacctcccaaccccacccggggaaaagaaaggtactaggagtgggaaggggctcacccctcagcagccccttctaagttttcaccctatcttgctctattcttgctctcaccactttgtttggtgaggaattgcagaccccctgccctgcctctaggcccctcaaatgcctgtcctatgatgtgagtgacggagatcccgatccctctctgccagcacgtctccttcccagagtgctcccagccacggcactgagccctcccttcctctcccccagatgtcagtggccccatgcccgactcctacagccctcggtatgtggaggctgcctggtacccttggtgggagcagcagggcttcttcaagccagagtatggggtgagtaggcactgctgcccaggcccagagtgggtggggtggggaagggcaggactgaaggatgtgttgcctgggaggggctgggagaggtgacctgaggccttaaacatgtgccatccttctccaccatcagcgtcctaatgtgtcagcagcaaatccccgaggtgtcttcatgatgtgcatcccaccccccaatgtgacaggctccctgcacctgggccatgcactcaccaacgccatccagg

SEQ ID NO: 120261 - DNA, 1051 bp, Homo sapiens
ccgacacggagttaataccagctgcctgtggagcaacgctgccggccctgggactccgaagctcggcccaggacccccaggtgagggggttgtacagaagagggggaggggagaaattcagaggagggaagcgaggactggaatggacaatgagacaagaaggtagtacatcagatgtgggaaaagagtgatcaaatcccagattgccaactggtatggtaaccctgggcacgtttcatagacccgctgtgtcttggtcttcctatgtctatgaacacgcaggcaagttgatgtaatgcttgcctcactgagttaataggattaaaagatgtgcgcagagcacatagtttagtgccaggcacttttaaagtctcttagtaaaagtttgatgagtctgaaattgatgaggatagaagttatttgaattgtaggaaaagactgggtgagggagagatgacaattgctgggaggagataaaagagaaatgaaatgaggaaggtaagtgagaggagagataaccctgccagattgtaactatcagtccttccaaaggagacctgtgccttggtgtactttcaactctgcctccttgcatggtattgagcacatgatggaaaattagtatttcttgaatggatgaatgaatgtggcagaccctgacttgctccctcatattgtgatcaccctatctacaatagagtccttgcattcagaatgtctgtccaaacaaacaaataaaatagagtccctctcttctggaattccctgtttgttcccctcttttatttcttttcttttcttttttttttttttttttgagacagaatctccttctgttgcccaggctggagtgccacggtgcgatggtgcgatctcagctcactgctcaagcgattctcctgcctcagccttctgagtagctgggattacaggcgcccaccaccttgtccggctaattttttgtatttttagtagagatggggttttgtcatgttgaccaggctggtctcgaactcctaacctcagatggtctgctcgcctcggcctccca

SEQ ID NO: 120262 - DNA, 1001 bp, Homo sapiens
ctgtaatcccagctagtcgagaggctgaggcaggaaaatcatttgaacccaggaggcggagattgcagtgagccgagatggcaccattgcactccagcctgggcaacaagagcaaaactcttgtctcaaaaaaaaaaaaataataataataatggtgttcatcttcctttcctagtatctcaacatcaaactaactgacatcagtgtcacagaccctgagaaataccctcacatggtgagttggggtctgtggagaagaggaaacacctctaaagcaggaggcccctgggtggttagaggacatttttaagggtgttttcatatttgtccatctttgtctagttatcagtgaagaactgcttcattcggggctcagtggtccgatacgtgcagctgccagcagatgaggtcgacacacagttgctacaggatgcggcaaggaaggaagccctgcagcagaaacagtgatggctcctcctcctcttcccctccctctttcattggtgacccataaccccaagtcccagcccagaacccctaacccccaatacttgaaggggttttgtttttttactaatgatggttttgtgggttttttttaagggatgagtggatgagaggagtaatagggaacagctatcctctcttgagaaggggaggataagtaggctgggaaacttcaaagccttcccagtccccagcacctgcctttctcactacttctctggagatggtaggagagtttcctaggtctttccagggcagcatgtgattcatttggggatggaaggaatctgtcccgcatcgggaataaaatttatgatgcaaatttgtgttttggttctgttactatgtgttgggcagggggctgggacatggaaaaggatgtcgaattcatccaagcccctgttactctgcgttaacccagccaagaatccaactcagcttcccactactctccttggtataaagcatataatacagttgctctacaccatgtt

SEQ ID NO: 120263 - DNA, 1042 bp, Homo sapiens
tgtactgtttctcaggttcattgaggaggcactgagaacaaatgggatattttttccatgatgagggaaaaaaccccaaccctgagagagattcagtgaggatagcgggagacggaaaagttagacctcagagcacttctctgccaggcaagcttcggcagggtgcgggtgggatattttctacaattcattgaaaggagtgggcaggtacccgagaaaggtggtcgactgagagagcacagtggggaggccgacgtatgcagggcagagtctctctgggactttaagtgatgggctcagtgcagtgtgcagaataatttgggctccagcctttcagctctgtcaaccaattattctttcctgtgaaattttgagaactgtcagggatgcagtggggttcacaataccagtatttggtaatactgtcaaaggacactcctccctaccatgctccttcccacatgatggttttccccctctctcccaatagctcttctattcttttttcaagtcccttgtgggcaaggatgtggtcgtggaactaaagaatgacctgaggtaggtacctgttccaacaagtctgttgggggtgggtgtgcccagggccctggaacctctttaatttgagaaatatttcagggctaggcgaggtggaagatgtacagaagaaataaatggatagggtgcagtggctcaagcctgtaatcccagcactttgggaggctgaggaaggaggaaagcttgagcccaggagtttgaggctgcagtgagcagtgattactccattgcactctagcccaggcaatagagcaagaccccatctctaagaaaaattttaaaatttagcaataaataaatgccttgtgccttaaatttacagataagcttagagattgtatcgtgtattggaaaacaatacaaagcaatatatagtttaaagagtaaatacaggtcaggcgcagtggctcacgggctggacgtgtggctcatgcctgtaatcccagcactttgggaggccaaggtgggcgaatcacgaggtcag

SEQ ID NO: 120264 - DNA, 1210 bp, Homo sapiens
ggagcagcacccggctggcgctggccggccggcgccggggactttcttccgcctggccagacagatccctgttttttgtttttcaaaattcagaaagcatctccgaatatttgcccagaggagtgtgaaacatactttcctggtctttctttcactttgttttatttctgtgtggacaaacaatggggaaaatgccgcgcgtctagccaggcagataagaaaacaactatacccgtcaggcccccaacccggcgccgccataaatggccccggcctcgccattttagttctttttgcgaagtgggctcgtgggttggcagtatgagagttgtaatggcccgactgttgagtgagggggagcaggggatcccaacggcttgcgctgcctttgcgcagcagccggcgggcggccacgtcgcggcctggctggggtaggagagggcggtccccagtgcagttgggtgaactaccgttgcacactggagtttctggtgtctttgcttggaactgacctagctcgtggcagggggaactcggctagcggccccacagcccctgctgactcaaaacaactgtgagtggggttgggcgagtgattgcaaaatgggggtggcggtcgcccggggataggaagggagtgatgatgaccccaggtaactcttgagtgtgtcgctgatgccatcaccgcagcgctctgaccgccccctcggtccagcatttctcaggctcaacgagttcatggccaagattcctaatcttttgttctgtttcatttccccgttaggagttgtaagacgttcatcgccgtgttatccttgagtaaaggtgagtattaggtgcgagagccttttgaatgcctcttcggaaagctttgttcccaagcaagctttcgttcatgggcattatgcgcctccctgcccttttttttttttttttttttgagacagtctcgccttgtcacccaggctgaagtgcggtggcacgatctcactgcaacctgcgccttctgggatcaagcgattctcctgcctcagcctcccgattagctgggattacaggcgcatgccaccaagcctggctaattttttgtattttttaatagataaggggtttcactgtgttagccaggatggtctcgatctgctgacctcgtgatccgcccctctcggcctcccaaagtgctgggattacaggcgtgagccaccgcgcc

SEQ ID NO: 120265 - DNA, 1575 bp, Homo sapiens
cacccagttccctttcccacagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatgatttcaatcctgatgaatgccaggtcaggagtccatgagatgttccctacccatttgaccctccctgccctccagaacatcatttcacgcacagacccagggtctgactgctccactcagtgccacacacccttgctcccctcggggacagggcattttccctgttccctccctgaggtcctgtcctctcccctcagccctatgagctcccagatggctcagtcgtcatcaatgcccgaaaccagaacaactaccactgccactgccgaattgtcctccgcagctatgatgcctgtgatacactaaggccccgtgatgtgaccttcgaccctgagctcgtggaccctgtggtagctgcaggagctgtagtcaccagctccggcattgtcttcttctccaacccagcacatccagagttccgtgagtgcctcatgggtggggtcagcagggagagccctgtgtctagacaaggcctgggcagagaccctctctccctgactctcctgctctccccaggagtgaacctgaccctgcgatggagcttcagcaatggtacctcatggcggaaagagacagtccagctatggccaggccccagtggctattcatccctggcaaccctggagggcagcatggatggagaggagcaggccccccagctctacgtcctgtatgagaaaggccggaaccactacacagagagcatctccgtggccaaaatcagtgtctatgggacactctgagctgtgccactgccacaggggtattctgccttcaggactctgccttcaggaacacgggtctgtagagggtctgctggagacgcctgaaagacagttccatcttcctttagactccagccttggcaaaatcaccttccctttaccagggaaatcacttcctttaggactgaaagctaggcgtcctctcccacaaaaaagtcctgccctcatctgagaatactgtctttccatatggctaagtgtggccccaccaccctctctgccctcccgggacattgattggtcctgtcttgggcaggtctagtgagctgtagaattgaatcaatgtgaactcagggaactggggaaggctgagcctcctctttggtgttgcggtaagataaccgacagggctggtgaaagtccccagatggcaggatatttggtttcagagtaaggactaggtgcaccaccatgactgactatcaatcaaaatgtttgtaacttaaaatttttaatgaaggataatgaatatttgtagagtctctatggttctgtcaatgcacatcttcgtgtctgttttcctcatgtatccttgtgagcctgggtgagttctggggagagacctgatgtgcgtactgcctgtgaaaatctgactttggcaaatcaaa

SEQ ID NO: 120266 - DNA, 1048 bp, Homo sapiens
acatgcatcgagatggatctcaacagataagaactgtttaaaagcatagccactatatcattatcacatctcacaaaattaacaataattccttaatatcatcaaatacccagcctgttcaatttgccggaaagggttttggtagacgttgcagaggctgctctggaatgggaatgctgagtgagtgccttcccctctgattgagactgagggagctgattatgcttatgctataggcagaccaaactgagtttgagcctggagatggaactctccgacagaacttgattcccgcagtccagagaagctacttcccacctgtcaactctgggaggggcaggagctactgggaatgggacgcccaggctccatactgaggcccccgatgcctgagcctactctatccccgtctaccctcccaggcccaccttgtgaactcctcgtgcccagggctgatgtgcgtcttccagggctactcatccaaaggcctaatccaacgttctgtcttcaatctgcaaatctatggggtcctggggctcttctggacccttaactgggtactggccctgggccaatgcgtcctcgctggagcctttgcctccttctactgggccttccacaagccccaggacatccctaccttccccttaatctctgccttcatccgcacactccggtaaggatggggcaggggcctggtcattgtaggcacgggggccccaggggtcctggagctgtctctgactgcataacaccctctgcagttaccacactgggtcattggcatttggagccctcatcctgacccttgtgcagatagcccgggtcatcttggagtatattgaccacaagctcagaggtgagtctggagtcggagtaggagtcaggagctggggaaggccattagggaggggcagtgaccaaacatgagccttcctcgctcccaggagtgcagaaccctgtagcccgctgcatcatgtgctgtttcaagtgctgcctctggtgtctggaaaaatttatcaagttcctaaaccgcaatgcatacatc

SEQ ID NO: 120267 - DNA, 1838 bp, Homo sapiens
cgacccagagacgttaagtgacttacccagggtcccacagcttgtgaatggtggagctgggattcacacacacagccaatcttgaccatttgctgctttggtgagcagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgtgagtgagcgtttggttgaggtagggcagccccaggcccctgagcaaggtggaggctggattcaagggcccagctgcctgcacctcatctgttcccctcctacctccacaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgtgagcccctgccccgcccttgatgcccctgcccccacttcttgcagcctcagaccctgcattgggcatcctgtcccctcttcaggttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccggtgagccctgggcccctctctgcacccaagaccacctcctccccacccataccctccccaggctccattgcatcctcacaacattccccaacccctccccatgcaccactgaatccccagaaccacccacaggccccctccccactagggttgccagatacagcaaataaaaatagaagacacccagttaaactggaatttcagatgcacagatgcatacttttttagtgtgagaatgtcctgtgtaatttttgggacatactaaaaagctatttcttgtttatctaaaattctatgttaactcgctgtcctgcatcttacctggcaaccttactcccctgcccccagccccaggaacctccccaactctcttccttatacctggagtagctcctcacccccttttccagcttcccagccccttcttcccgtcttctgcagggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcaggtgagtagggggcccggggcctccccaaaaggacaccgagagctgccaagtacagttggacaagcttcaaaccagcaaaggcacctggccaaggaagggttggctgaaagggagccctggtgtggggtcgcatccccaccaggggagggatccttttcctaggtcacagcaaggtatcatatgagctcccagtagccctggggacaccaccatactgattacccgtcaccctaggaccatcaccacccactgttgtaacacatggaccccaaagaaaggacagtggttagggggtcagggggcatcaagagtagaggggcccagaccgatcatggggttgagctgacctctgcctcctcgccccagcactgcacgtgtgtggacgactgctctagctccaactgcctgtgcggccagctcagcatccggtgctggtatgacaaggtgcgtgccccttgccttggccacagacacccggcc

SEQ ID NO: 120268 - DNA, 1050 bp, Homo sapiens
ggggctccaggctaacccaggcaaaactgtaggtgctctctgaccctcagtgtgctccctctcggcccacagcccccggtccctgagaagcggccccctgaaatacagcatttccgcatgagtgatgatgtccactcactgggaaaggtgacctcaggtcagtcccatcccccacccccggtggcttgatgtggtctgttctgaaggtttcggtgataggccccacaccattctctctcttcttccagatctggccaaaaggaggaagctgaactcaggaggtggcctggtaagcagcagaggcagagcctctacccctcgggggctgctctgagggagggtcagaggtggggctgcatcccatcctcagtagaaatgcgcagggtgtcagtggcctcaatttttctgatctttttctagtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaaggtgagacagagctggtctgccctccccgccggtgctcccccagggctggggctcactgtccagtcctccttgttccctgtttttctgctttctgtcctttttatcttctgaatatccactaagtcattgccccatgctgtctataactccttttttttgtggggggagacggaatctcattctgtcgcccaggctggagcgcaatatcacgatctgggctcactgcaacctctgtctccagggttaaagcaattctcctgcctcagcctcccgagtagctgggattacaggcacctgccaccacgcccggctaatttttgtatttttagtagagacggggtttccctgtgttggccaggctggtctctaactcctgaccttagttgatccacccaccttggcctcccaaagtgctgggattacagctgtgagccaccgcgcccagctgtaactcattttcaatgtgtattctgc

SEQ ID NO: 120269 - DNA, 1853 bp, Homo sapiens
cctgggagggggtctgggcattggaggctccgtgggtggccaccttggggagctggcccagagcagcgttccccccagcactgtagccccaccgcagggtgtggtgaaggcctgctatagcctgtcggaagatgcagaaggggagggcctgctgttgattcccggaggccgggccagcgtgggggccacctcgggcctggtggaagcagcagcggtggccatggctgcccggggggcggggggcagcctgggggcggggggcagccggggacccctgcctgggggcttctcaggtggaaaccccttaaagaacatcaagtgcaccaagtgcccggaagtgttccagggcgtggagaagctggtcttccacatgcgggcgcagcacttcatcttcatgtgccctcgctgtggcaagcagttcaaccacagcagcaacctcaaccgccacatgaacgtgcatcgtggtgtcaagtcacactcgtgcggcatctgcggcaagtgcttcacacagaagtccacccttcacgaccacctcaacctgcactcgggagcgcggccctaccgctgctcctactgcgacgtgcgcttcgcccacaagcctgccattaggcggcacctcaaggagcaacacggcaagaccacggccgagaacgtgctggaggccagtgtggccgagattaacgtcctcatccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaatgttttattcctggctaaggctgcccaggggaaggttctgacatttctcgagataagaagggttggggggtgggtgggaacagggagggaatttggcaggaggacatgctcctgcttagaatagacctggggtgagggagtggtaaggggaaaagattactgagtcccagaaaaggaagtgggagacagttcttgcatgctggggaaatgagactgcgagtatgaggcttgctgaaatttgagggagaacaaagtaagacgccaggtaagagaacgtggggtgcgcatcctgggtagatattgggaagtgggggtacaatagcaagaaacaatggatagtcatgggggtgggggggatagggcacttagaaaagaaagaacacaagaagggctgttgggagggagggagaggagtagagacatacagtattttttaagaaaaaacatattttttaggattttttctggagtttggggttttagtttttctgcttttgttttccacaaaataaaaaacaaaaaaaaacttttttttttcctttacactctggcaactgcgtgtacatgactatcctgccctagacagcctctccctgtgatgctgcgttcttaatacctagaggtcacaactctgcatatcccttgcctgaaggagcccagccctaaacatgggagaggagtgtgacaagtgagctcctctggtcagggactcccccaagtccccacccccagccctccaccagttctgcaatctcaacacttagccaggtacctcacagtacaagtgattggcagtcgtggggatgcacatgaactctatttgagggacttaggatc

SEQ ID NO: 120270 - DNA, 1814 bp, Homo sapiens
cggccaacacagcgaaaccccgtctccactaacaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagaccatggggagagggtgagggagagggagctctaggaacattcttgcatgtgattttggtacatgtatgcacttgcttctcttgagtaaatgatctaaatgtggaattgtcacatcacaggctggcatatgtttagttgtagtagaggctgagaaagtttcacccacgtacatgccagcaaggtaacagagtgccagtcgctctgcatcctctccaacacttggaattacctgttgtttcagtgttagccgttttgatgggtgtgtagggatgcctcactgtggtttatgaaatataaatgttctctgaaggagtggagggaccatcagctgacttcttccctgggtctctgggggctctgggacagacatgggtgcatccctgggttggaactgggaagcttctgctggcaactgaggccgctgaggaggcagagcctgatgggagggggctactcacctctgccttcctttgttcactcgcagctggccactgccccaacccaggcatttcactgggcgcagtgcggacaggcttccgctttggtcatggggacaaggtccgctatcgctgctcctcgaatcttgtgctcacggggtcttcggagcgggagtgccagggcaacggggtctggagtggaacggagcccatctgccgccgtgagtagctgccctgccctcctgagattcctcggcacacccggccactgccccggctgactcctgtgtggctctccccacagaaccctactcttatgacttccctgaggacgtggcccctgccctgggcacttccttctcccacatgcttggggccaccaatcccacccagaagacaaagggtgagtgtttgaggtggggtttctggttgagcagggtgctggatctgggccggagcaagggaggatgcaaccttcctggaggccaggagccttggtgggctcagccactgaaagggagggaggcagagaagctggacctgcttggcgagagcgcaggaaggaggtggggatctgaatcctccccttccacatttctccagaaagcctgggccgtaaaatccaaatccagcgctctggtcatctgaacctctacctgctcctggactgttcgcagagtgtgtcggaaaatgactttctcatcttcaaggagagcgcctccctcatggtggacagggtcaggaatcaggagtctgcctgcagcagaggccttcctgtgctcactatctctctctgtctccttcccctcctcagaaccccactcacagcccacctcctccaagaagtcttctcagattatactcatgccatgtaggaatcatgaattcaatttatacaatcataatttttattccacaagcactgttgggacactgtgctggggctgggcgacagcaaagatggaaaggctgaggtcttactttccaggaattcatcatctagaacagtggtctccacagaaaggtagtgagataacccacaggagtgaagcagaaaaatactggtgcccctgtggaataatttaaatcagattaataatttaatatttaataatttccttttaaaacttcaacattttgtgcaggctttaaaatgtgtgtgatagactgggc

SEQ ID NO: 120271 - DNA, 1033 bp, Homo sapiens
ggctggagtgcagtggtgcaatctcggctcactgcaacatccgcctcccggttcaagcgattctcctgcctcagcctcctgagtagctgggattacaggtgtgtgccagcatgtctggctaatttttgtatttttagtagagacagggtttcaccatgttggtcaggctggtcttgaattcctgacctcgtgatctgcccgcctcagcctcccagagtgctgggattacaggtgtgagccaccgtgcccggctcacctcttctttttttttttttgagacggggttttgctcttgttgcccaggctggagtgcaatggcgcgatcttggctcaccacaaccaccgcctcctggtgattacaggtgtgagccaccacgcctggctctggcttacctcttcttataaggacctcagtcattggattagagctcaccctaatctagtatgacttaatcttaacttgattacatctgcaaagaccctttttccaaataaagtcacagatactggggattaggactcgaacacatctttctgggggacacaattccaccattacagggaataaacaggataagaaaaccatagaacccagcaggtggtaggtgacacaagctaaggggtgttgccatgttgcccaggctggtctcaaacttctggcttcaagggatcctcccaccttgcctcccaaagtggggatgaaagtttgtctggggcattgcagttttagacaggaagaccagggaaggcctcactgagaaggtgacatttgagccaagacttaaaaaggtacgaaagtgagccatgtggaagtctgggggggaggagtgaactaggcagaggcacagctgggcaaagggcctgaggtgtgaccatgcctatggatttgaggaacttcaaagaggctgtgtgctgcaggagagtgaagggcagggagtggcaggaaatgaaggcagacaggtagcagtggggaggacgcaggggtccagctcatgtaggtcttgattggacacagtgagtttcagatgacagc

SEQ ID NO: 120272 - DNA, 1050 bp, Homo sapiens
ttcgtgacccagtctgcattactgctgtctgcttcagacactttgacccaaattttggggtatgtggcatatgtcactagaccatatcttggcttcacaccataacttgccacctgtgggtgaggagaacaaggcgccatggcattgaaaatagaatactgtgattgggagatttcagcgactttgctgggacagggaggctctcagtaagaggctcaagggctgaggttcatggaggaattaccagtcaagaaactgcttcaagtaaaagggaaggaggacagaataggacctggagattttcctggggccctgttgttcagaggggctggaatgatcagggagctagtcctggaagatcagcgagattccattcccccgagttcagggataggaggattccaccttctcaattaagttgactagacactttttggctcctgtgaagttgctggccccaatgctgtctgatccatctagcaccaggtagatgttcatggagcctgaagggtccaggacgatcttccgcttctgttgttcccctgggtgccaggagagtggctcaggctccagcattaacagttctgtcccttctccattttcccccagttccctgccctgcctcccttctctgtcttcaaacctgggccgtgcccatcctcagcatcgactccttctatggtctctgtcagggaagacaggaaagcttcggccacctcttgaggggtgtcgtacatgaaggagtctgggagagtcagaaatgaggtcaaatgtctgggagtgtcagggatacagtgaccaaagagacgggggatcatgggtttccagggtataaaaggctcagaagtgagatagttgtacagggaggtttaaacaaagtgaggaaagagcagggttgaggtggggagagaagacagtaggatggaagaccaggatctgacctgggggtacaggtcaaaggtcaccttggcaggaaggctccgtcccgctccaagagccaccttcctgacacgttcgccgctgggagccacgcagggtaagcccccggct

SEQ ID NO: 120273 - DNA, 1990 bp, Homo sapiens
tcatagtcataaaattcaggaattcctgcttcttttttcccattaatgttgtagttggggtgaaataggactacttctatctccaggtcccgcttctcccctcctgaagtaggagagtaggtaccacctctttgtgggcagcttcctgcctctggccccgtgtcattcctaacttcacgtcttcccccatccctgactggtctggggtgcaaggaatggggctgcattgaggatgggtggagtgtaggatctgtagaaagtgggaggtgttgcctggagagcataggtgcagcccaggaccttcagttgcatccttacctacgctgaccttgattgagtgttccttgtcatccacagtgaaacaatgtgctgctgtcagcacaaagtactcagacaccacagcccccatacagctctcgtgtccctttgaagggcgctggggacacaacagtagagagggaaagctcaactttcacaaaccaccatctcttatggccattttttccttcccctactcccatttcaccttgacctcacctcccccaagtccccactactgggattctgtgcttacaatgactgagatcttggcctgccatggttgcttgtggtaatcggtacccttcctgtgttcccaaaccatgccacagagactcagagactggctttcatctggcagagaaggagaatgtgctgaaaactcggaacacttcattcccaaatggcagcagccttttgggtaggagtctatggggagcaaaggcccaaaaggagaaagggaaagaccacgggtatttgtttcctcgtgttaggagaaaactgctatggtggactgaaaagggaaagaacttgggatcaagctgtcagaggcctggctgttttcaagcccacccttgttgctaacttgctgtcccttgacctcctttggcttctgtttccacgtgtcaaatgtaggactatagaaagatctctgaagtgctcagagctctgtgattctaaggttaagtgaacagtgccaggaaacaagaatagtgacactgaggtagagaaggaggaatgaagaaggctttccaggcaactagagcttcaggtgtagaggaagaatgaattacttcaggggaacctgaggagagttgtgttctttattcccttgtatctccctaccgatcatttggtagaaaacatcttccaggttttccatatccttgactttgaacacatgttgctcattgtctttcttggaagccaaagcattgatgttcacttggttcaccaaaggcccgaccccaaacacatagacatctgagggataaaaaggaaggatgagggtccaagccctgaggaagtggggtgctgggtcctaggcaggttactcacccagataatcctcccttgggtttttgcgatccttgccaatgtatagcaagtcccggatctcatcaatgacagtaattgggtccccgcccatgttgtgcaatcctgcagaagagacaggaccatgagggtaggagataaggaagataaactggctaaaggcagggatacacatggcagggtgagcaagttgaggaagggttagagatagttgatcacagggcttaggaagaattccttatgaagggtcacaggagagatgaacagccagctatgagtcacattcagggccccaaccatgggtatagtgttacaagtggacttaagggccacatgctggtctgagaaggtggggaggctgggacaggagagaggtcccttctgaccatcagtcatgaggatgatgacatggcgggtgcggttccagccttcaggagggacgtcatctggccagctcatcatgctgtacactgcctggagggccttcttggtgttagtccctgacttcaacttgtggtctgtggagagggaagagaccatcacctcacctggtcttccaagccatcttttaaccccagagaccaatctgcaactgaaatcccacatctttcaactt

SEQ ID NO: 120274 - DNA, 1031 bp, Homo sapiens
aggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacctgcagaggcagtggggtgccatggatcattcagtagaattcctaatcctggaagcatggctgttcctgcttgtgtcttagctgacctaaaggaatcagactagggacccagctcagcctcgttcttgacacacgcaggcaagacatgcggtcctaaggtgaggcaggctctgcctacctcgaattactagccacatgcattgagctttcctgctttggggcccatgctgaccacttggcatctccccagataggaaagggaggactcacttgaatgaaacgacttctcttgtgaactatcaaggggccgccagaatcacctgcaaggagaggagaagctgtagagaaaaggactgttgggccttgggcacttgtagcacaaccaaagagcattctctcacctctgcaagtattggggtcagcatagggactcactcctccagtacaaaggaaccgaggggtgaccacctctgagatgtccttgactttgtcatagcctggggcatattgagcatctctctcacagctgcctttctgtaggggaggtgggaagcatggagaagtaatgaacagaagtggcttaggaaggattggggcctagagtgcctccttaggatgcccgtttctcaccttatccccattcttgatgtagacctccttccgagtcagctttttctcctcctcagacacaaacagagctttgatatcctgtgcagggagcagctcttcctctggacgaatagactgcgtcacttcagctgctcccaccactgtcatctccccattgcctttgtcactcagtagatgtcccctaagcc

SEQ ID NO: 120275 - DNA, 1268 bp, Homo sapiens
ggaagaaaagatcagaggaaacctagaagagggtgagggaagaggaacacctctggtccatggttgggcaacctcctgctccacactgaggtaggtctctcaccactccaggaccccgagaagggaccagtccccactttccagccgttccagaggagcatatctgctgatgatgacctgcaagaggtaaaggctcctaatttctgtccctgaggggttggggatggaggaatatgagagacaaatatattttggaccacatgtcagcaactggaaatcatcttaactgttcttggtctcttttacagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcagtgagtgattttggctggaggtcaaggtgaccttaactgaggtttatgtgggtcctactaagtgaaatgtggcatggtctatgtcttgtgactatgatttgtgctcccaaagggtcggattcattccctgaacggcgagcccctaggaaagggaatactctctatgtatatggagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagctgccctccctgcagccgcctattatcactgggtttggttgggtccagaagagccccttggctctccactgaccgtgttttctcttatccc

SEQ ID NO: 120276 - DNA, 1075 bp, Homo sapiens
tcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaaggtgagggactgtgtgtggacatggcctaacctttcacagactctgcactctgagaagatatggggtgagtgtgagcgaatggggaagtttttctggcccatacctagagacatatcacctcacagtgtagcttcgagaggtgggctttcccaagccttggtgtggaccttctgtcttttctatgcaatttgccatggattgtcttcctttcccatggcttttagtaccgcttaagagctgatgatccccaagtttgttttttccagttctatccagtgttatactgaaaaacttcagatactcagtgttgaagctatcatctttctattcttgatcttccaaataagattgactacaccaattctgccacatgtttggactcaaaactctgacttccccactatttgcatagtcaaacctttgccaagtcttattgtttcttcttttgaagtaatttttcctgtttattcttcactgtg

SEQ ID NO: 120277 - DNA, 1032 bp, Homo sapiens
tttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattttctggatgtcctttatttactgtgacgtgtgtttgggtgccttgtttaggggtagaggtgaagtctgagctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttattt

SEQ ID NO: 120278 - DNA, 1017 bp, Homo sapiens
gagagctgctggacccacaggtgagaagcagcaggaagtaggtggagggaagagcaccatgcaggagacttgggagggagacaagggtgagggtccttccctggtgaaggtgcttgggtagatgactgggcagaggcggggggccgggaacctgctagactctcacttacttttttctcttgatgtcctctcctgtgtgaccccacactcaatgcccttttcttttcctaccctctccttgcccctgcaccaaactctgtccctgccatcctgtttaactcccgctatggatctgcctcctcactattgccctttctttttctctctgctcacctctacttttctgacctcctcccctcctccctgcaatccctgtttgcctccccatctcctcttccttaactctccccttctcacagagaccctgtcaggccgtggggccccgggggactatgaggagatgatgcagatcgagtgtgaggtcatggacaccagggtgattcacatcaagacctccacagtgcccccctcgctccgaaaacagccatccccaaccccaggcaatgccacaggtggccccttgccagtctctgcagccagccaggcccaccaggcctcccaccagcccctctacctcaatcatccctgacctctgccattcacactgacttagaacggggggagggggtaccaggtggccaggtgggactgtttcaaatttccctgatccccaggcttggggcaattggtaaaggaaagagcaggtgtgggggttaagcacttatttgaggtgggggtgttcacctctcttctcatcccttttcagaatatagggctcctctcattcctgtgaacccccagtcctggcttctttgtttgaggggattgtgtgaggttcagttgtggggtgggtggtgagctgctgcatattttttattttgtttctctagtgttatggcagtggaggtgggaatttagtccccaggtgggacaagggaagttttttcattttggagc

SEQ ID NO: 120279 - DNA, 1702 bp, Homo sapiens
ctgatgctgctcagcgagattgctgacccgacgcgtttcttcaccgacaacctgcttagcccggaggactggggtctgcagagtgaggcaccggggaggggagagggctgtggcaaactgtccctgaggcacgcgggaaagaagcgggggcctaaagaggaagtctgggcaaatacggaatccgccatctgaaggagagcggagcagggggctcgttgtgcattaagggggatacaaaagtcagggaagaactctgctccctgctggaacgtcgagttgttccggggtcggggaaggaggggctgaagcgccctggttgtatcacttttcaagtgggcgggcggtgggtctggccgagcggagccaatgagggatggggcgggggcttgtgtgcgatctgtaggctggggccaccgaacgaccccccgacgctcagcatttcttgcagacagcaccttgtattctggcctagatgaagtggccgaggagcagacgcagctcttccgttgcccggagcaggatgtcccggtattgtgtccccagcctttctctaacccttggtgggtggaaagtgagcccagaacctggacccattcacaggccataactcatctggagtcacccctactttctcatcctttctcacactcctgccctcttgtatcctcccttatttagtttgacggcagctccctggacgtggggatggatgtcagcccctctgagcccccatgggaactcctgccgatcttcccaggtaaggtagtctttgtcgttccctcagatttccagaaaccctcatcttcccactgtttcccagaaactacgtagcttcctatatcctcacgcttctacataagtgcctatcctctctccttcaatcccctatttttgtttcttctcccttgctgcggtacaggaatccccaccgacatgtccttgggtactttttggactcttcttaagctctgcttcctgataatttctaactccctttcctccagatcttcaggtgaagtctgagccatcttccccctgctcttcctcctccctcagctccgagtcatcgcgtctctccacagagccatccagcgaggtgagagagccatatccctcttactctctgtgacggggactctgcttcattcccttcacccgtgggtgacaaagaaatgatttaaatgatttgtgtgctatgagtcatgaggtgtgtgaggtgtggggggccttctccactacctttgccgtttccttaatatcttcattttccacatcccctttggttatctagcagtgaagatttttttgtttgtttgttttttgttttttgcttttttttgagatagggcctccctctgtcacccaaactacagtgtagtgacagggtcacagctcactgtagccttgacctcctgagctcaggtgatcctcctgcctcagcctcctgagtagttgggaccacagacacatgccaccatgtctggctaattttttttattgtttgtaaaaatggggtcttcctatgttgcccagagtggacttaaactcctgggctcaagtgatcctcccaccttggcatcccaaagtgcttggattacaggtataagccaccacgcctgatcttgggtctttttaatataaagagttatgtggggctgggaagaagagagttattgactgctgagaattctggaactgttct

SEQ ID NO: 120280 - DNA, 1038 bp, Homo sapiens
tgaggggcacgcccgggctggcatcagccctccaggccaccctgccactcacccagcacacggcaaaatgcagaggactacctttccctggtccgccccctggccgccccttggggaatgcaaacttcgtgttctgctgcggagccagacgcctgtattgggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggtgcgtcaacgtggtgggggggtgtgtttgtagggagagggctggagtaagttaaaagtaggctattttgtgacacggacctggtgtgggagcgagaggaggtggcttgattgccgggcgtctgttccgagggaggagggtgttgccatctccctcacatgcccttatcacccctttctcaggcgggagcatgctggggctctgcgggcagcggctccccgcggcgtgggtcctgcttctgttgcctttcctgccgctgctgctgcttgcagcccccgcgccccaccgcgcgtcctacaagccggtcatcgtggtgca

SEQ ID NO: 120281 - DNA, 1913 bp, Homo sapiens
agatgggtagcacttggtcccaccaagagaggctgttactaatcttaacaggaaagataaggcctgtgtgcacaaagctgtaatgaataacactcattcagcagtaaatgccaaacccagaggaggggggctggaggggtgctgaggagatgtctgaactggggattggagaaggctttgtataggagaagggcctcagaagtggcagctggcaagcccagggatggttgtccagggttgggggaagagaactgaaaggttgaggaagagtatcactcggaagctgggccccacctgtgggcaaagacctgggtggacaggccatgatggtgctccccttgccccaggacaatgtcaggtgcgggtgctgcccccagtgcccacggaagggctgacaccagatgacgtcccagctctggctgacagagtccggcactccatgctcactgttttccgggaaatctccactgatggccggggtggtggtgactatctgaagaagcctgggggcggtgggtgaaccctggctctgagctctcctcccatctgtccccatcttcctccccacacctacccacccagtgggccctgaagcagggccaaaccctcttccttgtctcccctctccccacttattctcctctttggaatcttcaacttctgaagtgaatgtggatacagcgccactcctgccccctcttggccccatccatggactcttgcctcggtgcagtctccactcttgacccccacctcctactgtcttgtctgtgggacagttgcctccccctcatctccagtgactcagcctacacaagggaggggaacattccatccccagtggagtctcttcctatgtggtcttctctacccctctaccccacattggccagtggactcatccattctttggaacaaatcccccccactccaaagtccatggattcaatggactcatccatttgtgaggaggacttctcgccctctggctggaagctgatacctgaagcactcccaggctcatcatgggagctttcctcagcaccttcaccttccctcccagtgtagcctcctgtcagtgggggctggacccttctaattcagaggtctcatgcctgcccttgcccagatgcccagggtcgtgcactctctgggataccagttcagtctccacatttctggttttctgtccccatagtacagttcttcagtggacatgaccccacccagccccctgcagccctgctgcaccatctcaccagacacaaggggaagaagcagacatcaggtgctgcactcacttctgccccctggggagttggggaaaggaacgaaccctggctggaggggataggagggcttttaatttatttctttttctgttgaggcttccccctctctgagccagttttcatttcttcctggtggcattagccactccctgcctctcactccagacctgttcccacaactggggaggtaggctgggagcaaaaggagagggtgggacccagttttgcgtggttggtttttattaattatctggataacagcaaaaaaactgaaaataaagagagagagagatctgggtgttggtggttgcatttgttaaggaattgaagaagcagttcttgcccaggcaacctgcccccagccagaagactcaggggcaggccaagaacacaggcctccccctttcttcagctctctgaagtttccattgttcattgctctttggtggctgatagccttatctgcagctcacagtcggccaatcccagaggattagtgggtccggtttctgtataaattagggggcaggggtgctgtagaggcttcttatcgatgattgacgccgaggcccaggctgttgtcctcacaggagcctggttaatgacatggcagacacagtg

SEQ ID NO: 120282 - DNA, 1032 bp, Homo sapiens
catttacattcttttatctgtcactgggtgtaattataaatttgtgtctatgtgtgaacatgttagtctttgtatgactgtgtgtctgttggcattagtgacacgaacttttaatcttgccatttggcccttgggtatatggctgtgagtgttctgtcacaatcaccatatatgctgtgtgctgtgttcgtatatatatatgcaatacataccagtgtcagcgtaatggagtggttaggaacacaggcggcttagatttaacctagaaactgctgtttaggagctgtatgacctcaggtaagttatttagcctccctgggcctatttcctataaaatgtaaatagtaatagtactttctagactatcatatgcatcattttaagagtttaacttaatgtatagaccagtactgttctacagaaatataatgcaagccacaatgtaatttttttatggtagccacatttttacaaggcaaaaagagtgaaattaattttagtaatatattttcttgaatctgataacatccaaaagattataatttctttttttttttttggaaatggagtctcactccattgcccaggctagagtgcagtggcgtgatcttggctcactgcaacctccgcctcccggattcaagcgattctcctgcctcagcctcccgagtagctgggattaaaggcatgcgccaacaggcccggctaatttttgtatttttagtagagacggggtttcaccatgttggtcaggctggtcctgaactcctgacctcgtgatctgcccacctcggcttcccaaagtgctgggattacaggcgtgagccactgcgcccggcccaagattataatttcaaaatgtagtcagcataaaagattagtaatggatatctcacattttgttttttattcagtctttgaaatctgatgtgtattttacatttccagcacatctcagttcagactagctgcatttcaagtagccacatgtaggtggtggctactttctcggacagcacaagtatagaccat

SEQ ID NO: 120283 - DNA, 1038 bp, Homo sapiens
ttccgtcaagttttagccaatgagttgatttggagccatacgctccaaagtccaatagcaatccggacattctctaaaagaggaagcgaaggaaagaaaggggcttatagtgggcgaggtctataggtagtcccgagcaaattgcttatggctttggttatgactgacaactactcagacgaataaagccctccttggccaggcgacagcgtgtagcgagttattaccaatcccttggcattgcacattgacttagaccgtatcagccaatagccattgtgcgaaggcaggactgcactaaccttttcccgcccctaccctttgggccaatcctttcttttgaattctttgtgactggcaggcattcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactggtgagaatcgaggaggggggcgggaggtggtgggtctcgcttatatactggagaggctaggagcgaataatcatacagtcatacagataatcggagggcacgttcccataggtgaagcccgacaggagacataagactttgctggtatgtgtgggtgggagtataacggtcgagatctgtggaaagaaaggtcttaggaaccaggagctgaggcacgtgatgtgctgagaagagaaggtggggcggggagtggcaggacaatgtgagacccgagccaccttaccccagagaagtgaggggtcttagctgtgcaggtggaaacaagtgagacacaaaggttaagggaggcacgcatcagttgagtcggggagaaccaggaaatatggatcacattcagat

SEQ ID NO: 120284 - DNA, 1293 bp, Homo sapiens
ctacaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccaggtgggcccagggaccccaggctggcccccagcactgggctccttcccattcctctccaagaccctgagctgccatgctgcacaacatggtactccatgacaatggtgactctggggtcatgccatgtgacagccctgccaggacatcaacatcctcctcactgctcttctccctcctctgtagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtattatggaggttgcgggaggagttgtcaggcaaagtgcacgcatctcagctaggtgcagtggtgtgttcctgtaatcccagctactagggaggctgaagtgggaggatcacttgaattggagaccagcctgggcaacagcatagtgagaccaggaagcaaaaaaaaaaaaaatgctgtcactcacatcttattcagtgaaggacttcagaggcaaatgtttctacctgaccctcctttctgccccacaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggtggatcccactgtcaccccggctgactgttttgcacacttcctgcttttgttcccacttcctatctaggcaggatcatagcagagagggggccttttggggtgagagggaccgagctgagataggctggagatgtcaggggacagaggccattccagtgatcttagttctgcctttcttcccacgggtggccaaggaacagcctgctctttctgtgtgttggaatgttattttgtggataattggagtatagtagcatgtccccacaagagttgagagttgtggttcatcctctaccatcacgggctctattacactcttccctctctgcccccacaaggctctggcggctctttcaatctctcaggatct

SEQ ID NO: 120285 - DNA, 1039 bp, Homo sapiens
gcaccattgcactccagcctggacaacaagagcgaaactctgtctcaaaaataataataataataatataatagcattctattaactgtttagtcttctaggacttgcactgtaatgccacagtccatcaggttgttgcacacagctgtgcttcatccattttcaacagaatgtaatatgtcattgtgtgaaattaccacaggacatggtttcaacatccacaaaatgattaacttgatgctctctgaggcgccttttagatatgagaatctaggaccctctgcaccgtcttaacccaagagtttgcttgatggagagcgggaagaataatgcaagttgcatctccaatatctcccctcccctccacagggttttgaaggccccacctgcagccacagggccccttcctgcggcttccatcactgccaccacggaggcctgtgtctgccctcccctaagccaggcttcccaccacgctgtgcctgcctcagtggctatgggggtcctgactgcctgaccccaccagctcctaaaggctgtggccctccctccccatgcctatacaatggcagctgctcagagaccacgggcttggggggcccaggctttcgatgctcctgccctcacagctctccagggccccggtgtcagaaacccggagccaaggggtgtgagggcagaagtggagatggggcctgcgatgctggctgcagtggcccgggaggaaactgggatggaggggactgctctctgggagtcccagacccctggaagggctgcccctcccactctcggtgctggcttctcttccgggacgggcagtgccacccacagtgtgactctgaagagtgtctgtttgatggctacgactgtgagacccctccagcctgcacgtgagcctgaaatccactggagccagggaaggagaggggtgggtgagaggaggaggaaggacgtagatggctctgagttacagtgtggccacagccttgggctccagggagtttccaccctaataaccatcactaaacaggggtcg

SEQ ID NO: 120286 - DNA, 1014 bp, Homo sapiens
cctagaagggagaaaacccctcagccttcccacccctcctctcatctccccctgggttccaggctgcctcccaccccacacctcgttccgccttccctcctggcttgccacctccctgtggttgcctcccgacaatatcacacactaccttccccttgttgcccgaacttcttcctatcatgccctgtctctgtcttgttcagcccctgtaggaatagggcaacctgccaggacagccctcagggtccccgctgcctctgccccactggctacaccggaggcagctgccaggtgagggccattgaagtcaggcgtgctgaggagggaagtggctgggagggaaaccagggagggtcacctggtcccaggccattcaggagaaggtttttgaagtaagggatttcgaggagctggagtgggcagaggaccatctctgggctgagaatctgatgctatgtcctgcctcacgctccctcccacccctcagactctgatggacttatgtgcccagaagccctgcccacgcaattcccactgcctccagactgggccctccttccactgcttgtgcctccagggatggaccgggcctctctgcaaccttccactgtcctcctgccagaaggctgcactgagccaaggtaaccaacgccggcactgactggagagcaaatgaagaaaatatgggtgttctcacctgccccgttcctgtgggcttccacacagcttttggccaaaacaaccatctgagaatcaaaaccacacagacaaatcagttcttgattgcagaggtgttgaattgtgcaatcagagaagcctaacacaattcctgttacctcatttaacgcaattcaagcaacaccaaccagcccattccacaggattccagtttaacccaaccatgagggacatgactcaacgtggagcaactcaactctgtcctgatcatcataacccaggcagagtggaccacacttaatccagctacactcaacgcatttcaccccaccccac

SEQ ID NO: 120287 - DNA, 1815 bp, Homo sapiens
ctttgggatctctgttctccctagcatggaggcccacccagggagaacaagaagcgggactcattctccaagccaatttgttcctatttgtaccttgaggtcctccaggctgatcagcctgccctggtgagccccgccctctgtatacacaggaatggccaccagaaagccttgtagtcctcccgcaggtccccagcaagcaccctgttccctggcctttcacacctcaaggagcagggccacacactgcgaagcagcagggcctcagggttcatcttattcaaccccatgcagacagcacctcgggggaggaccgcctgagtggggcaagtcaggagcagggccgattctagaacacaggtctcccaggcagacctggctgagccacagccctcatggtccccatgtccccaggcttagaagggcagctctgtgaggtggagaccaacgagtgtgcctcagctccctgcctgaaccacgcggattgccatgacctgctcaacggcttccagtgcatctgcctgcctggtgagtacagatgcctctctggccaccctcagaccccaggcctctgaacctgcagagttcaggctcagcaatcacccaaggccacttgaagctctctctagccaagccaaggagtcctccaaatctgtctttgctccccaaaatctctactcttacatccccaaatcttcccttgcttacttgcccattctcatctctgtcctaccaaatcacccaaagatccctcctttccagtcctcctgcacagcctctgtgtatgcatgttgaggtcccaggctggtcttggcactctcatcataaacccagcaaaagctgccccaagcctttcttctccagcctcaccggacactcctctgtcccctgctattataataactacacttattcaccacttactccaggctagccatttggctgagtacttttcaggcgttatgtcatttaatctttttaacagtaccatgaggtaggttccattattattccccttttacacagaacaggaaactggggcctagagggttgaccagcttgcccaaagtcacacagctggcaggtggctgagcttcaccttttctgcatcatctcctgtcaccccacgctcacctgccccaggtgtcttctctgggaagctctgcaagttcacctttcctggcaagggaaggcgccatgctgtgcctccctcgatgaccttggcctcctctccccacccacttccgccccaccaggattctccggcacccgatgtgaggaggatatcgatgagtgcagaagctctccctgtgccaatggtgggcagtgccaggaccagcctggagccttccactgcaagtgtctcccaggtaaactggggcacacactgtgggggacagcgggagcaggaggcagacatccgtgcaggtccctgaccttcctgctgtgccacaggctttgaagggccacgctgtcaaacagaggtggatgagtgcctgagtgacccatgtcccgttggagccagctgccttgatcttccaggagccttcttttgcctctgcccctctggtttcacaggttcacaggggaggcactggaaagaactggcagaatattttattccatttgggttggggcagagttcattggtgggtgtttgatggttgggatgtgagaatagaatgagaatggtatcctttaaagttatttagtgtaaaacctgcacaattgtacaaccatggggacaagggcaggggttaccgtagggcccacatgggcccagtgtaaatggtgtgattgcggcttgggagcaga

SEQ ID NO: 120288 - DNA, 1050 bp, Homo sapiens
attcgtacaatgctagaaacggctccctctgtcctctgcctcaggtgagcagtgccagcttcgggacttctgttcagccaacccatgtgttaatggaggggtgtgtctggccacatacccccagatccagtgccactgcccaccgggcttcgagggccatgcctgtgaacgtgatgtcaacgagtgcttccaggacccaggaccctgccccaaaggcacctcctgccataacaccctgggctccttccagtgcctctgccctgtggggcaggagggtccacgttgtgagctgcgggcaggaccctgccctcctaggggctgttcgaatgggggcacctgccagctgatgccagagaaagactccacctttcacctctgcctctgtcccccaggtgtgtcctcacaggggctctccggccgcccctctctctgggcagggcaggatgtctccgttggagcctcctcccacagctgatccatgaccctgtcaggtttcataggcccagactgtgaggtgaatccagacaactgtgtcagccaccagtgtcagaatgggggcacttgccaggatgggctggacacctacacctgcctctgcccagaaacctggacaggtgagttgtttaagccacatccatgacacccatggcccagagagttggcccctggcctcccctactcatagggctcccagccttagccctcgtcccctccccaaccccctgcaggctgggactgctccgaagatgtggatgagtgtgagacccagggtccccctcactgcagaaacgggggcacctgccagaactctgctggtagctttcactgcgtgtgtgtgagtggctggggcggcacaagctgtgaggagaacctggatgactgtattgctgccacctgtgccccgggatccacctgcattgaccgggtgggctctttctcctgcctctgcccacctggacgcacaggtatgggggtagagggtatcaggaggtgggaggtagagaaggagggtgagagaagcaccaggaggactgctaggagcttcaagtg

SEQ ID NO: 120289 - DNA, 1086 bp, Homo sapiens
gatgatgcccactttgtgccacatgatggtggctactgcctgtaagcattttccagtgactgaaagaggctgctagtggtcgggaagagatatcatccaatttcctaaaaagactgaacccttcatattccccagaagaataacagctgttccccacctcccacacatctgcatcaagctgaagttctgtgtcctcatgagctgatttcacctttgcacagatcttgggggaggtgatgacaatacaccctggacctcaactttctctgtctgaagctgcagggggcccctgaagggtgggggagatggcaggcccaccaggataccctgtgctgatcaatgctcttctctcttctccagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaat

SEQ ID NO: 120290 - DNA, 1014 bp, Homo sapiens
acattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtatggaagcaggtggcttgaaggagggcagggagcatcaaatacgaagagcattcttactgagcactctgaaagaggggttagggaatgataagagaccttgggtggagatggtggtgtagtcaggagggaggtagtatgattttgtgacatgttctcaataaagattttgagtcttcgatctctagataaccatactcccatgtgccttgttctatgactcttcatcatatttcatctcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacaggtactctctccactcatctcaccacccagccatctttacctttgctgaaaccccagtagtcttgcctttatccttcagttcctccttactcatggacatcaatttgaagttgtaagatcatgctcctatggcttcttcatcctgacatcctcaggattctgttcatcttcccagaatctcccctatccagctacaaccgtcagatcttggtgtgtgtgagtgcgtgaatgcatgagtgtgtctgtgtgcatgtacatgcgtgcacacatgtggctataccgttctcatcttggccctttgctctgcagaggtagacgaggctgggagccagctgtcagggggtcagcgacaggcagtggcgttggcccgagcattgatccggaaaccgtgtgtacttatcctggatgatgccaccagtgccctggatgcaaacagccagt

SEQ ID NO: 120291 - DNA, 1205 bp, Homo sapiens
actcatcttccctgcactgagatttgcagacctctggagaaccctaaccttgtttcctgcagcctccttagaaccccatgttgacacccctgaccctggcatcctggctcattgttagttcgtctcatcacttggaacctgtctgattcacctcactctcttctccccaaccctgcaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccaggtatgttcatggagttggcccgctctacacagaccctcatctcccagacttggcagactcagttcctctcacattgctttcagtccagctttcctggcacccttactgattctccatcttcatggaacaccctgtccctgtggtccatgttcccaggttgctcaacattaacctccatactctctgggtcttcttttctagcttctccccacaatctgtctttaagaatttgatccccaacccgttctgagtcattttcctcttcctcgtatttctttagcatccaaggggcatagctgtgtctctttctcttttctccttttcctctgtctcttctcacctttaatttccaaataggtaactcaggtattagtgtccctgatggtttgccaacccgtgtgacatctcttgtccatgtatccacagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtgtgagcacctgaagatgaatacccattcccttgtccttaagatgccgtgactccattcccattcctatgaccctgctcccactcctcctttactgggaaatggttggttcagtattttcgtcctagcaacctgaggctcaatgactctactcagtgtccctagccccctccctctctttaaagatgctaggtggctt

SEQ ID NO: 120292 - DNA, 2457 bp, Homo sapiens
ttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaagctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcagggcggcggcacaggggtgtggggcgccgtgttgggagtactgagcggccccggcgcgctgctgttgcggcgcagctgtcgactcggtcgcgcggagggaattgagcgacggttttggaacggtggtggcggctcggctactgctcgtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttagccttttaggggggattcacggacacctctagcgccctgtagggttgccatggtgacggagcgcttaagggactggcaacggggattcccagagaagggtaaagggatcactctcccgtgtgtgcaggttcctaatgcccagggtatgtcattaaatcttttgctttctttgggtgggtgggttgtgtgtggtgtttgttggtgcagggattgttttttcctaacattaaaagtttgattcagggcaggagggtagagctaaggttcctagttcagctctgcgatgtaaacaatgagattcccatatgatgttttaattcttaggtggtaggaaagactgatcggaggagcaccagagggactgtaaatgaaccactgttagcgtttggtgtccggagttggtgctacagggggaactggtagtggaatcgtgttgtgtagtgggtgggtggaagggggctatcacttggtgaccttgactgttttgtacggctttttgacttccttggagtgaggagactctgatttggtgcgaataattttgagggcctggaagttacgggctgtgaagtctgacaaattcttccttgtctgaatttgtttttaagttgatatggttcttcctctgggtttctagtctatgttctgttgtggcgtgaactacccagaccttgtggaagatggtgctctctcttctatctaggtggattattctgtgtcttatcagcattttatggaattttttatagccataatttgttcttttcctccttaccggcgctcaaccaccatggcaaccaccaaacccctagtgaggaggaagcttggggtttgagtttcttaactccacccattttgcttaagccccatccccatagggctgtagttctgagatgtcgtgccttgtcagaaacaatttgggagttttttaaaatatgaaaaagaacagataga

SEQ ID NO: 120293 - DNA, 4156 bp, Homo sapiens
tattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctagggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggggtgtgtgtgtgtgtgtgtgtgtgtgagagtcggggatcggtagtctccctataagcatttatttttctgtggttctgacctaacatttttttatttaggattatcacaaaattataaaacagcctatggacatgggtactattaagaggagacttgaaaacaattattattgggctgcttcagagtgtatgcaagattttaataccatgttcaccaactgttacatttacaacaaggtgagtttttctgtgtgttcatttagtaggtggggagaaacagtaacttctattattgctggatatgttgtctacataaagtttaaatcctttgctactgaaggtgttatccaggtagggtagtcggagtcttaaaaacctgactctagatggtactattgaacacagtgatgtgacttcagagctctagttgaaggttatttagaacacttcatacttgggggtggtggtcctgtttcttagaaatcaccagagacctgagtagaccagggatctgttttcttgtcagctctcaagttttttcttctttcgaattttgggagacagttaggagaaagtggaaattagtagtggcctggagtaggaaattttctttaagatttgatgacaagatgactggtgggggtatggtaatggcctagggcctgaatgcctctgagaaagatggtgtgtatctatcttctgttggcattttttaactttctttattgctgtctgtgttctcatagcccactgatgatattgtcctaatggcacaaacgctggaaaagatattcctacagaaggttgcatcaatgccacaagaagaacaagagctggtagtgaccatccctaagaacagccacaagaagggggccaagttggcaggtaggaagagtgggagttttgcaaatggacaactaaagatggggaagagaatcaaactacacttttttccttttttctagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaaggtatgatctgtggatttcctctgggcagcagggaggcaagggtcttaagtaaagtgggcttggagtgacaggttccctatcttgtttctttctgcagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaaaacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttgtaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacaggtattttgtcactcttgaaagtttttattgggtaagaggttcatgccctttgtcctcattttttcttcttgttattttatctttatttactttttccacttcatgttttttttcctttagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagtgagttagagtaggaagcagagactagtttggcta

SEQ ID NO: 120294 - DNA, 1839 bp, Homo sapiens
ggccattgaatggaaaaacagaagctccactctgggcaggaaataggatcactgaattataacagtgggaacatactggaagaggttaatgaagcttcttttgctgacaactctttttgcccttaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacagtacgtatgaaatgaggttcatctcatggttctgaggacagttgaggaaagatggtggggtctgtttgcattcaggattgtcagctcccaggataatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccccgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccacagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgagtccttagaagtaatctttaggtctacaatttgct

SEQ ID NO: 120295 - DNA, 1006 bp, Homo sapiens
aggttgacatgtgggaagcagctagatcacagtgaccctgaaggacctgatacctctgtaggcgcaggggaggtgggatcccagcactagaattggggaaaatccactcacgggaaggagagacaacaaaagtcaggcagctgtggggcaagcaatgaggggctagaggctggggtgtgtggggtgtgttgctgggtgggggctggctgttatatgtgagggttgaggtctccaggggtggagtggcatctgggcctcctctcactcctaactgcttcctgtccctccacagggcaagctgggtgttcctggtctgcctggctatcctggacgtcagggacccaaggtgatgccatgccccatacgtgcccctcctcctcttccctcctcctcttcgcttccctgatccctgattccagaaagcacagatgcagggcagtgggggaccccagagggaatttagctgacccccattttacagatgaccgaaagaggcccagagagcagcaggggtttgtccaaggccacttagttcttggcagagctcgggtctccctggccactgcctttgtggcctctcctgaccccctttgccccttcctgaaccctacctttcataacttctcaatttccccccttctccgttctcaccaggggtccctaggatttcctggctttcctggtgccagtggagagaagggagcccgggtaagctggggggtgggagggcgtgagaagggaagggctggagaggtgtagagggggtctgtggggagtctcaccctgggtaatgttctctctgcttcattcccaccagggcctgtcggggaagtcagggcctcggggagaacggggccccacggtgagtgcaggggagagaaacaggtggctcaaggtccagaggggggcatttgggtttctctgacaactcctcttccctctgtagggtccacggggtcagcggggaccccgaggtgccactgggaagtctggagctaaggtgaat

SEQ ID NO: 120296 - DNA, 1097 bp, Homo sapiens
tgggtaggttgtccatatgatcgaattgtactcccttgggatttggtggagggtggggacctccgaggtctccttggcctggggtctctgtgagtctctgtgtctctgtctcactcacccttcgtctctcaaagcggcccttgtgtgttggtgtttgcggagctgccacacgcgcaggggccaggcttaggtgggggttgggggggaaggccgtggtttcccggctcctggactcaaagggccttttctctgcctgcccgccccacctcacccaccccacccagctccactctcctgattgctctggcctctgccctgccccacacttctatgaaagttttgctggaactctctttgggatttttccaatctggagctgatggtgtgaagagtatgtgtataggggagcaagtgagggcaaggtgatcttttgttttccagggagtttgagccctaggaagctgagttctagttagacagggctggtgggctggatcttgaatctttgggtcccaggtggtggggttggtgggggtggtgagacaggattgaggttccaggtgtggggagcttgcctgggttctgggcaagcactctgatgggatccacagatgtgtggctcagggccctggacctgttccggctcctcgtggcagcttcagcccctgccccccattcctccacccctccccaactcatctcctaaaccaggaggcacagactcctgggagagctttcttgtatctttttcctcagcatgctcagggttgttcccaccccatcccccaaacctgggatctgtagctgcttgaagcccctctcatagagctgcttctctgatctcttcctcgtggcccccctgcacctcctgtgtccaggatgatcgattgcccagatgttgtttgtgctggagacgggacagatgccagagacccagagagtgagagatatggaaagagagtgagagcgagggagagaaaaagatggacagaatgtgagagaaatggaggaagacagaagagacagagacagaaagaccaacataaagagacagagagagtaagagagtgagagagacaggagacagatgaagagtt

SEQ ID NO: 120297 - DNA, 1048 bp, Homo sapiens
ctggagacctactgcaaacagaagtaccctgagcagcagggacggtgagatggggctggggggcactgaggctcccttgggggtggggagtgctatgaggatgtgttcagggcccgtgtgcttccagctctcaatccccttctcccacctccaccccaggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaat

SEQ ID NO: 120298 - DNA, 1687 bp, Homo sapiens
tcagttgtatgacctgccatgtattatatgaatttaagcaaactaatctctttgaaccccgagttcttcatcttaaaaatgagaataaatgcttccagcatcattatgataattgagtgaatggtaaaatgtgcttagcatgtttcttggcatattttatttaaaaaaattttttttttcaatcagctttctcaggttgaatcttggcatgttttttttaaccatgtagtaggctctccatttaaattcctccctaattcttttacctacctcacccttcccgactgacttacctgcccttttataacccttccttcagggctgcccccagtccaccctttctagtgacttccccaattcctataaatatctcccaagggccatgagatcctgatgaggccgtaaggatatttgtggaaccccttcatggctggctgctgactttccattttttctctcccccttccccctgcagcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcgtgagtgttggggtcaatccactctccttcgtgatgggggttgggggaggcagtctaggtctgttctacatcccctccccctcctttcccctcataaccttcctaacactacttgggactggaggtgctgccaaacaaggtctttcaaacatctgaggtggatgtgatagctccttctgtctccactccccaaacaacccactggcagaaccataggcatgtcccaaataaataattgtttgcactaatgccagaagagaagactcacttacagggattggtttggatggggctcacaggaagactatatgtaaggagggggtgtcaaaagcctcttacaagggggctcccagcatatctcaaaatcttccataactcttacccccgtcccctgcagccaaatgaccctgtgactaacatctgtcaggcagctgacaaacagctattcacgcttgttgagtgggcgaagaggatcccacacttttcctccttgcctctggatgatcaggtcatattgctgcgggcaggtcagtgaccttggatccctttgacttcttgacatttgacccctctttgacttcccgatctttagtgaccccagtggccttaccttgcgtacccagggagccaaacttgctgacctcgccacctcttttctccttctcttccactgatgtgctttgaatcccttggcctgatttctggctcctgacccttgctgccccacccaggctggaatgaactcctcattgcctccttctcacaccgatccattgatgttcgagatggcatcctccttgccacaggtcttcacgtgcaccgcaactcagcccattcagcaggagtaggagccatctttgatcggtcagtggccctcggctaggctggcatgtagatagagggggtggggctataggctggtccgtgtccaaggctggctgagctgtgacctttgagtgacctgcaggtccctctccagggtgctgacagagctagtgtccaaaatgcgtgacatgaggatggacaagacagagcttgg

SEQ ID NO: 120299 - DNA, 1038 bp, Homo sapiens
cctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcggggtgagtgccccagcagaagggcaggcgagccagtgaccgctttatctgcgacccctcccccacaccctcccccggtgctcttttccttgcgctcccgcccccttgtttgtaaacacgcgtcccctccctcccgagggccttagcaccctcccccccggggcggggcggggaaggggagcttccgccctcctagctgtgaccgcttgaggccttgggcaccggaggtcgcgggcctgggaagggcacgattcctcttaaacctcaggactttgggcgtttacaggcagatcctgcgtcttaggaggggtctctcctgcctgtctctttcccttgcacgctctggctacctggctttacgctgggaatagaggggctcgatggtctaccccacgtgctgccccacccacgagacaggtgtggctttgggatgacctggtattcattcaaatggattggttggaaaattttcctcacctgaactatcctcctctccttgtcaactccctcctctcaccacaatgaggagttacgctgtttttgggtttttttagccagtcaaatatagcagtgggaggttgtataccaattttagtgacacaaatgttaataagttctgataacccactaccatcggaccagccggagttacactgttgtttgacagcagggtgtctctgaacttggggatgggtggagtgggctgggtccggcacggtggggtattagagaattaaagtctctagttggatgtttgaagactcat

SEQ ID NO: 120300 - DNA, 2232 bp, Homo sapiens
agcccgtcgctctgctcagtaccaaaatgacagcgccaatgtggcagccatctttgtacagacgggaagtctcggcgcgagttcccgccccctcgtctagttggaaaccgaggaggcggtctcctccggcctgttagcccgcctcgcccaccctcccctcaaatcacctccacactcgcgcatgcgtgtcagtgcaggatggattcgtcgctaccggagtgccgccatattggtaaaggcattagggcgaaggtggaacggaacttcctgttctcgcgggatctaaaggcgggactgccacgtccaagcaaaccgggaaaggagaggatcccggagccggtgagaattctctgttttttctctaccatcctttccaggccttttcctcacctaatgagtcgtagagacgagggcccagagagtctgtaaagtggctggtgaaagattagtgtcccagggccctacatccgggaggtggttcgggataaagagaactagtcttgggaacaatgtaggtgggaacttaagggaatgggagagcggcccatagaggtggacggagggcgcgattggagtaaagcggaccctgtgtaggtatagagttgagtcaagtggagtcactgcctctgtccctctggtcagcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccacagccatgcccatggccatggccacactcacgagagcatctggcatggacatacccacgatcacgaccatggacattcacatgaggatttacaccatggccatagccatggctactcccatgagagcctctaccacagaggacatggacatgaccatgagcatagccatggaggctatggggagtctggggctccaggcatcaagcaggacctggatgctgtcactctctgggcttatgtgagtctccaggggatgggagagagaagggctggttctggattgttgggaaactccacagtacttgaccttgactctccctcaccaggcactgggggccacagtgctgatctcagcagctccattttttgtcctcttccttatccccgtggagtcgaactctccccggcatcgctctctacttcagatcttgctcagttttgcttccggtgggctcctgggagatgctttcctgcacctcattcctcatgctcttggtaagtaacctctgacttctacctcaaatctaacctatttcgttctttggaggaaaagggttctttctcctttatgatccctgacctttcgatattcccccaaatacacactcattgtgtcagatattccctcatctggttttccccccttcttccagaacctcattctcaccacactctggagcaacccggacatggacactcccacagtggtgaggaagagacagatggggatgggagttggggtgctggggaaggtccgtctctccctattcctcacctcccgcacttgaggaggaggagtctggaatgcacatctcccttaatgtctcaatgcctccattcccaggccagggccccattctgtctgtgggactgtgggttctcagtggaattgttgcctttcttgtcgtggagaaatttgtgagacatgtgaaaggaggacatggtcacagtcatggacatggacacgctcacagtcatacacgtggaagtcatggacatggaagacaaggtgagcccaggaacaactttcctgaaagctgacttgcctgcctcagaatctcctcatcttatggccctcaggagggagaggacatgttggaagatctgttctccactctgaccaactcttttcttccctcagagcgttctaccaaggagaagcagagctcagaggaagaagaaaaggaaacaagaggggttcagaagaggcgaggagggagcacagtacccaaagatgggccagtgagacctcagaacgctgaagaagaaaaaagaggcttaggtaagggccagagttggtgataaatttgggcaagggacatcatcacaaatcacatggaatatgtgctgtgggtaatggcaggtatctgagaaacactaaaggactgggtgtaaagtggtctctgaggggag

SEQ ID NO: 120301 - DNA, 1906 bp, Homo sapiens
tactttgtcctttagctcagtatttcttaaactggtctataaaccatctgaatggtttagtggagtcttacacacacacgcctactcaatcagaaagtctgtggaaaggacctctgatctcttaagatttttcagaaattgtctattctagactgctccctcttctctttttattttgatgtttagtttccaaatccatgtcccctatacctataccccaccagccacttctaaaccactgataatctttagctattggtgagtgcctttttctcttttctgcccatcaggcgatgcgtctgcaactactgacagcagtaggggcactggcaggcacagcctgtgcccttctcactgaaggaggagcagtgggcagtgaaattgcaggtggtgcaggtcctggctgggtcctgccatttactgcaggtggctttatctacgtagcaacagtgtctgtgttgcccgagctgctgagggaggcatcaccattgcaatcacttctggaggtgctggggctgctggggggagttatcatgatggtgctgattgcccaccttgagtgaggggtggataaactacccctgccccaaacctctacccctaactccaggtcaggggtgcgtagaggttgggggccctggccagggacatctgccaaaggaaggaactgtagcctgggagaatggttactttggcattagggccttcaagggctggcagtcttacagaggctggagcggtgagaatgagaggccagagggaccatagtgttgggcactgtctgaccatgttgcatttggaaggctaaatggggccatgaagaaggctggaagggacagggggtgatggcagcctacctggtgtcccctaccccacctgttctcggagaaccaagttgctacacaggaagttctccaaggtccagtttcctttctcccaccagttggtggaggcttcagggaagaccagagtcctggacagagagggtaacaggaggagtcggggataaacatcaaacatcaatcgtgtgtcctgatttgggagtgattggggggatggggtgggagagggttagttggtattctcatggcctgattttttttgtttctattccttttatatcactgtgtttgaatcgagggggaggggtggtaaccggaaataaagacctccgatcttccgccccacatgcagtctttgtctttttggggggaatggggccccttgtcttctccacacccggggcccctaagcagcagtgtcgggccacgccccctcggtgggaggtcggcctgcgctggtggccgcagatggcctaaggctggcgggcctttgattggccccggctttgcccttgccacgcccctctgcgctgggattggcttagtgctgggattcccacccacccacagcccgccatggcgtctcagctccagaaccgactccgctccgcactggccttggtcacaggttgagggggttctttccccgggcggtttggggtattggagtgaggtcaggggcgtgcccttggagtgcgcggccgctgtgacctctggccccttacccacattttactttctgccctgtgacctctgatccctgccctctcctccccgtgcccggtccggcgtgttctgtcctacctcaggtgcggggagcggcatcggccgagcggtcagtgtacgcctggccggagagggggccaccgtagctgcctgcgacctggaccgggcagcggcacaggagacggtgcggctgctgggcgggccagggagcaaggaggggccgccccgagggaaccatgctgccttccaggctgacgtgtctgaggccagggccgccaggtgcctgctggaacaagtgcaggtgaacgctaggccactttccccctctaaagctctga

SEQ ID NO: 120302 - DNA, 1061 bp, Homo sapiens
gtcaggagttcgagaccagcttgaccaacatgatgaaaccccatctctactaaaatacaaaaattagtcgggcgtggtggcaggcgcctataattccagctactcaggaggctgaggcaggagaattgcttgaacctgggaggcaggcggaggttgcagtgagccgagattgtgccactgcattccagcttgggtggcaagagtgaaactctatctcaaaaaacaaaaaaaaagccaaaaacatagatcctggacaggaaagcagggggcagttccattttacgtctctcccttctgtcctgtccagtgcatcatccccaaagaaacaaatgcgtttgttcatagtcactgaggacaacaaactgacattctcttttaatcctctgtttgttccccaatcacacagaaacacctggattcttatctagctgactgctacgatgccattgctgtttttctctgtatccacattgttctccggttccgtaacattgcagcaaagagggatgttcctgccctggacaggtcactgaattctggtccttgatgcccaacaggccacgaactctcttggtcttgcatgactctgccctgaccttagactcctactgacctggtatcatcaacctttattcccattcatttgctccggaggcagtagtgctgctttttgactcacctttctccaaccactgccccccaacccccacaactagctattgaccattaaactgaatgatgccccactccctcccatccccctccaacattccttgctggctgacctctgattctgattaagcccacaggtactgggaacaggtgcttgccttgctatggccacggtttgaactgatcctggagatgaatgttcagagcgtccgaagcactgacccccagcgcctaggggggttggatactcggccccactatgtgagggagggcaagggtaacaaagggttcttgaaaggcagggctctaagcatcattgtgggggttggccaaggtcacagttgtgtcatgggccacgctatgagcaggtgttctgggagggtggtgaa

SEQ ID NO: 120303 - DNA, 1470 bp, Homo sapiens
ctggaagctatataatgatatcgcgtcacttccgctctctcttccacaggaggcctacacgccgccgcttgtgctgcagccatggtaagactggaatccgtgccgtgatccagcggcatcgcagctcgggcaaggaaagccggctgtcagggttctggaaacgtcctgccctgagggcctgcgactttctgtatggagccttggatcgcgtccctggaaagggacaccaaagatttccaattccggagagcgggcccgaggaagggtcactgctcgggcgcacgaaagctgtctaaggcttgggcgtatatggggaactctggcttttgccacgcacttttgggaatgggcaggagacctgcttcctctctccagaggttgcattttcccaagcttgaacgcttcatgtgcctactctgcaggactgaggagtttgctctgtggtgtgaaaacctaaggaatggggggcgggtgtcttgccacttgtgtgacaggcttaacctttttgtatgaagttcgtttgccttatcggccttactgtttgatagtttactgtgtctgatttcttcccccgtactttttcaactagtctctagtgatccctgaaaagttccagcatattttgcgagtactcaacaccaacatcgatgggcggcggaaaatagcctttgccatcactgccattaaggtaagtgaagtagggtaaggaatagggaatgtaaatgagaattgggttgtgaagacataagcaaaaatgaagcaaggctggggagacttgagtctcatccagatcaccttgactgctggattaagaaaagaaagtggtttagggagagactgacccctttagcatttaccacagaaaataagtgattaaagccaagatagtggtctaaggtcaagccaaaacatttcacctggggaagtggggaggaggtatggttgctcacccgaattcgctaagattttcctgaaccacgagcttgtgagatttcttctagattcggtttctttacccatcccaccatcataacagcaacccttcctgcgaaatttatattccctgagaattggaggattattgggcatcttgagggataagtagaaataccaacagataaaaagtgtgaagaagcctgtagatggagggtggaagaagtctgagtgggacatttactcagatgagccataattgacactcctttcctgtcgaagtgtgaaggagtacatccatctttctttggcttttaagaatcgaatcaatgaatgcaagaatattatttcacttgagtatttctctccacaaacctaatgaattcttggctttctagatacataacgttctttttttttcccttaagtcagaatgtgtagttagttgtggaaatagcctaccagtatgtgtccatgcgtgcagggctaggcctgtcttcttggcttctgttgcatggtaggtacttaggcgacgtt

SEQ ID NO: 120304 - DNA, 1744 bp, Homo sapiens
actgtcgcccaggttagagtgtggttgcgtgatcttggcttgctgcaacctccacctcctaggttcaagctattctgctgcagcctcccaagtagctgggattacaggcacctgccaccatgctcagcaacttttcttgtatttttagtagagacagggtttcaccatgttggccaggctggttttgaactcctgccctcaatgtcatctgcccacttgggcctcccaaagtgctgggattacaggcgtgagccactgcgaccggcccaaagttaaccttctgtcgaacggtttatatctggaaaggtgggtgaggaaagggtgacctaggggattgcaaaatagattattgcagatcctacctttgtgagctttttgaatgaggctataaaggaatttaaaaatcagattcaacactaattccgaaacccctcacttcattcagggtgtgggccgaagatatgctcatgtggtgttgaggaaagcagacattgacctcaccaagagggcgggagaactcactgaggatgaggtgaggacaaggaagggggctgggggtggggtcagcctcagaaaggggtccatctagatctgaccttggtctgcctgccaggtggaacgtgtgatcaccattatgcagaatccacgccagtacaagatcccagactggttcttgaacagacagaaggatgtaaaggatggaaaatacagccaggtgtgtactgaaatgagggcaggattagaggaagggtggagggtcctaacagaattgggcataggaggtcaggggataaaacatcccttgccccctcctctgaatccaggtcctagccaatggtctggacaacaagctccgtgaagacctggagcgactgaagaagattcgggcccatagagggctgcgtcacttctgggggtgagtggggggtctcatctccctgcctacctcgactcagcattcctcctactcgctcttctttttccccaaccttttgtttctgctgtgcatgacctgtgactcttctctttttacctgcagccttcgtgtccgaggccagcacaccaagaccactggccgccgtggccgcaccgtgggtgtgtccaagaagaaataagtctgtaggccttgtctgttaataaatagtttatatacctatggcttcctgtcctttctgtccattctaatagggaatgttaaagtgctgggtcctttttccatttagagctgccctactcagttgcccacacagtgctattagttttagcagtggtgatgctgcagaccccccagtctccctatatgtagctagtgatgtccctctctgtaaagagaaatgtgagggtaaaacagttcagccttgaggggctgacccagaccagtttagagaccaacaccctggggttggtgtgcagcatcattgtggagtgggttagctgagcctagccagttgcagttaaggtgagtttgcaggtcttggtcactctgggtttttttgtttttgtttttgttttcttttaaggggtcatctagtcataagggaaaatccttcgggctgtgaccgaagcaacaaaggcaaaaacgcggacgttggttatgaagggtgtggtctccctggtggagtacgtcggtgggttgggatggggagcggctggacagaccggtctcactccgtttggtgccactccacccgcccgggtttccgcgccctgccgcgctgctccgacgccgcttccggcggggatg

SEQ ID NO: 120305 - DNA, 1685 bp, Homo sapiens
acctctggcctagaccaccagctgaagatctttgacttgcgagggacgtaccagcctctgagcactcggaccctgccccatggagcagggcacctggccttctcccagaggggactgctggtggcgggaatgggtgacgttgtcaacatctgggcagggcagggcaaggccagcccaccctcccttgaacagccctacctcacccaccggctctcaggccctgtgcatggccttcagttctgcccctttgaagatgtgctgggggtggggcacactgggggcatcaccagcatgctggtccctggtgagtgggccaggggatggggcttgaagtgaatgaactctgggtggaagtttgggccagagacatccaggaactgggggcttagttgggctggagctgttggactgaggttcttccttatggctccatgcttctccctccctcccttcaggggccggtgagcccaacttcgatggcctggagagtaatccatacagaagccggaagcagcgccaggagtgggaggtgaaggccctgctagagaaggtgaggctcccctgctggagagggtgagatcccccccattgctggagagggtcaggttcccccgtcctggagagggtgaggttcctccttcctggagaaggtcaggttcccccctgctggagaaggtcaggttccccactgctggagaaggtcaggttcccccctgctggagaaggtaaggtttcctcttcctggagagggtgagattcccctctcctggacggggtcaggtttccctctgctggagagggtgagattccccctgctggagagggtcaggtttccctctgctggagagggtgaaattccctctcctggagagggtcaggttcccccctgctggagagggtgagattgcccctgttggaggtgaggttcccctgctgcagagagtgaggcccctgctgctggggaaggtgtggtttggggttggaggtagagaaagctctcctgatgtctcatgctgggggtcttgggtagaggggttcagcagcctccctggcttctctttttggtgctaccctcctgtggctccttgctgagtcctgtccctctgtgacacccccaggtacctgcagagcttatttgtctggacccacgagccctggccgaggtggatgtcatctccctggagcagggaaagaaggagcagatagagaggctggtatggagcaggcccctgaatgcccaggcccgtcttctcccccacatcctctccccaccatggcttgtccccagaagtgcggccagcaggtgggtgctgccagttccctgactccgaggctgtaacagatatcactcctgtcccctccctcagggctatgacccgcaggctaaggctcccttccagccaaagccaaagcagaagggccgcagctccacggcaagcctggtgaagaggaagaggaaggtcatggatgaggaacacagggtaaatgagcattggcatgggccgggccttccacaggctgcaccctcctgcttgtgcctctgcccttgtcagcctgccacttctcactctgtgcctgtgtcctccccgtctccggtccccaggacaaggtccggcagagccttcagcagcagcatcataaggaggcgaaggccaagcccacgggggcccggccatctgccctgg

SEQ ID NO: 120306 - DNA, 1147 bp, Homo sapiens
cgtggggcagacctcaagttgtctgagtcggtggtcccctgccttaacaccctgcctgcccctcacctccaacagacacctggcttttggagggcgccgaggtcatgtggctgcccttgattgggtaacaaagaagcttatgtgcgagatcaacgtcatggaggcggtgcgggacatccggtcagtggcctcactgtcagcggtcagttggggtgagatagtccattcctgattgaatgatagcctgtgacctcatttcccaattgaaccactcttcctctcccccaggtttctccattctgaggcactgcttgctgttgctcagaaccgctggctccacatctatgacaatcagggcattgagctccactgtatccgccgctgtgaccgagtaacacggcttgagttcctgcccttccacttcctcctggctacagctgtgagtggccatggagctcaggaactggttggaagcccttgggatgaccacctctcctttaggaccccagcagagggaatacagagggcaatcaggactgggtcattctctctgtctttctctctcagtcagaaacagggtttctaacctacctggatgtgtcagtggggaagattgtggcagctctgaatgctcgagctgggcggctcgatgttatgagtcagaacccttacaatgccgtcatccatctcggacacagcaatggtcagtacctggcttagttttgactctgaccatcctgacttgcttttcttctatatttgtacttcatgagtcccttaaagttacccttttatttcccttttttgttatctcttggtcttgagttcccatctttcccatgtttagtaacctcaggcttaggtgtgtattagcaactttggttcttcttctcttccaggtactgtgtctttatggagtccagctatgaaggagccactggcaaagattctctgtcatcgtggtggggtccgggctgtggcagtagattctacaggcacgtaagtcactggtggggtgaggtgttaggagtcataggtgggcagaaaggtgtggaaggcagtgtgctttaggagcacagagtctaaagccaggatgcccaggtttaaatcgcagtgttaccacggatgggccttgcaagtataggca

SEQ ID NO: 120307 - DNA, 1038 bp, Homo sapiens
ctgaagtttgtctttcttgggcgggacatccttgcccggcttgggggctgtctccatctcgcccacccgaacggcgatccacgtgcaaaactcctctcagctgccacacagtcggcttgaaaactcccggaagccctctgtccttcatccaatcagcagcgtaccaggtatgaagctctctaggtgccatcttgagtgagggcacgctctccttagaggggcggaacagtttttggcaccttatcgcgagcggcagcttatgcaagagtgatttaaaaaagaaaggcaggtccggagccaggggctaagtagcggtgcggtttctttttctggattagtttccccatcttgcctaaaaatgtcctagtctagtctttttagcagaactccactccctaaacatgtcagaactacacttcccatcaagggtcagaaagaaacttccggcacagtcttttcccagcattccttgtttacttccgggtttattactactgaaggaagaacgtgagtaggttaggatttcggttgagaggcttggggtcttgcgtttcgcccaccatctcctggggacagggtggagtcgatatccgggacgggggggaggttgcggtgcccctcagggctacctctcaagagtgctatcatttccgcaggccagatcagaaaagggagctcaggtaccttccagagagtgagacccagcgcccttgtctcgcacccagtaggctttcatccccgccatggcggagctgatccagaagaagctacagggagaagtggagaaatatcaacagctacagaagggtaagggaacagggtcggtatggtctcgcccaatgcacttacaacccaaagccattaccgagataaggtttgttgccccatctgggccctcgcgtgcagagacttccccgcctcagtctcagtactcttccctgttcactcacccgctgcccccatccttttctgcttcctcagatccatatccacctgactaggattgtggggataggtggcacatttgatgtttctaaa

SEQ ID NO: 120308 - DNA, 1333 bp, Homo sapiens
gaactgtgtattctttttcaattaaaccgacattcctagcaatatggtatgttgcaaatgcccttccaaaagaatcatgccaaccaagatgagggagagttaagggttgtatatacaggcaagaagtaggtttgaagacatttaggatttcactttcaagaaagaacactgtgccacaaagagattccaagtgcaagagtttgaacctgagggggtaatacaggtggtgtgtgttaaggtggaaggggctgtggggatatgacagaagtgcctggtcaggaaacagagccaggtgtttttacattttattagctacagtatagatcctagagctgcctcattccctcccctcccctcccctccccccaccatggggtcaggccttgccaggagcccctgcctttgctgcctgggcccgctggaactcctgctgcagctgagcaagggtctccctctgttgctctgactgccgctcaagatcccgaagctgggattcgtatcgcttactaaggagagacaagggagacaagcagaaagggagaaattagtaggactcactatggagagtgctaaacgcaagaaagagataggtggaaaacttgagatccaggggagggagaagaaggggggttaaaagggaaggaaagggttggaggaactggaggactaggggccactatggagagctgttctgcaatggttcaacacctctactccaatggttcacttgcatcacagggtgcagcacacggtggtggaataaaaactcacatttcagctgtgatatagtccagcctcttccctactgtggcccgagcctcccccagctcctgtttgactagcaccggacccagaagtttaaagaccacgttggacccatccagcagggccagttcctgatggagggatgggacatatgtgatcagaaccatggctagtacaggtccctcctcgccccacaaatcccagtccctcacctctttcacgatattattttctgttagttgtgcttcaagtttctgcctccccgacatggatttacttaagtctggggatgagaggaaaggcaatttagaaacatcaaatgtgccacctatccccacaatcctagtcaggtggatatggatctgaggaagcagaaaaggatgggggcagcgggtgagtgaacagggaagagtactgagactgaggcggggaagtctctgcacgcgagggcccagatggggcaacaaaccttatctcggtaatggctttgggttgtaagtgcattgggcgagaccataccgaccctgttcccttacccttctgtagctgttgatatttctccacttct

SEQ ID NO: 120309 - DNA, 1520 bp, Homo sapiens
cagacacctactggatacccggacatcagggactgatgtgagcttcatgtcagccttcctggctacccaccgggccttcacctccacgcctgccttgctagggcttatggctgacaggtcagagtcataagggacgcagggtagtggagtatctgcccggatttcctaaagccgcaacatcccaccaaaatagtcaaagccactgagggtttgggaaaaatggacagatagatcctcttctccccctcaggctggaagcccttgaatctcatcctaccgacgaactagagaggacaacagagtgagtgacccctggttcttaatctcacagtcccctctgcccaggctgcagctttacctctcacccttggctgattcccttctcccagggtagccatctctgtactgtcaacctggctggcctctcaccctgaggattttggctctgaggccaagggtcagcttgaccggcttgagagcttcttacttcagacagggtatgcagcagggaagggtgttggggggggcagcgctgacctcatccgcaatctccggtcccgggtggacccccaggcccccgaccttcctaagcccctggccctccccggcgatccccctgctgaccccacggatgtcctggtgttcctcgctgaccacttggccgaacagctgaccctgctagatgcggtgagaccctgacctctggcccctatgccccctgaccccttactaacctctccttgactccagatcctttccttgcttccaccccttcctgatccagctcctagcctcctccacctaccattttgattctccccttttccctttggtcgttacccttcaaaccctgtgcccctctggttccttggccacctgagatcctcagatccctgatattggaaggctgacctcacttgactatgaactttaacctctgacctctaccctgcaggaactttttctcaatttgatcccctctcagtgcctgggaggcctgtggggtcacagagaccggccaggacattctcacctctgcccatctgtccgagctactgtcacacagtttaacaaggtggcaggggcagtggttagttctgtcctgggggctacttccactggagagggacctggggaggtgaccatacggccactccgtcccccacagagggcccggctcctggagaagtggatccgcgtggcagaggtgagagagaagattgccctacggtttgtggccatggaatggagaggcctcccatagccttagctctcttctttgacccccacaggagtgccggctgctccgaaacttctcttcagtttatgccgtggtgtcagccctgcagtccagccccatccacaggcttcgggcagcctggggggaagcaaccaggtgcggaggctgaggcattggactggggtgggggttcctcagaaggcggggaagagggggtgacagagccaggcctgtcctcagggccacttttctcccttccccagggacagcctcagagtct

SEQ ID NO: 120310 - DNA, 1538 bp, Homo sapiens
atttctgaagtctccacttttctcttgtctctgggtccctacatctcctcctccttgcctcagttattctcgcgcctccctgggtgtcggcccgtttctctgctgcggggagtcctggcgtctccgtggttctctgtcagtgtgactcaggacctgcccgcaggaacctgccctgttcctgcctggaacttctggctggctgtcctgtccctgcgggtctttggccctccacctctgcctgcctgagtgtgcctacctctctgagcagtcgtgtcttggtccctgtctccctccttgtttttgtttggcggggaggggtttgtttccacagtaaccagctcctctgactctgggattggggagggaaccctcagatttcgtgacccctccttccctctctcccccttccccccgcccccccgccccgccccggtcctgggtagaggccgggaagccacggttctgggacctggaggaaagatcctagggtgggtagagagtggtcatctgttttcattagggattaatggtggtggccaggagcaggatttcgggcctcaggaggggccagaatttggatttggggccccgaggccctaaactcctaggtccagatcctaggtgagggcaggttgactggcagggctggtttttcgggatcggtcgggggaggggctggggccacgtgactctctgagtctaccgcccccaaccccctatcatcccacttccccttttccttcctgtactgggattggagctgctaccttcgggggtcccttagggctgagatagtggaggcgctacccgagggaccagggtgaaaggggtcctgaaaaagactaattctctgggctggtatagtccttggccgggaggggcggggcatgcggcagtgcctggactgaggtttcagctacccctagtcgctgcctctggcttgctgcctctcgcttccctctcctgccctttgtaccctgcttctctgtcgtgtgtgggttcagctctggggagaaggggctttgggggtctccaggatcagaattcctgtactccatccacgcctccactgcagccccttcgactccaccggggccctgaggcggctggggtggggctgtctgggccccagtgggggagacctggggtcaccagctcccccaacccttcctcgcactcgctggtactatgccctgccaccacaggtgaggggtacagagggaggagcagggcctggggtgaaggctgagggcaatggggggtggtgtggaactgtctgacttccccttccttgctcctccaggcccctgtgtccgtctgggatgaggaggaggatggtgccgtgtttaccgtcacaagccgccaatatcgacctcttgatcccttggtgagatcatgactttagcttctcacctctgactcttcattcccagttttccttcctctggctgactttctggccagagtgctaggttggagttctggagtcctggactctgctgtgtgacataggccaagactcttgccctctctgaata

SEQ ID NO: 120311 - DNA, 1046 bp, Homo sapiens
tggggagctgtggcagaaggatcgcttgaatctgggagggtgaggctgcaatgagctaaggttgtcccactgtactccagcctgggtgacaaagtgagaccctgtctcaaaaaaaaaaaaaaaaaaagaaagaaaagaaaataaattgcagcccttttctcaccttaagtattcaaacacaggtgtttattttaaatagtcagcacatctcaattcggactagccacatatcaaatgctcaatagcctaatgtgggtggtggctgtcatattggacagcggagcctgagaggacttttaggaggattaaggaagacagtgtatctccttaagaagatgcaggagatacagcactcagcagtgtctggagggcagaaaatattagcctcatccttctcccatcatctgtgcccatgatagtttatatgtctctaaactgaccatgtacacctcaactgccttttaatatcctgaattcctcaccaccttcctctcttccagaaagcagagtgagggcactcactgccatcctgtggaagccaccatcatctctggcccaagcttctgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggctgcagtgcagtggcatgatcttggcttactgcaacctccgcctcctgggttcaagcaattctgtggcttcagcctccggagtagctgggattacaggcacatgccaccacacccagtgaatttttgtatttttagtagagacggggtttcaccatgttggccaggctggtcttgaattcctgacctcaggtgatctgcccacctcagcctcccaaagtgctgggattacaggcgtgagccaccacaccaggcccgagaaatgcttttttaaaaaacacacatcttatggcattcaccttcttggagctctaggacagtg

SEQ ID NO: 120312 - DNA, 1486 bp, Homo sapiens
gattgtggggaccgtaatagggggagggatgatggataagagggtgcctgggcaagtaagtagagatagaaagaggttcctgggagttagaggggtaatgggaggctagaagtttcctggaaatttgaggggctttgacatgggtatttctgtgacgcaccaatggagagacagtgggttccctatttcaggagaagaaacctaaccttctttagttctgaggaagccagcaggcaaactgagggtctcttagggaggacagtatggactgatttccctatgctcatttcgtcctctttccccagaaccccccaaagtgtccctgatgccagcaacccttgcacgggccgccccaggggaggcacccccggaattgctctgccttgtgtcccacttctacccttctgggggcctggaggtggagtgggaactccggggtggcccagggggccgctctcagaaggccgaggggcagaggtggctctcggccctgcgccaccattccgatggctctgtcagcctctctgggcacttgcagccgcccccagtcaccactgagcagcatggggcacgctatgcctgtcgaattcaccatcccagcctgcctgcctcggggcgcagcgctgaggtcaccctggaggtagcaggtaagagctgggagctctgcggaatctgagccagcacccaggaagacaggagctcactctcaccccttctgcctgccaggtctttcagggccctcccttgaggacagcgtaggccttttcctgtctgcctttcttctgcttgggctcttcaaggcactgggctgggctggtaagtgtcagccctaccctgaccatgacctgaggttggtggactttccccacctactcccaagagcctgacacccatccctctgccctccacctctaccactccagcatcccatcccttctcaatctttccccacagctgtctacctgtccacctgcaaggattcaaagaaggtacagtgctccacctctctgtatctttcccttgtcactttatctcctcatcctatctcaaaacccatggagggaggctgctggtgtggtaggcagaacctaggcttggaattcacactgatctgggttaaaacctggcactatatcctaactgtaggactctttgagcatgctacttaatctatatgtttccttgggtgtagggattttaaaaagttacttaggcagtgctgtccaatagaaagataatgcaagccacatatgtaaatttaaatactctagtactcacattaaaaaaataagcagaaacaggtaaaattaacttaataatataccttatttaatctaataattctggtcccttatctgaaatgcttgggtcagaagtgtttttggatgttggattttttcagactttggaatatttgcatatatttaatatctttgggatcagacccaaatctaaacacagaaatcatttatgtttcctatacacc

SEQ ID NO: 120313 - DNA, 1020 bp, Homo sapiens
gggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtg

SEQ ID NO: 120314 - DNA, 1043 bp, Homo sapiens
ccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtatcactgtctttttcttgtccttctactgttacagattggcattagctgtccccttgctcagggttagcccagtatccccggggtagtcccgctctgtcctttctagcctggcctttttttttttttttttttttttgtctcgctgtgtcgcccaggccagggtgcagtggtgagatcacagctcactgcagcctggacctcccagtctcaagcgataatgcctcagcctcccgagtagccgggactacaggcgcgtgccaccatgcctggctaatttttgtttttgttgtttgtattttttgtagagacggggtttcgccacgttgttcaggcagtacttttttttttttttaagtgcttcagccgccttaacgcactttactttttcacttcgtgcagtaggagtgagaaagccaatgaggggccgactcaaggttatttagcc

SEQ ID NO: 120315 - DNA, 1988 bp, Homo sapiens
cactgtcaggcttcaatggagcgcaaaaattcctaaatttggtgagaaatggcaacattaccagggaatgaacagaccaggccactcacatccacgtgagggctccaggagccacttccgggcccagtcaaccacgaccaggagaggcagcgctggagcctcaatcacgtcgacggaaaacaagtgcgctccctactgcagtcaccaggaggcgctagtcccgcctgtctcccggcacgggtcctcgtttgcgcacgcgtcatttctttcctccagcgtccccgccccttctcctccggccgccaccagtttcgcttggccagttgcgttcgtgcggcgacgtccacgcattttctgacgtagcgagcgacggcggggagccgagcggaagtccagcactattgccgctagaggaggggaggggtgagaagcataagtggcaccggaagtggaattaatccgcctacctctcctgcgcctgcgaaacagaaaagacaaggcgcctgtcgggcggggtgtggcttcgggtggcggagaacgctgcgattggccctcggctgtggcgacagcgacgattggtccctgcgtgcagagcgcggtgagagtgggtggtggccgttggaattcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcaggtgagtaggggcggcgcaggtgtcctgccctggggatggggacgaaggctgaccgctccgatgctgtcgcgcccccggctcccggtcggcctttgtcatgtctaccgggagagcgaaggtccgtgcgcccccgcacaagtggaaaggggcggaggcaggagtggagacggcttagagcacccggggaggtcggaaggcacgtctgtctgccctcccctagcttcaagtttctggagcccctcccttaactttcatgtctccgagatttctcatttcgaattctcaggctcgtctgacacatttccacttctttattcctactcagggtgtgattgcagtgtgtaagaagggagagttctgatatgacttcttccttttggggacatggtgtctgaggccacatccttgctgaggtccttttgtgttaatcgcctctccttatcactgctgcttcggagtgtaggaaagggagaaggagagtagggtaatctgggccaaaagacttctcattctctctctcctttcccaaattgtgcagattcctgcccaatgaaactgattgatttagttctttctcttaaatggtgccctgctgcaccccacaaccatatgcagcttcctgtctccagtgaagagagatgaatgtgtgtgacagctggagtgtacttatctctggtgccaggaaaggtctgcctgaatcctttgtttactagtatttcacgttcaggtttccctgaagttaggattcagccttaagagagattctttctctcgtgacaaccagagagcagagtagtattatgtgacagtaagaagtagtaaaagccttctcagatctattaatcaagtatttattgagcacctactacatgctaggcgtggttgtaggtacttaggatgcagcagtgaacaagggacaaatcgttgccatcgtggagctgccattctatggggatacagacaataaatgtaataaatgaattatataactgccagaaggccgtaagtgctgtggagaaaaggagaaattcaaggttgaggacataggggaggccaactggcgggttagagtattaaatagggtggtctcagtaacccccatggaaaagatgagttgaataaagacttgaaggaagtgagggagacagacaagcagatagtgagggaagaacatttcaggcagagggaatctg

SEQ ID NO: 120316 - DNA, 1576 bp, Homo sapiens
aggccagcctaatcaacatggtgaaaccccgtctttactaaaaatacaaaattagttgggcgtggtggcgcatacctataatcccagctactcgggaggctgaggcgggagaatcgcttgaaccctggaggtagagtttgctgtgagctgagatcatgccattgcacttcagcctggacaacaagtgaaactctgtctcagtcaatcaataaataaagtatatgggagcgtgtgcatagactatatttaatactatatacctatttatgtaagggacttgggcatccttggattttggtattcttggggggtgctggaatcaaccccttttggatactgagggatgactgtaatttctggttctaggggaggtatcattaggagctggccagacttagggataagggaaggaagttatcctatttctaattctgagaaaagcacttcttctgcccctgtcctagcaagtgtacatgccatcttaagaatgatcattctacctttgctctctcccatctcctgggcagctcaaaaagtttccaagaagacaggaccccggtgttccacagctattgccacaggtaactgtgctcaagagctgggtctgagaagggatttggggtatgtgtaaagggagaatgatggaggtggagggacactggtcctgtaattcctaagtcacctcctcaattctgtagggttgaagaaccagaagccagttcctgctgttcctgtccagaagtctggcagtaagtgacaaacataaccactgggtgagaggctgggatagggaagagaagatggtgagtgaccagaaaaatccatttggtctctaaggggaaggagatgtagcatcaggtgtggatcccataaaggctagaagggaggagggatagagagcctagacttcactgacctttgtcctttctgtgttcatcttagcatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggaggtaagggccagattttcaccagatgtcagccccgctttcctggcagaggtcatgcctcccctcccttccaggtacccctcaagtctgggctgagaactcctgagcacctatctttagcagtataggtgctgctgaagatacctctctcttgacctgtctgcaccccagcccactcctgactgtcttgctttctgccacgcttcttcctacccttgactgtttgcaaagctctc

SEQ ID NO: 120317 - DNA, 1942 bp, Homo sapiens
ccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtgaggacccatgggcactggaactgggaaatggggaggagtgggcagggtgccacgagatggaggtagagggagaaaggagcaagagagaattgaaggatgaagtgcaagttatcaggctgggttaccacatccggttttggcctgtgggctgtcggtagatctgccttaacctgggagtggcgagggagtgatgcatctgccaaaacgaggagggtcactacatctcatgtctcatcttcttgctcagctcatcctagccatgctggcctcctggctgttcctcaaccagctagtcgtgctccccatctcagggcctttgcctggatgctctttcctggagatcttggctatcctgtcaaaacttgtgttccccaccccgcctttatacactccctattctatgtattccttaccattttcagacatactgtgcatcttattttgtttcttgacaggctagaaagcttcaagagggtgggggtgggctcttattcatttccatacatattactatgtactgacttctgcctgcctttttgccccttctgctcccatccccaggtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggtgggaatgggagtggggtgagatacgggacctgggggacagttggggttggctgtgcagaaccctgcctattcctaaacatctgtccccacctcaatcatctaggagtcccacgtgccttaccggaacagcaaactgacctacctgctgcagaactctctgggtggtagtgctaagatgtgagtgaaagggacagatggaaggggtcaggtaggaactgtgttggggtgaggggtagaaaggggaacagtggagacctgtccaggctctgctggcccctaatgctggggttgggcacattgtcttttcataggctcatgtttgtgaacatttctccactggaagagaacgtctccgagtccctcaactctctacgctttgcctccaaggtgcgattaccacccgtcagccttgtcaggacccgtgggtggttgtaggcttctccattccaatccc

SEQ ID NO: 120318 - DNA, 1079 bp, Homo sapiens
tctcaaaaaaccaacacacaaaaaatccctaagattcctccctatcagcatacagagatcattatttttaggtctgcctagactccactatgtagctgcaccaaaatttatccaccagttccctctactggacacttggattgtttccacacttttttagtcacaaacaaggccacgttgactaactttgtacatacatcattttgtatttttcagttacatctaactagggaaatagtccttgaaatgggattactggatcaaagacttagaggtttttcagactattccaaatagtgtgaattcagactccaaacctcatgagggtcagccagtggctatatgaattctcactaatgagaattccttccactagaatctccttccactagtgttaagcaagtcagaaagtttccttactgtctgcctccacagtaatttttttctctggtacaccctcctcctgcgcgtatagccctttgatgggctctggctttatttgaggtctgatcaggtctgtcctgctgtgcgcttgggcctcctcccagtcagcactgattgttgctgtggagtagccagcacctgcaccctgatctggtattctactttgatgagggtttccctcactatcttgcaagttcaattttagagggtggtgatgttttttctaactttttattaatgttataccaatgtaacatccaacaacatgaactttaatatcctctaatacccagtttatgttaaatttcacccaactgtctcagaagtgtcttttatacataataggtttgttcaaatcaggatccaggcaagggccacccacttggttgaaatgtctcaagttccacaaccctatcccacactgccactattatgtcgtttgttgaaggtcatttgtcctatagaatatactattctggattttggctggttgcttcctctttcccccatactttcacttatttatcatatttgggtgttgtcaacctgacccatccatttacaagctccttattgactttttcacctagtgattttatccagcagtgaccatacctggatctttatttcattaa

SEQ ID NO: 120319 - DNA, 1349 bp, Homo sapiens
ataggaacctcctggccgggcgcggtggctcatgcctgtaaccccagcactttgggaggctgaggtgggtggatcacgaggtcaggagatcgagaccatcctaacacggtgaaaccccgtctctactaaaaatacaaaaaattcaccgggcgtggtggcgggcgcctgtagtctcagctactttgggagtctgaggcagaatggcttgaacccgggaggtggagcttgcagtgagccgagatcgcgccactgcactccagcctgggcgacagagcaagactccgtctcaacaacaacaacaaaaaaaagagcctccttcagattggtgccagtgtcctttagacagaactctagtagtcttttcagattcaacttgtacatttccttccccagacttcaactgatccattttctaaggagtcctagttcctaaatgggtgttattactattttatctcggtttaagtgttttacagtgggagaggttggaggtctctagtacagggtattgctggaaatgaaagcctcctttctctgctcctgtattttcttctggggcttccatctcttctcaagccttttcacctcctccaaacctagtgtgcagaggagaacaaaccataactggcaccagcctgaaccagcctttggaggccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgtgggaggcgggagcgggggctgagggcttcgtcttttctcccctctgctatcaccggttctggaccttggcctggatcatcttcccctctgctaataccccctaccccgtccgtcacatcagggaggtgtgccctctagctatccacgccccctccttggtcactagttataggtaactttcacccttccgccggccaccccagccccagggaagaacgttcctttggtgggtgtcggcaaatggggaccggaccccagagtc

SEQ ID NO: 120320 - DNA, 1050 bp, Homo sapiens
gaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtg

SEQ ID NO: 120321 - DNA, 1154 bp, Homo sapiens
ccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaaga

SEQ ID NO: 120322 - DNA, 2275 bp, Homo sapiens
aggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggcc

SEQ ID NO: 120323 - DNA, 1698 bp, Homo sapiens
acatgcctgtaatcccagctattcgggaggctaaggcaggagaatcacttgaatctgggaggtggaggttgtagtgagccgagatcacacgattgcactctagcctgggcaacaagagtgaaactccatctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccaga

SEQ ID NO: 120324 - DNA, 1086 bp, Homo sapiens
aggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcaggga

SEQ ID NO: 120325 - DNA, 1524 bp, Homo sapiens
caatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggtgagctactccgctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtct

SEQ ID NO: 120326 - DNA, 1043 bp, Homo sapiens
caaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacct

SEQ ID NO: 120327 - DNA, 1048 bp, Homo sapiens
atgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggccccccc

SEQ ID NO: 120328 - DNA, 1101 bp, Homo sapiens
agacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggt

SEQ ID NO: 120329 - DNA, 1291 bp, Homo sapiens
aggatctttcaacccactagacatggtgtcagtggaggaacacgtggtggactctggagagaatagggtggagggatgcagacagcaagcctgtctagagccagaggatgaggctgtgctacacctgcctggtagaagccaggatccaatcctacccaactcaagcggcctcctagacatgcccctcgctgcacacacacacctttgctcagaaggcagcaggtggagggggggggggacttgtattgcagtactcctgttacacagcttttgtaacagcctttctggaattagcaattgcagtatgtgccttgcttctgggtctctaggtgcttaaaggacacatgagcttggttgggactaggatggggctagcatcacgaaggctgcaggacaggaggtagaaaagaacaaacttgcaatggcctgagctgccctctggggctgctggctgctgcacactcaaacctatggcacagctgcctgttccttaaggctgcactggggacttgcagaaactgggttgcctgcagtgctgaggtggctctccataaaacaaactgtgtgacctccctacagccacccccactttttccacaggaaacttgtcctcctgtagctaaacccaacctctgtcccaagcttccagggtaaaggagaggctgtcttccagctaaatgtggggcacccacatcaggcttggcatcaaagccactgcccagatgcccccatggcaaaagcccaccctagctgttttgcataggatttcttaaacaggcacacaaatagttggtgtgctttgggaacagtgagctgtaaactcagccttgaacaaaagagaactaaaaggaaggtcttaggaaggaggccttggccagaatgccaagtttccaagtgatgccaggatgaagttacttattggaaagggatagtaccttgggggagatgttggtcagggaagggggatgtatttgaaacttagtttacatttggcttgcaaaaaggctttccttgaaacagacctccctaaataagttgggtcccctgttcttccatttcacttgttcagtgtccatcatcgccctaggagggcagctctgccatgacagggactggcccagcctgtctgcctaatgcatggctgacactgggtgaattggaggagaagggtggggagaaatagtcaatgttatctgtatctcaggcctgggtccctgggagagggctttcctctgagtggttgctgtctgacatccctctctgcccgtgccctagaaggatggctgatgct

SEQ ID NO: 120330 - DNA, 1043 bp, Homo sapiens
ggctggcggcgcattcggcgtccgggaggccgggccccggacgcgcgaggagcgcggggcgcgggaaggcaggcgggtgcacatgggtgccggcgggcgagctgcggggggagggggggcggggtgtggcctccccgcctcccgggcgggatttgcatgtgtgtggtggccccagacttcctgctccttctacgctgcaggtacgcgcgggccgggcggggcgggcgggcggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcggggacatcgtctccctgtacgccgagggctccgtcaatggcttcatcagcactttggggtgagtgagccgagctcgagaggggcgcgggtaaagagggggcgccgtgggccctggtgccagctgcgtgcgtccagccgccgccccccgatagaggcctggacgtccccctagtctcaaggagcgggaacggctcgcctccttcttttacagaaaggaagtgaagtgtttgctcaggtaggactcgggctccctactggagttggcaggaggagcctccctcggcggcgcagcctctaccctcccgcgcacgcctttggagggggcggagggacggaggcttcctttgcaggtggtcccgggggcgggcaggtgggtggctggaggctgagttggggaagggcagccgggccgagacgtgcccggctctgagggtagggcggagctgtcgggagtgggcaggctcagcttggagcccgtaatcctctattaccgatcccgtggtgcctttgaggggtcgcaccttctcctcacagctctctccctgttcttcccagctt

SEQ ID NO: 120331 - DNA, 1382 bp, Homo sapiens
ctcctgtgcttctctcatctgtctgtctttggtctctctctgcttctgtttcttatgctttttgtctttctgactctctgtctccctcccttccactcctctatgcttttgtttttctcctcctctcctgcccccttcacccactgcccatcccatcagggcagcagggtctcagggctgggacaggagatacacctgcagcatgtgacaggcccgactggtggcagagtccccccaggacagctgcagctccagtcagggggctggggtgggctgggtgtgcttctgtgttcttcctggggttctccccgcccccaagagacaccttgcctttcaacggtggtgccaggaaagaatgacttgatggtggggagcttgttagagatggaggaattatcttaggggctcactggtaccctggcatcccctgctctaagggaagggatactgtgggagataggtctcttctctcctgctgaccgagctgctttgttccccaggctggtggatgaccgctgtgtggtggagcccgcggccggggacctggacaacccccctaagaagttccgtggtaagacctccgcttcctctgcccccgcccctcccaggctgcagggttctggacctgcgactgaatttattcaactgcattcagccccagtggctggattagatgtggcgctgccctgcagacctcactctgctgtcggcggaatcccccttggcttgcactgctgccatcttggcacagacgtgccattcccttcattttctggggccacaccccacttctcaggggcacacccacttctggccaggggcccattctccccccaaaatccccacagccacagggctttctttgtctgtgtgactggatgttttctgagggaacgggtggaaaagagaattgtcttagactttaggaggccctggtgacagcccttccctgtgcctcagttcctcatctgcatggtaagagatttggaccccatggtttccagaactcttctgaccctggctgtgtcctcagccccctcctgtgtgtgagtcctgccctgcaggaggctctaataacaaagccccttggtgggaagttggtgagaattcaccttgggcaagtgacttcgttcacgggaccttgtcctgagtggtcagtgggctcctcgggccgcccagcaggctgagggcctttgtggggattaaacaatatcctggctgtcattatgccaagccagggtgaggtgctattgttgtgcttacctgtgagggctgagaccgactgacagtcagacagacaggtcctgggcgtgttgggcagggtgggagcaggcagcaacacgctgggcctgctgccaccaagtctgcccgcgtggctgctc

SEQ ID NO: 120332 - DNA, 2079 bp, Homo sapiens
gactgtcccctccagaggctgggctgttctatgcctgtgtcagtcactggataggggctgcccctgggaagaggggtatgtcatttcccaggcatctgtgtgcaagatggtttccatcagccaaggcaattagctaaagaggatgcagatgtgagctgttagctgccaatactcacaaaagctgggcacagacatggcataagggtgaggccccagcagcctctggtaaatctcctaggggaagagggcacgtgtccaccccaccaagtgagatgcactgctctcaaacctgcctctgagcctccccattctactcagcatattccaggatgctccaaattctgtgaggttcttccaaccgcttcctctctacctgcagcggggaacgggggtggggaagggttgggagagaagagctgcaggctggggttttctccagggagggccctgagccccagatgaatcattcccctcacccccaacctgccccaccacagactgcctcttcaaggtgtgccccatgaaccgctactcggcccagaagcagtactggaaggccaagcagactaagcaggacaaggagaagatcgctgatgtggtgttgctgcagaagctgcaggtatgtgtgtgtgtgcaggcgtgcatctgtgcacatgtaccaggaacctgggtacacaagcagcggtgctgcttgtcggagccagtaggggctctgtggctgagctgagtggtttctaaaactcgtatgggcgtgacagttcacacctgtaattccagcactttgggaggccaaggcaggaggattgcttgaggccaggagtttgagagcagcttgggcaacatagcaagaccctatctctacaaaaaattaataaaaaataaaaataaaaaaataaattccaatacgcaagagattggtgtgaattgctgtgaaggaggggatgtggggggagtaggatcccttcccagtgacccaccagtctgtgtaactctgttgtgtcaatgagaagaaagtgccccttcctccaggctggcacagccctgtgccagggtgcatggctcagagagtggaatgtcgacaccatagagcagtgaacaacctgtacagctgtccatggagttcccagtggctcctggagacagtggctctggggaacccaatttgggagccctggatctagtcttaacctctccccttgttttatagagttggagcctggggcccttagatgggactggtctgtccatggtctgaccatcctgtaagtctgcagtagagcctagatggcccccaggtctctgactcaccctggcttcctcagacatgtggatcgtgccatgatgctggaatgtggtggtcgctcatgagccccttgtgggcagtggctcagttcacatcctgggcagatctcggggtcccaaccccgttccccaaaccacaaagagagtgggaggctttggctgtggtcaagaactttgtagcctgggccctgggccctgttgccccaccccttgtcatacaaaccttgcttctctctgtccccttcctctaagccccacgcctagaggaggtgggtctagaatggggacattgggctgcgccttatagctgtggactgggctggagagagggagctgcaggtgggctgcctgagctctagtattaatacctcagctctcttcctggaatgggggctgcaacaggcttccttcctgctgccagcaggtagaggctgagctggggatctggcctggggggagggcattcacctatgcagagccacataatcagaaccgcaagcggtcacacagccacatgctgttgctttgtggaaagtcacatggtccatggcaaggctctcctgctgccaccttcgcctcggtctcagtaaaggactgaggaggaggaaaggacagagaccactgctctcagagagtgccagtctgatggaggggacagggctcctgccctccaggaacccctaatctggtaaggaggcagggcacctatccttaggcagcttccagtctaacagaggacagaagagcctaaaaagctgtctctaatgggatgcaaac

SEQ ID NO: 120333 - DNA, 1797 bp, Homo sapiens
aggagtgggggtggtggtgggagccaggaaatggcaccaagcagcccctgccagcgtttggactgggacaagggtcccgtgtctggggcattgggagtctggtgaggtgggggtgggtggtgagacacacacagctttaggttcctgggggggtaaggggattgcgggggatgctcaaggtcctgctggcatgccctctccaggggaggtggctggggagggttagggatttggctccctgggctgtgtgtgctgtgagacctcaggctgccttctgcactcagagtgcagcactctgggtgcagcaccaagagctggggcaggggtccaaggggtcctggagtccagggtgactgtgtgtgtgtgtgtgtgtttgtgtgcatgtgtgcgtgcatgtgtggggctggggtatgtcttcctctaggagcagcttctgagcccacccttcacttctgtgtgtgtctgtgcagcatgcggcgcagatggagcagaagcaaaatgacacggagaacaagaaggtgcatggggatgtcgtgaagtatggcagtgtgatccaggtgaggctggcctgcctctctcccgcctgcccctctccctgcctaagaggctgggctggtgctgggtgagggctgccagcaggcattgccctctgtgcatgtgtgtccccgggtgaatgagtggccctggggccacctgtgtggctgtgcgtctgactgtgtgtgtgtctgttgctgtgtggcctgagtagctgtgccatgggtgtgtttacagcatggtggccatcagcatggagtctggagccacgttgtctggattcaaatcttggctctgccactcctaatggtgtaacttgggcaagttacctaacgtcccctggcgccttggtttccccatctgtgaaatcaggcagtaatagtacttccctcttggatcgttgtaggttacttgagctaatctatgtaaagtatttagaacagcctctttcttgtgatcaccagggtgtccatgggggtgtgcctgttgtgtgcacgtttgtgtgtgattgtggttgtgaatgtgggtgtcagcctgtatgtttgtgacaggtgtctgacactatgtgtgcagccagaatgtgaccaagggtctaggggatccccccatatcccctccctaatgggccgactcctgtggcgcggtgaccttcccgcaccccacctgacccccagctcctgcacatgaagagcaacaagtacctgacagtgaacaagcggcttccggccttgctggagaagaacgccatgcgggtgactctggatgccacaggcaacgagggttcctggctcttcatccagcccttctggaagctgcggagcaacggggacaacgtgagggcagggccagggttggaggggcctggtggaactcccgaggggcttctgtagggtcttcggtgtggggactggataagggcatgcccatttcttagaagggcagactgagaccaaagggaggcctggaggcgtggtgacaagagggccctgcccttcccacctaacctgtcccacctgtctgctcaggtggtcgtgggggacaaggtgatcctgaatcctgtcaatgccgggcagcctctgcatgccagcaattacgagctcagcgacaacgccggctgcaaggaggtgagggggtggggggtcagccatgcagtgcagggacgtccacacacccctggtggtgtagacaccccgctccctgccatggtctctgcctccagccccatctgacctgccggacaagctgggcctcacggcttctgca

SEQ ID NO: 120334 - DNA, 1013 bp, Homo sapiens
tttcggggctgtcctccccgcagtgtcctctcagcccccaggctgtgtagctgctctcatggtttcctacagaaaattctcagtcatctccccacacagctcacctttgccctgacacctccttcttttcccagatttgcttaaagctcatgtcctccaggaagccttcctgggttagccctgtcccttccttagcaaggctttgccctgcagctgacataaacagattatgcatcctctgcctccctcatcagaccagggacccctgtgtacagcctctacaacctccttggcaacctcctctgcttccccctccacaggcaagaatgtgcggcggtccatccagggcgtggggcacatgatgtccaccatggtgctgagccgcaagcagtccgtcttcagtgcccccagcctgtctgctggggccagtgctgctgagccgctggacagaagcaagtttgaggagaatgaggacattgtggtgatggagaccaagctgaagatcctggaaatccttcaggtgcctgggccaggaccgtgtgggaggtgttgggtatagggggagggtaatggggcgggtacagggaggctgggcagggcgaaccccttcagatctcagtatttagtactggaagtctccatcgtgactggctgtcaggcccagcggttcccacagtgtggttcttgggccagcctcacctgggagcttgttagaagtgcacattctcggttgtgcgcagtgactcacgcctgtaatcccagtgctttgggaggccaaggtgggaggactgcttgagctcagagttcaagacctgcctgggtgagaccccgtctctattaaaaaaaatagtaataacgataaataaataaaaagaaaaacagaaatgcacattctccggccccaccctagacctactgagtcaggaacactggagaggggccctgtgggctgtgttgtgacaaaccctccaggtgattctgaggtgcactgaagtctagttcaattctcccat

SEQ ID NO: 120335 - DNA, 1018 bp, Homo sapiens
tgactcacccatgtctgcaagccctgcatcctcacgtctgccccacagtagcctctcctcctccctcacaggcctcagtttcccctcccatgagtatccagggtctgtttggctgagcaggataggaggacaagagtcagtttttggacctgggggcttcattccccttcctgtcagtgtctagcttgggaaagagggactgagtgggccgggcgcaggggtgctcgctgcctcatgctgagaggaggccctcatactccatcactggggcaggagctggggagagggcaccctgggcctggggagaggggtcttgttttcttgctgtgacatcctggagcatcccaaatgactgtgctgaggaccctgctgccccaagtgctagagcctatttgggggctccctgccccctgccccccataaagtaggaagggccttctgacctcagatcagtcctcaccccatcctcacctgacctttcctctcttctccagttcatcctcaatgtccgcctggattaccgcatatcctacctgctgtctgtcttcaagaaggagtttgtggaggtgtttcccatgcaggacagtggggctgatggcacagcccctgccttcgactctaccagtaagcccctgccctgccttcaggctgaggctgtgcgactctcccagggatacacagcagtggggtggagccagctcctcagccctgctcctttttctagtctgcaaaggccttttctttccactgtctcatttaattgcctcagtgagggggaagggcagggatccttcccttcgttttccaaatggggaaactgaggctcacagaacagcagggacttgctcgaggtgacagccagtcagaggctgagccagaccgggatctggtctcctgactcccagcctggatctctgccccctttgtactgccctgcaggggagtagggggctgtggctcctcccctacttggttccttcccagaaaggggcaggcagagcagctgctgtgcagccag

SEQ ID NO: 120336 - DNA, 1047 bp, Homo sapiens
cagggccccttacccaccacggacagcagggagtgtgccagtctcacccatgcgccctgcacccttgtgcccgcaggaagacaagcagcatgctggaggtggatgacgagggcggccgcatgttcctgcgcgtgctcatccacctcaccatgcacgactatgcgccgctggtctcgggtgccctgcagctgctcttcaagcacttcagccagcgccaggaggccatgcacaccttcaagcaggtgacgggactacctggccctggccctgagcatgaggcctgcaccaggcacggggggacagtaaacgatgattgaggagctcacagctcaaggggtaacttgggatgcccatttggggttttcagccttgctgagttcctaggtgaagactgagtctcctggcctggctcagtgcctgccatttcttatgatgtggacagcactttacagcttgcaaactattatatgcacctatgctaaatgctttgaatcatgcctagcatgcagacaaccctcactgacgtgactggcatttgctattgtgatgtcacgcagtcccgacagctccctgtgaaatatcaataccagtcggcgttggcctttaaaaaaataagtgcctgccatgtaccaggcactgagtactggacttgcattatcgcatggcattctcacagcagccctgacagtgaggttactactctccctcccattccagagcggggagaaatccaggcccagggagctttcctccattgcccacagacccagagcgaggatggtggcagtcagacgcaggcctgggtctttcagggttcagggctgccaatatgttttgccctgcctgtttggggtctcagtggataagtgacagaccacagccacatgtgacactagtcagtgagtaactgaagccaggttatgtggcagctcagggcaggcagtgcagggaggcctgtggccagcagggaaggcttcctggaggtggtgggcttatggcagagccagaaacattgagtgggaatcggctcggtggagagggacaggt

SEQ ID NO: 120337 - DNA, 1183 bp, Homo sapiens
tgtacagtgttagttttattaatttctattattatattactgcgaataatgcagtcgctggcacgagaggtgtgtgctcagtgaggagggtttaagtaactgctgcgggagcacaggggagggagggggtgagcaaggcgggattagcgaggcttcctggaggaagctgcctctgagatgacccctatgggacttctttccagtggggagaagcggggactttctgggtcatggggtcaatatctctgctggcagagggcctgagacatcagctggggaacccccaaatcccagccaggggagggttttcctgatttcaggtaagggctgtggtcagagtcccagtttctccctggtaagcaacggagaggagagcccagggcttgctggaccgagagagtgtgacacgtgccccctcccacccgcagctgaccaatgcaggtgacgatgtggtcgtgttctacaatgataaggcatcgctggcccacctgctggacatgatgaaggccgcccgcgacggcgtggaggaccacagccccctcatgtaccacatttccctggtggacctgctggccgcctgtgccgagggcaaaaacgtctacactgagatcaagtgcacctccctgctgccgctggaggacgtggtgtctgtggtgacgcatgaggactgcatcactgaggtggggatcgggagactgggcaagacggctggagatggggcgaaggggtgggtaaagccacgggacaggaagagtgggtgaagcaaagccagggaagtgggcaggaaccggaggccaggggacaggagcattgtggcagggagagcctggccaggcggccctgcttgcgcccctgacctcccgcccactgcccaggtgaaaatggcctatgtgaacttcgtgaaccactgctacgtggacacggaggtggagatgaaggagatctacaccagcaaccacatctggacgctctttgagaacttcaccctggacatggcccgggtctgtccctgtgaggggtgtgggtgaagccccccaggaggtgtgggagtggaggggccccatgtgaggagcccccagccatccctctctcctgcctcaggtctgcagcaagcgtgagaagcgcgtggctgaccccaccttggagaagtacgtgctgagcgttgtgctggacaccatcaacg

SEQ ID NO: 120338 - DNA, 2027 bp, Homo sapiens
ccctaagctcgcccatctcctgctcccaggtggttgtcagtaagttcttcttggcgtctgcctcatcctggcaattgagagaagctgttttctcctctgggtcagttccccagagaaggatgctcgccgacattctccagctagttttttatgggtatttgcagatgggctcaggcaggagcaggcctgtggattgttagggacagttggggaagaagagaggacaggtgagagagaggaaggggaagtcagggtagagccggggggaatcaaagaggcagaaactccttttacccaacaaggggaagaaagcctctcagtccctcaagcataggccggggtggggggggtctctgtctcccagacccttggtctagttcactctgtctcctggtgtggcagccctgagcctggcctctggctggctgaactgcccccgcaccagcactccagcactccctcccttcccacccagccaagggccgggccatcttgctgcccatggacctggatgcccacatcagctcgatgctcagcagtggagccagctgtgcagctgccgcccagcggaacgcctccagctacaaggcaaccacgcgggccttcccccgcgtcacccccaccgccaaccagtgggactacaagaacatcattgagaagctgcaggtgggtgtggggctgcctggcatctgcctcgggagctgcttggttgagtcagcagctcccctactttggaggggcaagttctcggggagtgtttcttcctgtcctgcccacacttccaggaaggggctggttggcttctctacactctggggctgctaagggccgacccagcagcaagggactggggaacctccttccagaggaagcctggagaacccagaggcctgctagtggggttggagctcatgagggggtcgggaccacccctcactcctgcagcgccctcctgtctatgcagcacatttctgtgcgctgtctcgttggcctgtagagggggtgtggtggattattttccccacgtggcaggagactgaggctcagagaggctaaggggtttgcccaaggtcacacagagctgggagagaagccaggcttggcagctcccagccagggctctgagcagacagacatcacgctgtgttcagggtgtctctgtgggtgtgggcccctcagacagaggcagggcaatctgtggggctgtttggcgtttgggtcggaggaatggcagtcacacccgggtcatttcttgggcctggcaatgactctgccctgcccaccccaggacatcatcacagccctggaggagcggctgaagcccctggtacaggctgagctgtccgtgctggtggatgtcctgcactggcctgagctgctcttcctggagggcagtgaggcctaccagcgctgcgagagtgggggcttcctgtccaagtgagcgagacactggggcatgggggcagcaggggtgcagcggcaggggacagagaagggcccggtggggactagacaggctcactgggtcagagggcctgggggtgttcctgcctgggatggggtggggaagtagctggagggaggcagtgtggggctgccctgagctgcctccttggccggctcaggctgatccagcacaccaaggacctcatggagtcggaggagaagctgtgcatcaaggtgctgcggaccctgcagcagatgctgctcaagaagaccaagtacggggaccgggtgagtgccctggtggggcaagtgctgggtgggccagtcaggagtacccaggggctcagggtcaagcccgtcaggccagtggtcagtggtgggctgtacccacaatggggcctcactcccatcctcccccagggcaaccagctgcgcaagatgctgctgcaaaactacctccagaaccggaagtccacctcgcggggggaccttcccgaccccataggcactggtcagtatcaccttcccctgcccccgggccctcccttccactctcctgtcacaccagctctccctcaacc

SEQ ID NO: 120339 - DNA, 1050 bp, Homo sapiens
tctgctgtctgggtagctgagtgtttgccacagcgggggtgaaggcaagcctatgggtgggctggctgtgcaggatgcttctcattaagccggggggagggaggatgggaaggtcatggcacctgaccttttgttggatgggagagctgttatggagaggaatgagggagaagttgtcaggggcatggtgtcctgagactgtggcctgcctccctctgcccctccacccaggacaatgcctccaagctgctcctggctctgatggagagccggcatgacagtgaaaatgctgagcgaatcctcatcagcctgcggccccaggagctggtgaggctgggcaggtgggcaggcgggcggaaccaggtggagtgtgttgggatggggatgagggcccggctggccctaccgccctaggaagagagcattggaacaggcactgcccctccaggtggacgtcatcaagaaggcctacctgcaggaggaagagcgtgagaactcggaggtgagcccacgtgaagtgggccataacatctatatcctggcgctgcaggtaccagttccacccgtggcaacggccatcacccccctggccaccataccccgccccagctgccatcatcccccagtcgccattgtcgccccccagccaccatgtcccccagccaccacaccctggtgactgtgctgccatttccctcagctctccaggcacaataaacagctgcagcacctgctgaagccggtgaagcgcattcaagaggaggaggccgagggtatctcttccatggtgggtgctggccccgagactggggtgggggtggggcctggaacccagggaggacacttgacccaagggcgtggcctggaacagagtgaggccctagaatatgagccaggctagaatttgggggtacagctcagggggctgattgggactggcagccgtgggtgaaacccagacagaaatggaagcaaggctcaggtgggtctagggtgggtctggaagcttcaagcaggacccgggctacacttgggcaggactgaggaggc

SEQ ID NO: 120340 - DNA, 1695 bp, Homo sapiens
ggcgtgaccatgtgctgtgtgtgctcagattgtgcggcaggaccgcagcatggagcagatcgtgttcccagtgcccggcatctgccagttcctgacggaggaaaccaagcaccggctcttcaccactactgagcaggacgagcagggcagcaaagtgagcgacttcttcgaccagtcctccttcctgcacaacgagatggagtggcagcgcaagctccgcagtgaggacccacgggcgggagggtggggcggtctggagctgttcactgatgccctgttataacggcctcctttgcctgcctgtgggtgccctgcgcccaaccccgcctcaccccaaggaagggctcttccatgtgtggcttcctcctgagcggggccccacatgcaaggggcagggggtgctcaccagggccctccagcagctcaccgttgccctcctcttcaggcatgccgctgatctactggttctcccgccgcatgaccctgtggggcagcatctccttcaacctggccgtgtttatcaacatcatcattgccttcttctacccttacatggagggcgcgtccacaggtgagaacacagggctggccggcaggttccccgggccctgccatgcttcctccctgggttggggcagagccttgaggccagctggcctctgagggcaccagatgcagagtgtgcagaagcaccccctgcgccatcctgtgggctctcgccccatcatggagacacaggtgcggtcaaaggggatggtcagggtctttgacctcatgggagatggcgcatgcaggcacgtgcacacgcatagatgtgtcagccagaaacaaaacctggtagccgcagccggacagggcctcccgcttaggcctgagaggcaggtgtaatggaggaggctaaaaccaggcaccaggaacttaaccgggaaggcggccaggagaaggtggcttttcggcacctgttggacctgctctggggccgtggtgggcttgagggagccctgctcaccctgcccctggcccccaggcgtgctggactcccctctcatctcattgctcttctggatcctcatctgcttctccatcgcggccctgttcaccaagcgctacagcatccgccccctcatcgtggcgctcatcctgcgctccatctactatctgggcatcgggcccacactcaacatcctgggtgccctcaatgtgagtgccagagggagcccccattcccaaacaagctcatgctcactgtgcattcagacggcaagctggcctgctgcttccaggagccactgctctgtcccatcccctcctctctgttgggctcccaagttccttatagaccggtggcagggactgttctgtaccttcttcctttccctcaacacctgagggcagctggcactcagagacagaaattcaagagtccctttggagcaacagggtcagggtggctgtgcacactgtgcgggctgtgcactgcccagaggcactgctacgcggcagacgtgaagattcatacataatgacaatctcctgacagatggaaataaagtgctttgagcgaggaatacctttccctgatagagccagtcagtggtcttctctgtccccatcctccgttgcctgtacctcactgtcttcctggaactgaggacccaaggggctgcctctgtattctgagtcccaggcgcctag

SEQ ID NO: 120341 - DNA, 1048 bp, Homo sapiens
ctggagtcccttgaactgtcattcatgttaaacccagtatttgcagaaactgcccgtgtgccaggcctaggggtacagagacccctccctgcccttagtgtgcaacccagtcgggggcagaagcgtgatgacccttcactgtggctggacagtggagggctggcgatccaggaccagggaaggtttcctggaggatgtgacactggggacagagccaggggataaggccaggcactggacctcctgatgatctcatccatatcccctccagccagccccctggggatgccacatggagctgctgcatttgtggacacctgcagtggggacaagatggactgtgtctcagggctctcggtgcctgaggtcctggaaggtgagggtggtgtgtgtgcaggagtctgtgtggggtaggaggagcaggcagcccgggcctcagcacactctccgcttgcagaggacagggagctggacagcacagagcgggcctgtgacactctgttgatgtgcatcgtcactgtcatgaaccatgggctacgcaacggtggtggcgtgggcgacattctccgcaagccctccaaagatgtgagcactcctgcccactcccaaacctgtggggcccaagccactgtccagatcagcaactgtggagagtcctgtccttggcctcgcgtcagatattcagggttgaaccccctcccccgaacttgtatccacttttccctgctttccacacctggccaattccatgatattactgcttagctgccccctcaccctcccattccataaggaaagactttggcaaccaaactttgccccagggctagggatggtgaccactggctttcctagcccacagcaggtgggcagagggcggagctgagtcagctttatcaggaggcctcatgatttggcttgggcagccacattcccgaatgtcaggccttcccctgttgcttgggagtgagaggccgcctccctggccagacagagggtttctggaatgtgtgaggccaggcgtcctgagggtgggcagaggtgttca

SEQ ID NO: 120342 - DNA, 1071 bp, Homo sapiens
agtcagtgtctggagcttctggtctcagtccagtgcttttcctacccctgaaatgaagtgctagtcccctcaccagccacctcgggctcaggcaggtgtcacctgtatggcctgtaggacctcgctcattcagccattcgggcttcccctgagttcgagaaattctcgcgtttactcctggagtcctcggttgctgctgcgggagggctgcagctgcggcagggcaggatctccactaagtggctgctgctttaaatagaagtgacccaaatagcccagagcgagctgttggaagcgctcatcccgagaacaaatgcctccaacccccggaagctgggtcccctccagcaggtgaccctgcagtggctcttgaaggctgatggtttcattcccgccctctgcaccctcaggtctggagagggacaagtttgataacaagacagtgtcatttgaggaacacatcaagctggagcacaacatgtggaactacttgtacttcattgtgctggtccgcgtgaagaacaagaccgactacacgggccctgagagctacgtggcccagatgatcaaggtgtgagcaggggctgtgccaggcctgtgggcccaaaccagccattctagagtcatcactgtgcaccagaggcctcatggttttagcttctgagtaccctgggccctggagaggagtggccctatctgactgttggccctaggaggccaggcagaggggctcggacagctgcagacacttgttgaaaggtcagcagggcgaggagcagcagctggaagcagctctgggctgcacggaagccgctgctgcagaggggcctcctcacacttctgggtgtcaggaaaaatcccacagcaaacccatgcgccccgaagaacacgtgtggtatccctgggcctgtcgtgcagtgatgctgaggaggggtggagttggggagaccctgcccgtggccagtgatctgtgggccgctctcagggagtgttttctagctcggtgggaaggcaggctgcttcctaaaaagtctgaattagatgatcctgggctgaaggggagcctggaaa

SEQ ID NO: 120343 - DNA, 1047 bp, Homo sapiens
gtcctgggaaacgtggctttgcctcccagacacgtgtcagatgccagctctcctcagcggagcctcctgatccctcaatttgccatctgtctgactcgcgtcttcccggggcgtggggcgtgcttgtcaggcaggcgggcgggaggaaggaaggaaggagatccagggtctgtctgggtgcagaggccttcctccacctctcagggggtgttatgagagtaaacagatggtgctgataccagcaaaggactcaaactcagctgccgacgctgcctaacggaagtcagcctgtctcggtggcagagggttgacaagagggttgactgccagctcactctggccccggggaggaccaggtcaattcagattttcccatgacacatccctgacgagtagttttgttaagggtgtggcagaagcctccccccacattactgtttttctaaatgaggcctttctaggccgggcccacgcctgcttaacccactggtgatgtttttcagaacaagaacctggactggttcccccggatgcgggccatgtcccttgtcagcaatgagggcgagggggagcagaatgagattcggattctccaggacaagctcaactccaccatgaagctggtgtcccacctcactgcccagctcaacgagctcaaggagcaggtgtgcaccccgcctgatcccaggcccaccctgggttctatccctgggcagtccctgcctgccttcatccttcctgacccaccctcttccccactggcctctggccctgggcctggatgagaaggcaggtgccaaacccactctcccctgcatggcaagtcagactggggttgacaacccctgccttgggccgctaaagacaaggccaagtggaaactttagtacagggtggtggggccctctgtctctcatccccttcctctgacagctgccaggtaggtcctttgaggggatccccatcactggagatgggggagtttaaggccctcttgcctagacatcctcttctgcatctggcagtgcctgcatgaagatgaggcag

SEQ ID NO: 120344 - DNA, 1050 bp, Homo sapiens
ccttctgcttgctgaccttctgcttgctgaccttctgctgtgcttccttcagaacctagcattgtctcacttccatcatgcactgaccacttgagcatgcggggactcccccactgagtccctgtagcccactctgcccagcaccccctttgttaggcacgcctttccaaccttacatttctattgtggcatctcccactgcagctggtgtcgtggctcacaagtcacagatgctcaacaaatgcttgtttgctgattaattgatctgatttttctgtaggttggggagttgatgaggcagagctatgcctccaaaaagtagtttctaatagcagagctgtagtccaggtttgcttcccgcagagtggagaagccagtgctagctgcaggcctgcttcatgtgaacgctttattaagtatggtctttcctcaaggtacagacactgtgggaggcaggactcctttgctcacctcctttgggattctttgcttttcaggttgcagagcctgaggcctgtgatcagatgtacgagagcttagcgcgactccattcaaactactacaaacacaaggtgagtgggccacagtcttttatatacccagctttctgacgggacaactaataagaatgagtgaaaatctgattaggtaatgttttgtaaagacttggctttgctgcgttcaaatgaaaccagtaatttcaaccaagccaacagaggtgcctggtagaggcttttaggccacctaaataaaagctatttaaaattgtgaatatagggaagaaacaaaaccaattatgaatagaagccatgtatttgatatgccagtgtgtgctcctgggaatgtctgacagccattggatttatacctattttcccatccactctgacggaactgacacctccccacattctggtgataaagatgggatgattgggaaagtgccctccttttacggagctgggcccaacatgattactgtcaaattccatttagagtggtttttcccatacttgaaaaatatgctcattaactccacaaacatttgtg

SEQ ID NO: 120345 - DNA, 1041 bp, Homo sapiens
ttgggcccagctccgtaaaaggagggcactttcccaatcatcccatctttatcaccagaatgtggggaggtgtcagttccgtcagagtggatgggaaaataggtataaatccaatggctgtcagacattcccaggagcacacactggcatatcaaatacatggcttctattcataattggttttgtttcttccctatattcacaattttaaatagcttttatttaggtggcctaaaagcctctaccaggcacctctgttggcttggttgaaattactggtttcatttgaacgcagcaaagccaagtctttacaaaacattacctaatcagattttcactcattcttattagttgtcccgtcagaaagctgggtatataaaagactgtggcccactcaccttgtgtttgtagtagtttgaatggagtcgcgctaagctctcgtacatctgatcacaggcctcaggctctgcaacctgaaaagcaaagaatcccaaaggaggtgagcaaaggagtcctgcctcccacagtgtctgtaccttgaggaaagaccatacttaataaagcgttcacatgaagcaggcctgcagctagcactggcttctccactctgcgggaagcaaacctggactacagctctgctattagaaactactttttggaggcatagctctgcctcatcaactccccaacctacagaaaaatcagatcaattaatcagcaaacaagcatttgttgagcatctgtgacttgtgagccacgacaccagctgcagtgggagatgccacaatagaaatgtaaggttggaaaggcgtgcctaacaaagggggtgctgggcagagtgggctacagggactcagtgggggagtccccgcatgctcaagtggtcagtgcatgatggaagtgagacaatgctaggttctgaaggaagcacagcagaaggtcagcaagcagaaggtcagcaagcagaagggagaagggcaggccttcctgggggaggagatgccgtcagcaaggaagaggaggcaggaatcctgtgggatg

SEQ ID NO: 120346 - DNA, 1004 bp, Homo sapiens
aggagaatcacttgaacccaggaggggagtttgcagtgagccgagatcacgccattgcactccagcgttagctcttggctgtgcgtgccctgctgaagaaatgttccagatgtgttcgcccagatgtgtgcagaattccattctaatgggactttccctggacaagctgaccagcagcagggagaccacagcctcatattttccattcattctgtccactcagataatgactttattattcagcaaacgctggccacctcctcaggccataatccttcctcttctgatgtatctgggtgtacattctcatgatgagtagcctgaacgcaggaatgggtcaggtagaactaaatgatggattgtcttttttgtttgctgtaaagtagggacctcatttgacatgcacagagaggcagcagtggagctgcctattaaaccactttactactgatttatttatgctctgccttctccaaggaaggatttaagttaggaaaaaatccatcatttgaattctgggggaaaaaatataaaagagaaagttttgttctggggagcttttcaaaattcttggcagaaaaatataaagaactatacataaataataggaaggacagagtaaagggaaagttagaagaggtgcaagagaaaagaccacacctcctctgtatgctgcctgtctccctgagaaggtccagcaggggcactgctgtctctggcaccagagaattgacttacatcaccctttctatggcaaggcctcagtgttctgggccatctcctttctagcaggacctaactgtggtcctggcttggttctcctcagtttacacattttatcttaaatgttgccttcttcatgtttctttccttcttgtagagtttcagcagctccccacttatcatagattgagaactcagatgattttttttttttttgcctttgctaaaagaatctgttggtctgaggccgggcatggtggctcatgcctgtaaccccaaca

SEQ ID NO: 120347 - DNA, 1069 bp, Homo sapiens
ggtctcgtgcagcggcccgtgctccgcagatctggctctcacttacacattgccccgggcagggttggtttctaattcatgtgtatcttgtctctgtagtgtgcctgccagcttctccacagctggcctgggtcgtcgtctttgtggcccctcaccgtcccctagtggagcactctttctatagtaggtgctcaagaaatacattttcaactcaattgaagggaataggctcccataacagaatgaactcatttcagaagttcattaccaagtcttgaaaacctttttttatagatcctcctggaccgaatccagctctaccttaattagcaaagcaatttgcaacaccctttcccaaaagtgcttatgcgtccctttgtgtgactagaataggggccgctgtaccaattgctgtcaccacccaaaattcaatttgcaaaatcgaaatcagtgcctgcagcactgatgtagatttgtatgtataaaagtttaatatggtaaagagaaatttactgacgactgaacaggggaaatgcaaaaggagcaaaaatagagctataaaggacactcgtcagatgaacatctattttattcacatttggggagcagtgctgaatttttcataatgtccccactgctgccttttcaaacccagcactgctattagtcctaaaacgtctgtgatctcattaggtgtgaatgcaaaatcaggtaatttaaagcatgtattaagaatatttctaaaaatgcaccgtccatttcatcagaaaaactgcatttcagagctcaggaatgttagtgctggagtctgtgaataaagtgtaagctataggaacgtggtgaggcttctggaattcgacagatgtctccactgacatccttttaagtagtaagcatgacttttttaattgctgagcttgagttatctgtggctaggaacccagcattgaccaaggcttcatcactcctcaagcagtaagaacttggctagaaatgggcatgtctcaaactcctgtcacctccactgagctgcttttacagcctcagttagacaccttctgacctcaga

SEQ ID NO: 120348 - DNA, 1043 bp, Homo sapiens
cagctccagcttcttggcctcccccgtctgatgcttagctcatcccatcccctggagtgctgtggagcttagatgaaacagcccagtgctcactcttcaatgagcccacccagagcagcatcaagatgcagttggcggggtactggaactggcttggcaagggctgcgcaggcaacaggtcccagcaagagtcagctagcctagcacagccctgcacacctggagacctgggggtgctccagacacctcggccctttagctccctttaattgaatgtgtttggatcagtgaaggttgaggaatcatttctctatggcccaagacgtttttctcctctgcagttgtcatgttagtacctgccagcttttcctctcttacataaattccatgccagagcctggaaatgtgtgccctttgtaggaggggcatccacaggctggctcacctcggcagtgccaggcagagccccgtccctctcattgcaggaggcgcatgaagcgtgtctgggaccgagctgtggagttcctggcctccaacgaatcccggatccagacggagtcccaccgcgttgcaggagaggacatgctggtgtggagatggactaagccctcttccttctctgactcagagcgataagccccgggcggggacttgttcccggtcagcctgtcccaggacagcccactccagaggcacaggagggtcaccaggcctgcggtgctgaattcacacttgccttgactttcagtctcgtcctgacacgattccaaaggtctgccatactcttcagaggagttcggctcgcaggaaaatgtgggcttcctttaaagggagggggagaagccagggtgatagcccagactctgccctgttgtgctggcagaaacggggagaagggttgagttttcatgaatagaaaacaagagcagcagctgtcaggcccagctgacaagcgtggggctggtgggctggggcatggccacgccagggagtctgtcacctgggaggtggggcagggatggtgtttcgggtggcgggatggg

SEQ ID NO: 120349 - DNA, 1689 bp, Homo sapiens
tcatggatgccccatgatctttacacttaaacagcttatgtgcctccttgtcaccgaggaaaagtgcaacctcccagattctgtctttcagttcttgccatgcaattgcaaagctagtgattcagtaaacatttccatttctctatgctgggaggtgggaatccaatttacagtttaatctcctgcatgctgagagaggctgtcaaagacctgacagggggacgttgctttagcggtaggggttcaagcctgctgccgtctttaaagctttattcattctaagtagccaatgtgggaaatttctggaaagaatgcagccaggataccaagcctattctataagcaagtagaggccttgcgtccccactttccttcgcttcctcctgtttgaagtggggcttgcactgcctctccttggagctttccaacatgttcagagccctgtgtcctgtttcaggttgaaaggagaagaccagtctgaattggtgacgactgtggacaaggtggtctgcctggaatctgcccacccccgcatgggtgttggctgccgcctgagccgggccttgctcactgctgtcaccaacgtgctcatcttcttctggtgtaagtcctcggccgccttccctccccttctgtgcagtcaagcatactcctaggcatgaatgatgagctatagaaattccaggcccggagggttcatttctgtctagtgaacctgaggtctgtctcataaaacagaggagatgaacaagtcagcctctgccctgggttgtatttacctttggagattggtggcaggaatccgtgaggataactagaaaatgtccttgattcagggcaggggactgtcagatttcctgagcgggagcctggcctgagcaggagctgggccccaccccttctgggctctgcagggatcccagtgtggaccagcttcgagcaggaggcacagcaggggcttggcctacttttactccctgaaaaatataaacatctcctggagagctacagatacctgatgaaagcaagaaggactcagggtgctgcactgaaaggagggcaccagtcttatcccctgacatcgggggccgcctttgagcagagacctcagggcgtctctgaaggcgaaaggccaagtcacagaaaccacggctttccagagatagttggagctacaaatcacagaccgcctcagtgtgcacacagctccctcccctgtgccatcaggcacagaaatcattatcggcagcagcatctcggaatacaaagggccccggcatgtatatatgtatgaaacactgtgttctggttcacaagggaggagatgaaagccccagaatgaggttgggaggagccgagatctggacggctggggatgccgctgtggtgacagccggtgggaggaagatgatcacttaataatctgtcgtccctctgcatttctgtatcttttgtttctcgcatgctggccctgagcctgacacatagtaggtacccaaacccatgtggtggatcccccacagcatccatcacagcatcttgtccatggtgagacccactgccaaatgaagtgtgagggattaacagtgttttgttccctcacaggcttggcttttttgtgggggctcctaattctcctaaaatatcggtggcgaaagttagaagaggaggaacaagccatgtatgaga

SEQ ID NO: 120350 - DNA, 1997 bp, Homo sapiens
gccccactgcccagcacacagacatcctcttcctccaaggggcccctcaagacaatagacctggcattccaggtcgcctgcctgtgtcatgagtcagaatccccgtggtgcccatggcctccctgcctttcttttttctcaggctgtgtttatttatagtgccattccggtaccttccgaagctatctgtctgattcttttagggatcaattgcaaagagaccttgctattgggcagctttttagtcatttaatgcaaaatgccacactgctttgcaggtcaggttttaatgatctggaatcgatccaagctaagtggcttttgatcttgctgcagagtgaagatgccccacagaagccaggagccgctgggcaacatgctccttattagagctgatggcttgattcttgctgcattttttagtctgtttcagagtgatttttcctttgtgtttgagcatgtgtggttttttttctcctaggtaattttgagtgtggaaatccagagaatctaaaaagcaaatgcattcctgttatggaagcccaagaatatatagccgtaagtaggcttcagtgcttatacattcctgggagggcctggtgctttcctattggtctttcaagccctgttggggtttttgttttttgtttgctttgtggcttttgtactaggctaccttaagttaaggtttggtttatggctttttgtgctagactaccttcagttaaggcagccatggtagtgactgccccagagccaggccgccatgtgcagtggggcggctcactcctgactgctgcactgtaggtgtgcctgttacctgcttctcccttggttcactttgctcgtcttgccttcggctttcaggagaaacatgctgtcccttctcccccgtatgattaccattcagactgcccaggggccgtctgatttcctgtgtggcctcaggatggtagattatagaactatggagctggtattccaggtcgcctgcctgtccagtaacttaggggtcatctggttccatttgcatttcacagatgaagaaactgaggcctggagagggtcagggacttgcctgaggccagaccacttgcaccggccactgggctcacccacccccagccacaacgctgttattcgctttaccctaagatgagctgccagctctctggcctgatgcttccatcctcgagagaatcatattcttttggccgcctcagacccgcactgttttcctgcttgtgcttccgcatcacctcctctggttatagcctcttccttggctttcatcaacccccgatttccttcctgccactttgctgtgcttttagcagaacagggttttggggctgtggaggacacgggagagggcttccttaatccagcagcagaataatgttccagctgctccgcccagacgccgaactaaccttctcccgcgccctcccacagaatgtgaccagcagctcctccgccaagtttgaagccgcactgacctggatactgagcagtaacaaggacgtgggcatctggtgagtgtgggcagggtggcgacgcagcatgggtgcctgcaaccactgtcctcgctcgtcagctaacacccgtgctccaacagagctgtctcaggtctgaagctggaggctgggtctcccagcagaatcatgtgggttaggatggaagtggggcaacaaaagcaagaagcatttggaatgcagtgtaaggagcagcttcaagatgagacacaaaatccaggtgttaggatgttagcctggtgttccagctaaatcctgtctcaggtaactcagtctgtgcctttctcattcatcaacaacaccacatggtttgttggggaaggcatttttctgcacttcccctcctcgggagctagtttttatttgtagatgaaattattctttctgtatgttggttttacttactatggaaatcgcataaggaaatactggattttattctgaccaggcagtttctgcctc

SEQ ID NO: 120351 - DNA, 1734 bp, Homo sapiens
tggtaatgctttactccctccaaatgttgtgagtagtctctttttgtattcctttctcaacccacacttaatttcctctgtgtttcttttcttggtctcagtgaagttattgccagtggactgtgagagaaaaacagatgaggtgagtttgagtttctctggtttttattattcttcctgaggatattagcctccatcaggaggtaaacttccccagaaaaagaataggatcattttcagggagtgcttcctgtaatgtaccagagtcacattgtgttctgtgatgttcttgtcaggctcaattgtggcagtgaaggaatacttgaaatagaattgacctcccaaaatccaaccctgggcttgttatggacactttcccatcaaatgtagcatcggggactttgatctgcctgagtcaatctagggggatgcagtaggttgttgttgaaggaccctcaagctccctggcactgggaggaagggccggcgtttctaagcatcaggaggccaagttctcaattccacattctctgtctccagtggtgcagctgtggctctgaaaatgctgttctgatttgaaacatagggagtttgtttggaacacatcttaagtggaattagccctcttagtctacatttagatttgttttatgaagctctaatatggcgagcagccccatccatttatgaatcatgaaagcagcattatcaaggagctgggatgctgcttctggtgacagtctggagaagatatggggcagtaaattttcaggtcttaaattgtaccaggaggagtcttgtgctgccagagggcatgacttagtagtctaattaagtgtgcaatgcctggcctcccaagtccttagttaacatctctagtagcccaggggctgggaaagaaaatgacgcatggtcctctggccagccctgcattgactgtcttactcatgtaaatgagggggcatcctggtgcagataacggcttttatttctctttggcttcgggtgtgtcatagttgggggtgttttattacatccatttattggattcatccaccaaatatctttgcttcccaattgttttgtaaaaacagattcatagtaagtttaatctgccttctatcataaaaactgtagttgatgatgagaggaagtggcccagaaacacaggcagccagaggggaaactggaatttgaagacttaaaacaaaaacaggaaaaaataactttctgtaagacttctcagtgctgttagttttgtcttttaattagaaaaaagttccatggtttctatttcttggtccttcacatctctaaatgaatcagacccacaagtgaatggcacatttgttccctggccttctctgatctggacacactcaggctccacttgagtgagcccagacaggtaccctccaggtcctagctacagatgcgctccgtgggcagacggcattcagcacctgccagcgagggcttcagacgcagatatccctatttgtaaccattcagaccttcatcagagcatcagaaagcaggggctgggccatctcaatgcaggctttgtggagctaagatttcatggggcacccttggcctttctggagggtggacacaggaacaagcaggtggggacgtgtttcttggctttggtgaggctcttgctgaaagtcttattctttgcatggctccaggcttaccgagatcacagacgggcatttgaatttcagattc

SEQ ID NO: 120352 - DNA, 1044 bp, Homo sapiens
cttggctggagccccttttcatgtagatcatggggtcaaggtctgccttgctggggtggggtgagcattaaatagacaatggatgccaagaggctggtgtgtctggtaggtgctcaatccatgctgaggcgtttccccatcttgactcggttacctcaactgtaatattaatgtaaggaagggggtaggccatgctggggactttggaggcccctcccaactctcttagtaccagatacagggaggagggagttttctgggtgatgacaaagggcttgggggtgggaccagaccaagcactgtgcacgtggggtctcctggaggctggcttcgtggaccctgaaatgtgttgaagctggattcaggtccaggcactctccctccctgctgtgctgtgtgcttcttgggcaaagcacaacctctctgtgtttcactttcatctactgatgactgggcatatttgtctcttccaatccttcacttcctggttgacctgagaattgaatgagacatggatgtgaaaatctttcttcaacttaaatgtcatctccaccaaggacgggaccagctgtctgatttaggtttgagttgccaacacctgaaggtgaaggagagccaggcctggggttgtgtgaacccaggggttgcaggatctaacccatgtgtggagggtttggagaagccacctgcatccatacatacctacacatgcgtgacgctgttcgtgtcattgcacccctgctggcctcgctgttagtagagtgactgcctagccctgcacctgagacacaatggtgcttactaagagcttgcaaaataaatggatttgtgtgtgagaagctctggcttaaaaagggagaaaatgatcaaaggggtagagaaaatcaataaggatggaaatatctcagcaaggaaggcacatctccaggtagaaatatggtctgctgtttgttcagctgttagcagttgctgagagctttccatgggggatatggagatggacaaggcactgtccctgcccttcaggggctcacagctacatcg

SEQ ID NO: 120353 - DNA, 1109 bp, Homo sapiens
cttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcacccgggctccacatccactgagggtcctgccatgggaccacaggctcagcctgcagctggagggcttagacctagagggaagcgggaactgggctctggagacccagggcttgggggctgtggagactgctccctaggctgggatctagtgtggtgtggtgaggccttgggcatggaggggccagattcccaggtaaggggcagggacattgcaggaaattccaggaatcagcacctagtagtcccctaattagggggtatgctctgtcccctgccctgcagccctgggagggtaacatttctgccttgcctgtcctctgtctcacacccctcacacctgggactgcccttccacccctgcccccataacctgtg

SEQ ID NO: 120354 - DNA, 1103 bp, Homo sapiens
taagagtcaggactcttgagttctctttgctctgcactgttgtttcctgtgactctaggttgtcactactgctttctgggctcagtttcttcatatgagtcttgagagtttcgggttcagtcaggattccctgtaggtcaattatgtctgagttatgccggagaccttttttaactccagctgttagattcagtaagtccctgtggggtccgggcagctggacttttagccaactagctgggtgatttgagtgtggggctacaaggtgccaccacccagtaggatggtccggggcaccgggtggcatgttctgaggcctgctttacggtgctgtcattgccagatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcc

SEQ ID NO: 120355 - DNA, 1039 bp, Homo sapiens
acacgacccaagtcaaatgcagcctgggatggagcaggggtggggtctagaagctggaagtgcccatcctgtcgcccttggctatgtgacctgggctttcccaccagcctcagttttcttgtctttaaaatggcagcgggggcagatgacccccgtggtcctggtgtccctagtgttgtggttctatggtttctactgtccactcagcaatatctgagtacctaccctgaggaaggctgaaaatgggatgtggttctggctggcagggttaatgagcgaccaggccagctatcccccatccccacatccttgtgtgggtgtggccactggtgtggccaggattagagggtgtgaggggattagagggtactgcctcagggagaggcagtgagatcccctgcaccctgggtctgccttcagggtgtccaaggcagggggctggacacagtgacctctggagtccccggggaatcactgcctcatgtggacccagcttaaccctggcctatgggggcaggacacaggtgcaggtgtgcaccctgctgccctctggggaattgcctctgtgcagtgtggcatgtgccctctagctgagaggcacgggctaggagtagaatgataggaggagtaatttcctcgtcctgtccttgaggaagaaggccatgctgtatgcaagggctgtggtcttaggaggggaatccaggcttccctatctctgcccatcctcccccttcctcctcccagccatcctcctgccatgtcctcacttcagatccctggtcccctccccacattcctgcccacctgcatccctgtgtggcagagtgtggtgctcagggttggagttggagtacctgggttcacatcagcttttcatagtcgtggaatgttactgagcttttctgtgctcagggcttcagtttctttttgagatggagtctcactctgtcgctcaggctggagtgcaatggtgcaatctcagctcactgcaagctccgcctcccgggttcatgtgatccttgtgcctcagcctcctgag

SEQ ID NO: 120356 - DNA, 1024 bp, Homo sapiens
tcaccatccctgtgtgcaccaatggggctcatgcccctgagagcagccctcagcctaggactggcggagctggagcatttatccctgtggatgggacaatgctgaggtgtagtttgcagggtctcctggaggtccccagcaggacggaaccccacaggctggcattagttgactttcctcccccacctcacctccctgtcccctcctcatgcttccgggcatcacccaccaataaaacccttgctctcaactcctcctcagcatctgcttggggacttctcagcctaagccagtgggtgaatctgaatgcccatgtgtttgtattagtgtcgtgttaaatgtgtagctgtagctatattagaagcatttatatgtacatctgtgttagagcatgcatgtgtgtgtagacatgtgtaaatgcatgaaggtttgtgtatttgctactctatgcatgcagatgtgaatacctgtgagtgtctgtgtggtggattttgtctaccctggcgtgagggagctgcttcagcaatgtgtgtgcacgcacgtgtgtaccagtgctagaactggaggattgtggctgggctggtgagttgtggagaagtgaggggggagacgagaaggactctgattatttcaaccttgaaaactcatttcaattacaatttacaacctgcagacaaaggctgcagtcgccgtagtaaccacgcttcggggttttgacagagaaaatcctccctggatggttccccagctgactgtcacccatggcagagccaaatgcatctctgcctcactgtgccccgggacacaattaggacatcttcaaactgttgctactgtcactgccatgtgtctggaatttgtctcctacaacagctctcagaaatgcatgtcttgcttcctcccagaactgcggtgcccctgcctggtcctggggttcctgcccacccatgagaggggattttcctacccctttctcttcactgccaccttcctgttctagacctgcagacagggagtccttaat

SEQ ID NO: 120357 - DNA, 1048 bp, Homo sapiens
tccagcccaaccaagggctcctttctgggcaagtcttatggatgctgagtggggcctcatctgtgaagtgcagtctcttccccttggttttgttaccagtttcttttttagctatatacatgtttatttctgggcactgctgcaaattctttttgggacaaggcaggtctgaatgcaacgatgaagctgggacgagaggtttgaagcagttgtctccaaaaatctcttgtgtctctggctaaactgttgttgcagggatgggaaggccaggcaggagtcggggaagggaggctgccttgaggagcagtgatgggagagacctccaggggaggtggtcctatctcagggtggtgggagggtgtcctggctgcatgcctgccttctgagagtaaggaggggcagccttcctgaaagagcagcaggtgacgtgaggcgggtgggctggccctggcagagagcgctttccccggcctgctggacttgccttgtgtccatggatgagccactgttcctcactggctcttggtttctccacctgtagtatggggacaactgtattccgactttgctggttattgtaagaattacagagataggaattagccaacagaaaggcctagtgagagctggagggagtgaggggctgcctctgaggcctcagacctgggggtgcgcctgggcctctctcagcctcccgttgtgaccgtcctttcctctctccctcacttacatgctgccccattatatctgtgccccattttgcggtagacagaatgatcatatggatattctatgcaaattctgctttttaatgagccagaaggaaagctaacgactcttgcagacggcttggggccccagggaggccttgggatatggggaggagaggaagcaggacaaagtgacaagtaagaggagaggagggagggagggcggagagtgaacagagggccacgcagtaggggctgcggaggggtgcgggacaggggacagtggaggccctgtgaccatctccctgagcctccatgcccaccccatttcacaggta

SEQ ID NO: 120358 - DNA, 1087 bp, Homo sapiens
gtgcagccttgggtgctgggtggtgaggagcaggaggtgggaggcccttcctaattggagcggttatcatgggaaagacaggtgctcaggtgagctccccatgggggcaggtgaggaggtggatgtggcaggtggagtgtaggaggcagccaggtgtcccaggtgatactcagggccctggagagacgtgccggatgaactgcaggcatgggagccagggactatggcttcacttcatgcttgctcaggatgaaagccccctaaaccccggaaattcaactcagggatttaaatccagtgtggcagctgaggtagtgggtgggcagggagccaggctggcagggagggatgacctcacaagtatacttcaccatggacaggtggggtttgtggcaggggggcctgggagaaggaggcagatacccctgaggctctcaggttggcatggccttggaagcccttttgggctggcccagcctgtctcgcccacctcatctttgttccctccctccggccctgccattttcagttccatttcccccgaggccagtctctaaatccccccagcttcccatctgccaggcctctgcttctgatggtccacctgccccgaagaatgctctgtctgccttttcattcctttacatttttctttaaaatggaggtacaacttatacactgtaagatacacaaatttcaggtgtatgacttgttgaacttttataaatgcatttgccggtatccgatagagaacattctcagtgccctggaaagctcccttgagcccctcctagttaatatcctttcctccccaaggataatcaatagcctgatttctaactgtgtagactggtgttgcctggttttgagcctcacgtaacagaatcgtgcagcaaggtttttatgtccagcttcttttgctcacattgtctgtgagaaccccctggggttgggtctgttggtggtttgctcacttctattgctctgtactctttcattgtatcattgtttgggtaattcatcatttatttaccctttctgctgccactggacatttgggctgaatccagtgtttggctattatgaa

SEQ ID NO: 120359 - DNA, 1095 bp, Homo sapiens
gtgccacccctagcctggcggtgtgagttccctcccctcgtcccatgttgggctgcatgtgccccctgggctcttggctgcttctggagccggggctatgggtgtggccctgggggaacactgtcttagatcccacaagatgttctgtcgaggacgtggctttgtgtctttatgtgttttcactacacagccaggaggaactctagagagagcccacccaccctactgcacccatcttgaccaggccaaggaatctggaggcatttttgaccaccgtctttctgttcgtcagctcaccctgcaggctccactttcagaacttgtcctgggcatgacaactcctcacggcctccatccccatagtctcttacccagcccattacagaagcctggtctttcctctccctgcctccaaatggcctctccacagccaaaccttcactcagcagccggagagatctttctaaaacccagatggaatccactcaaccctctgcttaaaccttttattggcttcccgttgctcttagattaaaatgtgaactcctttcctgtctgagaggccctgtgctacctggtgcccctgatgtccctttgtctctctgggcactgcccacaccagtcatactgttttctttatgctccttgaagacaccatgctattttccaactgcagggcctttgcacctgcttgccttgctgtctggagtcttctcttcccactctttgaagctggatctttctcattcagccttgagcttaaatggcctctcttcggagaagctccctggcccctggctattctgtctctttccctgttcttttccttgatggcgctcatcacagttgcagtcatgtacacatttgttttcctttttgctattgagttcccctctagcccaggggttagcaaacgatagactaggagccaaatctggcctggttttgtacagttcatgagctaaaaaaggcctttatgttttaaagggttgaaaaacaaaatacaaagaaaaataatgtcatgatactggaaaatcatatgaaactcaaatttctgtgtccataaataaaggtttatgggaacacagtcatgcc

SEQ ID NO: 120360 - DNA, 1057 bp, Homo sapiens
gttgtgggcccagcccaggttgtggagaaagtcaggcctgggtttgaatccctgatccactagttacctcacctccacttaccatgtcagttatttacaccatactgtgaatgagcccataagacctttctgtggctggcgcagtggctcacacctgtaatcccagcacattgggaggccaacgcgggtggatcacctgaggtcaggagttcgagaccagcctggacaacatggtgaaaccccgtctctactaaaaatacaaaaattagccaggtgtggtggcatgtgcctgtaatcccagccactcggcaggctgaggcaggagaatcacttgagcccgggaggcagaggttgcagtgagccgagatcgcaccactgcactccagcctgggtgacagagtgagactccatctcaaaaaaaaaaaataccttttcctgaaaagtcattgttcgggggaggaagagcagactggagacacccccagagggaagcagtttccaaattctgtacctgtaagagctcagggggatccagaaataatttctttgagtcttttattcattttgcagtggaagaagctaaggcttggagaagggggcgctgcacagcatgggggtaagcatttggactctggagccaggcagcctgaggtctgaccaccctggcaaactgcttaacccttctctgcctcagtttcctcatttgtaaaatagagatgataatggtgccagcctcataggacagcacggggattaaaaattaaggtccagctaggtgtggtggctcacgcctgtaatcccagcactttgggaggctgaggtgggcagatcacttgaggtcaggagttcgagaccagcctggccaacatggtaaaaccccgtctctactaaaaatacaataattagctgggcgtggtggcagttacctgtaatcccagctacttgggaggctgaggcagatgaatcgcttgaacccgggaggcagaggttgtagtcagcgagatcctaccattgcatcccagcctgggcgacaagagcgaaactcagtctcaaaaaa

SEQ ID NO: 120361 - DNA, 1012 bp, Homo sapiens
cacgaaggagcttctggcggggggtggtgacgggtggcggtatccttcctccctggtacaggggtcccagggagagtcacctctaggggcttccagggcgtgtgggcccggccccccccccagggcgtgtgggggtggacgggggtccacgcgggcccagggggtgaagagaaacgcgctcgttagagaattccgcggcctacacgccgccccctaactaaaatagagagatggtagatttcccctgggcggacaggtgtcagcatgtgcctttcagtgtcaacccgcgtgtggctgattggtgagatacaagtcttgtgaaattcaaacgtgaaacttgtgaaatccaaagtgttttattaatggccaccagcgagccatgatcaaggtggagccttccagcgaaaccaacgattggctcgttggcaggtacacccaagggaggcttcataccttgaggtgacttagatggtgttctggagatacgcaggcccacttggggacctgggcccttccgttgggactgtaaataaaaataaaaggtgggccagaggtcgcctggaagcgctttgagggcaggggccgagcacgcaggccatctccgccacgcctggcccgcccggcgcccggcttaacaaagacttgttgcaccgagcgagaaggaagccaaaggggaagatggcggggagggcggtgggggaggaaagggcgcaggcggagcggcgcgccctgcaggccggcccggggccttctcgggcgcacctcccgcgcccggtccccgaggcggccttccacacctcctgtgatgcagggaattgaaatgcgctccagtgacacacggctgtgactcatgtttttctctgctccccttcttcctccccggtcagccgaggccctggcccagccccctcctcagggggcgagccggcggtggaggggacgcaggaaagccctgggcccggcgcggaggcggggtggggagcggcgggctgggccttgcagttgcaggaat

SEQ ID NO: 120362 - DNA, 3331 bp, Homo sapiens
taggccgcggaattctctaacgagcgcgtttctcttcaccccctgggcccgcgtggacccccgtccacccccacacgccctggggggggggccgggcccacacgccctggaagcccctagaggtgactctccctgggacccctgtaccagggaggaaggataccgccacccgtcaccaccccccgccagaagctccttcgtgactcctctgcgcgtgccttcccacacctcctccgtccgggactgcgaggagtgggcggtcgactcgagttcgcagcccaggcctcccacacgcccctccctgccgtcagcacccacccgcgcggcagcggcggcggcggctggcgggcggccgcccttttaaatccccgggctcatttgcatggccccgccccctgagtgacacggctggcgcgggcgggcccgtcccccctgcccctgggtcgctctttttaagctcccctgagccggtgctgcgctcctctaattgggactccgagccggggctatttctggcgctggcgcggctccaagaaggcgtgagttcgcggccgctccggtggcttcttttttttatatctataatttaattaaattatttatttattgaggccgcgcacgggccgtgcccagcttcctgcccctcgccatccttcgggggagggggaatatttttgtccccccgcctggctgtgacacataaataccccgcgggggcctgggcggcgagcacgcggcggcggcggtctctgagcgcctctgctctctcccggtttcagatccgcatttgctaccagcggcggccgcggcggagccaggccggtcctcagcgcccagcaccgccgctcccggcaacccggagcgcgcaccgcaggccggcggccgagctcgcggtgagtcgtccccggggcccgcggcggcggcggcggaggggggcgcccgcgcccccgcccgcacgtcgcccctcctgcgagccgcccggggctgcagcgcgcgccgccggctttattcccaggccggggcggcgcgagccggcggcgggggagggccgcgcggcgcgggggcgggcggcggggcccggcggcgcggggaggacgcccgcaccccttcccccgcgccgcgggcgccctgcggggggcggggacccgggaaaggcgcgcggtgggggagggggcgcgcagctgcggcgagcgcgagttgtgcacccggcggagcccggaggagcccggcgcacctcgcgcggcggccgctcccgctggagccggagcccgagcccgagcccgggcccgggtgaggggcggggagagacacgggctgcggcgcggcaggagagtggggggtcgggcgccccccgcagctcagggaagttctggaagtgagggagatggggaggaacccccaaattcggccctacgccctctcggcctttctctcgcgccccctccgcagatgaggccggagcgcgggcctgggtttggggcttcaccccgaccccacctctggcctggcccgcgcctcttcagccccaggggccgggcctgccctccgcccccacaaactggtttcgctgctttgctgggctctgttggaactagtccctttgactccccgtttctattttattttcttctggggctttattttgcggggaggggacggagggagggggctttcttcctctcccccgcgcccgcgcgcgccaggtttcctgccccaaggcgggcttgggtgccccctctggcaggaagtggggccgggtgcacccgcgtggcggtgcatgcggtcggggtgcgctgctttcccgcgcctgcaggagcggcctgcgcccctccccccgcgcgccctggccccgggtcccgccggccggcctgcaacggccgggcgcagacacttgcagagtcaccctcgggccgggtctggagcctgatgcctcgggggtttagccctagccgctaggcgggtaggcaaagtgtcgggttgaaagggtctccgggaacctacttcttcctgctcgccaacttgctgtgtgaccttaggcaactcaaggcttctctgggctacttttttacgggggacggggaagaaaacaagggaacccccaagataatttcctagggcctttcctgcagagtccttaagtatttgaggagcacagtttgcatgcacagtgtatggaggagacaggcttgaggcccaagcgggcttattacaaagtgagggattggggttaggccctaaatgtagttcctccaagacaggcctctgatgttcagaaacaggtggaaaagacgaacgtttcttggcctcactggaaagggcctcgggccttcatttagttcgtggggggttggctgaggggattaaagggtccccagcagcaagaggtggggggaggcaccagatggtatgagagcttccagggagacccgccaagatctccaggcaggccgggccaggctctctgggattccggactggcttcgcccaactggaaccccctcgatgagggggccccaggcagaccttatatgaggtcagcactcgtttagttgattaattttgatgtttagtttgaagggggacctgtggtgtaatataagattctaatcactgcctgtaattgcagagcaggccaagccactaatgacggagcaggataaatcaccaaccaccttgtttaaaagggtctccaagtctgaaacattataagatagaataattaccaaagtcctgctgtctggagggtctcttgatgcttgaaaatggaggtcctgggccctctagaaatcacaagtttgcaaaaatgtttttttcctctcattggggtaaaaactctttttcttcttttttttttttcttttaaattagacatgggagtcccaccgtattgtccaggctggtctcgaactcctgacctcaagcagtcctcctgctttggcatcccaaagtgctgggattacaggcatgagtcacctcacctggcccataaatcattttcaaatggtctagttcttattttggttagagtgaagatttctttctattattttaagtttttctaaactattacctagtttgatccttgaagcagtcaggaggtagttcaggcaggtaccttataattaccttgatcttacagattgagaggggttcagaagtggagccgcttgtcccaccccttaccatggcaggcagggattggttactggaaaaatgtgtagcctaggcctccggcgtctcatccatctgtagcctggggataaggactaggatgaagatgtggaggactgtcctttttaagcctgtaatacagggtattcccaaatacagg

SEQ ID NO: 120363 - DNA, 1107 bp, Homo sapiens
attctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctgggaccccccccaccacgctgcactggggcggtgttaaggcaggacaacaaagagcccttctgaacaggagatagataagaagctgattagggccaacggcccttccccgcccttggcagcatctgggggtgggcagacccctccatcctgggcagagtaggaggcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccggtgagtcccgggacagcgctggtagggagtcaggtgggtgtccaaacctttgcttcacttggtttaccctttggggctagggaggtgcctggagtttcattcagcaggcgagaccatgcatggagggtgcagaatgattctgcgcagtaagcgtgtgggtgtgtcctcccacctgtgtgtactcctgccccacttgcaaccctggtcagatctctatagagaccccaggagagaaccgggggccgaggaattcaagataaattctgaagccaatggcaaacagtccaaacctaaagcaccccagaggtcacatggccagtgcttaaaacactcgcctttttcttaatttccaatccactgtggaccagtaattttaaaatgcagtaaagacgaatgaacaaaaatgaacatagaagcccagggtttttaatcattagattcagtgcacgtaaaatgatttttgtcaatttgctgtaaagttgctgaatacttatggtcgattcttg

SEQ ID NO: 120364 - DNA, 1022 bp, Homo sapiens
ggtggatgactagcagaggatcctcttgttggcaccatggccacggctgtggggaggtctgggaaggggctcagtcatctcagttgtgtacccccttccctggtacagggatggcagtgagtctttgctaactggggagagtggggcgatgactaaggtcttacttctggggggttggtcctgcccaggacactgcggagatcaggtcagaagtcccacagctttcctgatctagagaagggcagagtggggagaatggagggtccctgccagtccctgggctgagaatgttaccttctcttggggttccctggagcctgaaggggtggggacaggcagcaaaggccagattcacagtgacattagcctttcagaaaagttgttttgttttttattttattttttctaagacacgactcatatcctctgagtcatgggcggaggtgggagtagggggcgtgtgtgtatgtcgagggggcaaatgtggctggccagtcattgccagctggacttgggtgggcctgttgggtgagagtgttgggtcaccctgaacaggcaggtaggtctgccccccatcactattgggcatcgggtgagcactgatgagcattttggacttaggagatattttctctaaccctctagaaaaccaccacaactccaggaaggaaaccaaggggcagacccaaaaaactggtaggtgaagaagcagactgctgcttgcctcctgggctcttttgagttgagggtgttgagtacacagtacctgatgctatgcaccccctatggaaaggctctccttgacctgctgggacatcagattttacagaagtccagagaggggaaggtacctggcctgggctgtgcccatgagaagtgaggggtcccaggtataaatcagaccacatccccctgccctgccctgccctagttgtgtgtgggggtccctccctctcctgctcctagaatactcagaacttctaggggagatcttggaagtcatctagcctgtgtccccctca

SEQ ID NO: 120365 - DNA, 2208 bp, Homo sapiens
atcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgctccttcactgttccctctggcttcccatagtggggcctgggagggttcccctggccttaaaaggggcccaagccccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggttacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtggggccctgcccctaggatgctgcagcagagtgagcaagggggcccaaatcgaccataaagggtgtaggggccacctcctccccctgttctgttggggaggggtagccatgatttgtcccagcctggggctccctctctggtttcctatttgcagttacttgaataaaaaaaatatccttttctggactggagtctcctgtggtgtgtgcccctaaagcctggggcaggtaggatgggtgacacttgtgttctggcccccatccttcaggctgcaggaagggaggggaaatagcactggaatcacctccggggaaggtcattttaagcctcttgatgaaatcaaaacccctagccacaaaacattttatttacaaaatatatactgaatactatacatctggccccatcaccatggaaacaactccaaagcctgcctggggatttgtgcccaagcccagcccaggagggctagagaaagcaaaggtgtctaccagccgcccccatcccagaaggaaagcctcttcccatgagtgcctgtgggtgggcggtgagctcaacacccacaaagggcagaaggcctgggggcagtgaggtgatggtgagggcatgggaagcagatgctgctgagggtgggtggagggagaaatggagacccagcacccagcagggggagccaggtgacagcaggggaagcagatggcagggccccaggcagtccaggaccccaggctctgaagggtggggcaagggggtcaggtcacgtcttgacatccagcagtggcatccgcttgtgctggtagccactctgccagccatgtaccacctgtcggggaggagaccacaccacaaggctgggctgtgttccctgggagtctgcagcacccagttacagcccaagtaagcagaaccaggctctggtttcagtgtggacgagtatggctgggaacagggctgactcccaccttgcctcattctccccctggcccccaagtgctcaccttggggtctcccatgtcagagagcagctcctgctcagcctcatgcagttcctcagctgggtcatagctgtacatggggagcaggtgatggcgcagccggtccaccctggggagcaggggaggggactcagctaggaggtccccccaacc

SEQ ID NO: 120366 - DNA, 1050 bp, Homo sapiens
tttgatttcatcaagaggcttaaaatgaccttccccggaggtgattccagtgctatttcccctcccttcctgcagcctgaaggatgggggccagaacacaagtgtcacccatcctacctgccccaggctttaggggcacacaccacaggagactccagtccagaaaaggatattttttttattcaagtaactgcaaataggaaaccagagagggagccccaggctgggacaaatcatggctacccctccccaacagaacagggggaggaggtggcccctacaccctttatggtcgatttgggcccccttgctcactctgctgcagcatcctaggggcagggccccaccttccctgggactggggtagtcggtcacccagcctgccatgccccagcccctcttccccacaaagagtatcttgggggaggggatcgtgggcagaacaggaggcaatgaggatgaacatttggcgctggtagcagcagcaatgacggatgtcgaagaatggaacattgaacaaaaaacaacacaactgtccagaggtagtttgtgaacagaggaaaaatggaaccagaaccttggggggcagggaggagcaggaggggggttgggagcgggcagggtgagctccttgttattggtgccccatctgaggagggggaaatggctgagtggcggaagcaaagtagggttaggggagcagccccagcccacctcaggtggcggccacagggctcttgggcctcacctggacaataagtgactgcatctccatcaccacaatatgtactcagatcccaggcggagggcaagggggctgtggccacagtgaagagggagtaggggactcacccctcctgccttcctgtaaccgaagggggctgtccaacctagtacggggactagggaagttggggaaggatgaaaagtgagccccacgtggtgacaaagacagtttggctgggggaatcctgggggccagcacccccctccattggccacacctgctgctgccagggcagtggagtagggcgtgccaggatgagatgg

SEQ ID NO: 120367 - DNA, 1460 bp, Homo sapiens
cactttgtaccccttaaagatgtaaaattataatttgtcaaaaattaaaaattttaaatagtaactaaataaaataatgctgctacaggccaggcgccatggtgcacgcctgtaatcccagcactttgggagtccaaggtgggaggatcacttgaatccaagagttctagactggcttaggcaatatagtgagacttcacctctacaattttttttttttaattagccaagcatggtggcacacacctgtaatcccacctactcaaggaagtgaagatgggaggatcacatgagcccaggccgcgaaggctgcagtgagccaagacagcgccactgcattccagcctgagtgacagagtgagaccctgtctcaaaaaataataatctgctataaatatttttgtacacatttgttgaagacatatattttcatttttttctgggcatgtacttgccgtatcattaggtaagtttatatttgaatctacgctctttccctcggagcgggcggcgcggcggcgtcggcggcctgtgcagcaatggccaagatcaaggctcgagatcttcgcgggaagaaggaggagctgctgaaacagctggacgacctgaaggtggagctgtcccagctgcgcgtcgccaaagtgacaggcggtgcggcctccaagctctctaagatccgagtcgtccgcaaatccattgcctgtgttctcactgttattaactagactcagaaagaaaacctcaggaaattctacaagggcaggaactacaagcccctggacctgcggcctaagaagacacgcgccatgcgccgccggctcaacaagcatgaggagaacccgaagaccaagaagcagcagcggaaggagcggctgtacccgctggggaagtacgcggtcaaggcctgaggagcgcattgtccataaagcacgcctggctgagaaaaaaaaaaaaaatctataagaaaattctaaacagttttccaaagtggttgtaccatgccacaccactaccagtgatgcatgagaatttcagttgtgccatattctcttaaaaattaaatatctttcttttttaaaaactatttctgcccccaactctgccaatacttgcttcatatattatgggactctgttgttcaacatgtatgttattatacttgccgtatcttcttgatgaattgactcctttatcattataaaatgtcttcctttatcttgtgtaacacttttttacttaaaatcgattttgtctaatattagtatagccatttttgctctctttacactcttcatgggatacctttcccatccttccactttcaatttatttgtgtctttgagtctaaagtaagtttcttttttttttttttttttgaggcagagtcttgctctgtcacccaggctggagtgcagtggcgctatctcggctcactgcaagctccacctcccgggttcacg

SEQ ID NO: 120368 - DNA, 1045 bp, Homo sapiens
agatacggcaagtataataacatacatgttgaacaacagagtcccataatatatgaagcaagtattggcagagttgggggcagaaatagtttttaaaaaagaaagatatttaatttttaagagaatatggcacaactgaaattctcatgcatcactggtagtggtgtggcatggtacaaccactttggaaaactgtttagaattttcttatagattttttttttttttctcagccaggcgtgctttatggacaatgcgctcctcaggccttgaccgcgtacttccccagcgggtacagccgctccttccgctgctgcttcttggtcttcgggttctcctcatgcttgttgagccggcggcgcatggcgcgtgtcttcttaggccgcaggtccaggggcttgtagttcctgcccttgtagaatttcctgaggttttctttctgagtctagttaataacagtgagaacacaggcaatggatttgcggacgactcggatcttagagagcttggaggccgcaccgcctgtcactttggcgacgcgcagctgggacagctccaccttcaggtcgtccagctgtttcagcagctcctccttcttcccgcgaagatctcgagccttgatcttggccattgctgcacaggccgccgacgccgccgcgccgcccgctccgagggaaagagcgtagattcaaatataaacttacctaatgatacggcaagtacatgcccagaaaaaaatgaaaatatatgtcttcaacaaatgtgtacaaaaatatttatagcagattattattttttgagacagggtctcactctgtcactcaggctggaatgcagtggcgctgtcttggctcactgcagccttcgcggcctgggctcatgtgatcctcccatcttcacttccttgagtaggtgggattacaggtgtgtgccaccatgcttggctaattaaaaaaaaaaaattgtagaggtgaagtctcactatattgcctaagccagtctagaactcttggattcaagtgatcctcccaccttggactcccaa

SEQ ID NO: 120369 - DNA, 1058 bp, Homo sapiens
taatcccagctacttggtaggctgaagcatgagaattgcttaaacctgggaggcagaggttgcagtaagccaagatcatgccactgcactccagcctgggcaacagagtaagactctgtcttaataaataaataagaaaataaaacggaactgcagtgctaacagtaatttatacatttttaaatgttctgagtatgttttgactgggctagtgtaacaatatactaccctgaaagtgcagttttgattgttgttggtgtctttgggtcaggaaagtgaactgtgccaagaagtatttttcagtgacatgaatggattcctgttaatgcaattgactgagagattgtgcttacgctttcttaactgacaaaaagaggctttgtccaacatcagaattgttgaaactggtgctgttttctgttgcactgggattctgatgatctgggattttccctccttggcacagtaaacaccatgactgtctttattgagaatgtcgtcacagtcctttagtgatagattagttagacccatggttgcaatacctttatctccccaaagaaaataatcaaaagaaagcacaaaagctaccctgtttgcagaatatttcactgacattgatttgtcattaattctaccagagctgacctcattcaggcttgatagaaacaggttcctatgtttagggcagatccctagcctctcgctcacagtgagtctgcatgtcctagattctggttattgctggagcatccattaaagtctaccaaactcaggacagaagaagatagcagtggatttgtaaaaatttttagtttataaattacagtcattggggaaacactagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcacagcaaatataacaggatggaacagttagtgttttgttttcacaagt

SEQ ID NO: 120370 - DNA, 1058 bp, Homo sapiens; identical to SEQ ID NO: 120369

SEQ ID NO: 120371 - DNA, 1832 bp, Homo sapiens
cctgtttgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcctcacaattaacatacctttttgttttcgatgctagtggctgggcaggttgccctgtcctttctctatttcccagtcattgactgtagatatgggaagagtttagctaccttcatagtgctcccaggactcatggcctttccttctttaagctgtatttccctgcccagaaagaaacaggaagaaacctttttttatttttttatttttttttaaccaagcaaggagcaaatggcctcagcccagatctgtaaaaacaatgatagaaattgaattctgccccacatgttgacagtagagttggaactggattcttgggattacttatctaaaaaactggagcatcaggtccatttctgttctgctggtttggaatcttttccgtaatgctatttattgccaacaatggcctctctttgtgtccatatatgccttacaccgtgctgacctgggtatcatccatgtgctctgaagcatccaactttactttgcaggtgcatcaatgtagtcctgtccctgaactgagtaaccgtgttcctgaaaagtacactagggaaattcacctgcttgcttgtctttgtattggcatggcacttgtgattgcaccatggagcatgctcagagctattaaattggtctcccatctcccaccaggatatgaaaggtccatatgggaggccacgtaatcacttattacagtggttacataatacactggctcactgcagactctcttgttttttgatacagtttcgtgctggcttcatttgccaattgtgttgtttagttcggaagtaagagggtcttgagattgaggggtagggagggctacactgactgatccgtggcttaagacaggagattatctctgtactccagtggcatctccttagccaagatgtgaaattaaaatcatagttcgcctcatttaaaaattctaataaagcactcaaactttgaaaagcttttacttttccctcctactaaaagaaatgtatgtacctcatagccctgtgtcatttagtgttcagcacttttgggaacatcagttggtgaactttaaattttgctgtctactcactgggcacggtggctcacacctgtaatcccagcactttgggaggctgaggcaggtggatcacctgaggtcaggagtttgagaccagcctgaccaacatggtgaaaccccgtctctactaaaaatgcagaaattaggtgggcgcctgtaatcccagctacttgggaggctgaggcgagataatcgcttgaacctgggaggcagaggttgcagtgagccgagattgcaccactgtcgtccagcctgggtgataagagtgaaactccatctcaaaaaaaaaaaaaaaaaatttttttttttttttttgctatatactcttagtttacatcctctcccccaatcttcacacacagagccaaagagcagttatattcttgggataccatgatacctctgggaaaggaattatattcccaaggagaggtcccattggataagaacaataccatgggacttgagtctgaatgccaacttac

SEQ ID NO: 120372 - DNA, 1026 bp, Homo sapiens
cgtaggtgacaaagtaaggctctctctcaaaaaataaggtaagtggggttagtgggaaaaggggtgtgggtgggaagaggggtgtgggtgggtgtgtgtgtgtgtcacactcagcttgtttgccttgctggggtcactgaagtttgagacctctgtggtagcccacccatccacagtcctctccctggtggtctagctagttaaatttacatgatgcctttttcttctcatagtattcctgttaagttgtatttaggggaaggggaggaaaaaccaatataattacttggttttagaagtccagccaaagagcacaccctcaaattcaagtgtggcctgctttaaatcatgtagctataactgtaggaccataaaaagtaaaagtttagaatctttgtgtctgagctctctggacatatgcataagagtgtgtttcatttaagtaattccagctttctaaggaaaaactctctctatccttctctctttgcccttcagaaccaggagaggaagcacaggacgtatgtctatgtgctcattgtcactgaagtgctggaagactgggaagattcagttaacattggtaagccatctccagacagcctggaaagggttcctcacaaccagcccttgccatgccacaggtcatgaccagaaccagaaacaagagcgtaccaggctcagtggctcacacctataaccccagtactttggaaggccaacacaggaggatcacctgagcccagagttctagaccagtcttggcaacctagtaagacctcatctctacaaaaatcagaagacttagctcggcgtggtggcacatgcctgtggtcgcagcttctcaggaggctgaagcaggaagatcatttgtgcttgggagtttgaggtcacattgagccataatcatgccactgcactccagcctaggcaacagagtgagactctgtctcaaaaacaaacaaaaaaacagaacaacaagagctggataaagaatagaaataattgaaggatgtgtataataaa

SEQ ID NO: 120373 - DNA, 1060 bp, Homo sapiens
atgtggccaagagaattagggtcccttagagtctagggtggtgtattgtattggcctgtggccatctgatggagcaggaactgggatacagctcccagttcatgggtgagaaacttggagggaaagtgttggaccatgatggcaatcatggccaagggccttttgtcttctggccagctttttcagtgctgacaggctcatcagtgacaatcctctttttttttttttttttttttttttgaagtcttctattcaccttgtcaggtctgtgttcaaagggctctagcaaaaggaacaaggaggggataaatagagcaggtgattgagcatctgaggggagtgtagagataatggccttcagatgcccttctgcttttactagctgatgcctactttttcaaatagaaacgaaagctactttgcaagaagtgatttgggaaggcataaacaaagaatgggtcttggttactttgatgtttgtggtgtttaaactctgaatttgtgtggatgtgtctttgaatttttaacccccccatgcaacctttgtgacttaacaggtgctactcgtgagcagtagtcgccatccagacagatggattgtccctggaggaggcatggagcccgaggaggagccaagtgtggcagcagttcgtgaagtctgtgaggaggtatgcatggagaagagagggcacagctgtgcctcgtcatcatgaacctgtcctatctgtgtagttctttaatatgtcagcactcactgaataaatatacagtcacagaaaaagggcaatgaatggttatccggtccctcctttattaccgggtgatggagttgtgacatggtaatgttaaccggcactctgtgccagacttcccatgactttttatgccagacttttgttacttcccatggatttcttccaacactgcctgttacctgtggcacaaaatcaagaagcaaatagttcctgacctctaaggagtaagaggaacaggcagcattagtataaatgactcattgtcattaagctttggaggaggcccttgttttcctgtgcttact

SEQ ID NO: 120374 - DNA, 1047 bp, Homo sapiens
ttttttatttgtaaaatgggaataaataatacctaattcttgaagttgttatgagacttgaatgaggaaagtaaagtgcctcccagataacatagttggtgctgtaacgaaggcaggaaccacagaaggaatcacactagccaagaaatgatgatgatacagtgaaatgagtgctgtaaaagaaccctctccgaatgctttagaaatggaggagtagacaaatgctggattgagaagtcagacacagtgcgaaaggactagatctgagtgttgaaggatgagtataaatttgctgctactccaatacagattgtgcaggcattaaaaaaaaaatcagatgctgatcataacagcgtcacaaagacagactgatatgtgatctaaaaaatacaagaactgggaaagaaaggaaagattcactgcagtaaatggtgctctgtgaatttactgtgaaagagcttttatggaaagagaggaagacctgaagttatagaatctttacatttgtgaacctggaagtaaacatagacatgatctatccagccacgtcagtgaaataagggaactggaaccaaaagagtgttgaaatctgtctactgtgataattctggtaaaataatatgtacaaagataacacagttttcttctgacagatccacaaaaggagttaaacaagtagaatgcattttttttttttttttttttttttttgagagggagccttgttctgtcgcccaggctggagtacagtggcatgatccgggcttgctgcaacctctgcctcccaggttcaagtgattctcctgcctcagcctcccaagtagctgggactacaggtgcatgccaccacacctggctaattttttgtattttttaagtagagacagggtttcaccatgttggccaggctggtctcaaactcctgacctcagatgatccgcccgccttggcctcccaaagtgctgggattacaggcatgagccactgcgcccagccgaataaaaatatatttctaaaacagactcccagtaccagtatttaaaagaa

SEQ ID NO: 120375 - DNA, 1007 bp, Homo sapiens
actgtaacttcttgagtaagattttataatccaaaattgggtaatatgatattcatctgtcatattattcaactttggccctgctaaagtacttccagtgagattatccctcttcccccagcctttccttttttagagcctctgtgaggagaagtgagagacagggatgggcttgtttgtactcttagaaaggccaaatgatacagaacatacaacaaatgacatcacagtgcctaggaaagttaaagctgctcctaacgggtctgtttttacccagggagaaaaatgactactaataggattgtgtgagttagatttccctgtgccttaaagctgttttaataaagaaaggatgaagctgttcctaagttgttaggttcgtttgttgtacttttccactagaagccctatatctcttggcaaaggggagctgcttcacattttctcagatccttcagctcaccaggttggaacggagagatgattgacattggagctcttcagtgggcagagactggtggcctgtttgtctgtaaaatgccccagaggagcaggtggactgacgtctctgcagactgcaccttccagcaggctctagagaagagagtaagacacaggtagcaatcccagaggcaataatcatgacaaagggcttccagcagatcccaaggtggtttgggagtccttttgtaacacatcttggtcaccgttcaatattacattgctctaagatcatgatgggttcattgatcccgtcatgactggacatttctgcttctcatttctcaaaatctttcctggaagcttttttcccctgctttcccttctgtttgcctaataccagttagtcatgtcttccattacgttattttttgcctccttcccaaggtgtgaattctggtctgaattcatactgcagtctccattctttttatgtctttgccccaatcctacttctttgtttctgctttaattctcatttctcaataaaaatagtgctgcacatc

SEQ ID NO: 120376 - DNA, 1064 bp, Homo sapiens
cagcaggctgctgggtctggtgtaccccaaccaggtggcctcccagctgccaaattgtgtgattacaattagttacctctattcctttatctgtttatgttcattgtacttgttattgtaattgtgcaacttaaccagtgaactttgagttcagaaaagaacaaggctcagcatggtggctcacgcctataatcccagcactttgggagaccaaggtgggcggatcacatgagcccaggaatttgagaccaacctaggcaacatggtgaaaccccctctttactgaaaatacaaaactagccaggcacggtggtgtgcagcctgtagtcccagctacatgggaggctgaggcacaagaattgcttgaacccaggagacggaggttgcagtgagccaacagcacgccactgcactccagcctaggtgacagagtaagagtctgtctcaaaaaaaaaaaaaaagaaattactgctcacttatatggacaaacaaactgagaagactggagaggggatcttaaaagtctagaaggactctgcacatagattacttcatgaatgtttttaggtttttgttctttataaaaactaggactggaaaacataggtcattgattatggatgtggcatatgaaagaaagacaacttaacaattcaaacaaacaaaacaaaacaagatcttggccctacaaagattaccaaataactacatgtttatatacatataaaagatttatttgctaataatatgtaatatggtctcgaactcccgacctcaggtgatccgcccgcctcggcctcccaaagtgctgggattataggcatgagccactgtgcctggccatattttttattttttgtagagatgaggtctcatgtttcccagactggtctggaactcctggctcaagtgatcctcccttcttggcctcccaaagtgttgagattataggcatgagccatcacatctggcctgattatttaatattttcatttgcttcctctttgcacataatatataattagtaatatataaagtatgtatatataaatgtatatttatct

SEQ ID NO: 120377 - DNA, 1451 bp, Homo sapiens
ttagggcgttgtgcataagccatagccagctgtttattttacagtgcgctgggtagcctttatggtgtagtctgagaagaaaagacatttgatataataatctttgtgtgctgaaaatgtttcatgttaattgggaagaccaaaagcggtatttaacatttttgccctgacgttcctccactgccttgtgggaagactcttaggattaaattagctaggaaaataatgttttagaatcagtttctttttataataggtagggtactttaaaaaaaaatctcggcttcccaaagccgtttctgtggtgatgaagggaattcagagaagcacatgttttgtaaatccacaaaagagtagctgctttggaaattcataagatgcctgtgggaatgcatttctcgtgtgcatggtggtaaaatggcagttaaactggaaacaatgaaggacagtgaaatccaatatgttatattggattcagcagtgggctatggtggcagggccgcagtacagtgcagtgtcgaaatggggaaaggaacttgacccgttagttatgaaaagaagctgtggcgaaagagacagatggattgccaggagttgctgtccagaggtatttaggaggaagtgggaatttgaattactgcctgaagaaaattagttagtgaattgtgttgttaagggatcccatgtgtgctccctttcagcaaaacagaacgaaaggagatttggaaacgtatgctttgtatcctaccatatattgtaaaagtccccaaaacagatgcattgtaatagctaaccagggccatgctgtaaattatatactgttttggaatgcatatttgagtaaagtaaaattattggtggtgcttattgctccagagcctttattctcctcattatcatatcatgttatgggaaatcagatgggatcacaggctcttaactgaagggaaaactaattagcataatagcatgtcttactacactagtatgcataaatctgtgagcaccccaattataagtataatttagttgtacgaatgatgcaagactgtttgttttaaaaaaatcacaccaggccgggcgtggtggctcacgcctgtaatcctagcacttcaggagaccaaggtggtgaggccaagagttcgagaccaacctggccaacacagatccccatctctaaatataaaaaaaaataataataataaatcatactagaaatagaaaatgtatttttgataaattgaaaactatagatcataagcaaactagcaacggcttaattttccattttctgttaaatgttttgttatgcactgacattagcaacattaatgttgaaagcttacttgtctgtttaggctacctcacggcatctcacaagtcagaccaggcataggacttgccttctaggagcttactttttttcttttttttttttgagaccgactctt

SEQ ID NO: 120378 - DNA, 1418 bp, Homo sapiens
aattccaaattttacattgagttgtagcatgcaaacttttgtaaatacataaattactgaaatgagtctcagaaatcagtacatgtggcctactagtattttctgtttcattaatgcttgacattgaactaaacactggaaggtgggtgggcttaagaaccaagatggtatgaaatcaaatcctccatcttttttcagttgatgtaatgttaggtaggttcccctctgcctcagtttctccatctataaaataaggtgataattacagctactaaggtagttgtgagattagttaatccaggcatagtactggcatatcatttttgtcctatggcaggtcctcatagcacacgattgctctcagataatgtcatttgtaaaaaggaagcatgtacagtagaaacggtccaatcctggtgctggatgctttcataggagtatgtatgaacacactctgggtgggtggccatactcccactttaccaatgaagaaatgggcctagatgttagatatggccccacatccagtaaggggcagtgctgggatttatagcctgtactcagctctctcccagctgtttacatttgggggcctctggagttataatgaggcctgaaagttagcaaaacctccaaagatcaaaccagagtgccgctcatgctgatgtgatgtgctttctcttacagagaggcggatttggtcgtggacgtggtcagccacctcagtaaaattggagaggattcttttgcattgaataaacttacagccaaaaaaccttaatcttttgtccattttgtttgcattgtgcagcctgaacaggaacagtttaagtgtcagaatgtaaatggggcagtacaggcttggtttggggagttgtcattgtcctgggtgacaccggctgctgctgtacttggctttggcgtgtgccctgctttctctaggcagtgcctccctgcagagtggtgtcccatatggtgctgcagttggaaaactgggtcccttctttagaccagccatgctgcctcagctcagcatggtgggaaaattgctggttggcctggagtcgtgatttgtgcctgctgtcaggaactataagaagtactggggagggaggatgaaaggtaacgaccaaggaaatggtgcacttggaatccttcaatttatggagaagaagcacaggaatggtgtttaggccaacgttactaatctaagtcttcaaggctcagcgtttgttgacaagaatcaagggagaaaacaatgcacaaaaaccactgttcaaagtggctaacgcctactcaggagcctgaggcaggattgcttgaggctaggagtttgagaccagcctgtgcaacatagcaagaccctgtctcagaaaaggaccaaaacatttgaaagtcatctgaaattcttttttttt

SEQ ID NO: 120379 - DNA, 1048 bp, Homo sapiens
tggtggcacgtgcatgtaatcccacctactggggaggctggggtgagagaactgcttgaacccaggaggcagaggttgcagtgagccaagatcgcgccactgcactccaacctgggtgacagagtgagactccgtctcacaaaaagataataaataataaagtttctgccttaatatatatcccacagcctaacaggtatgtgaagaagcccaagaggaactcaacgattcttggtaacccctagattatgtacttaatattggagttgggactttcagcttaggatgcttccttttctgtttgcatatactaagttttccacttaacgtgggtcaggttcaaaagtttagctattcagatgttcatagaaatagctagatacctagattggtccaataattggaaaatagttttatgttgaaacaaaatggaagccttttttttttttttcagatttgcagccaagattgtcaataagtttctatggagaaataattatttctagctgacattgtaggtttaaggagttcctgtccccattaacccatcttaaccaagtggttgctgagagtgacaacaggagagcaatgccagttttcttggctttaagggacagagttctcacattgccctgtgttcacagtgtggtttgatttacataggtctggagggtgagcgacctgcgagactcacaagaggggaagctgacagagatacctacagacggagtgctgtgccacgtgagtaaatgcatcacctatattaggggtgttggggtgaaatgtctggattctcacagctggctctggctgggtggggctcagcccttgatgatgacaaaatgaccaggaaagattcttggtttcactctgcagagcatcagaacagctggagtcctttgtgcttctttcttcatgcagtgatttcatagatgagaattaggaggaggctgggattttttaaaaaacaaaactcaggccgggctcagtggctcatgtctgtaatcccagcactttggttggagggggggggtcgaagtgggcagat

SEQ ID NO: 120380 - DNA, 1058 bp, Homo sapiens
gtagcgataggggctggaggcttattttatggggtagggggccgctggtaggcgaagattgtccgagggagagggggaggatgaagccagtgagtggcggagacttgccaggtgagactagcgagacggtgtcccaccgacacgcttttttcttgggaacaggactcccccgactgcctccttgcctggcactggagctctagtttgggggagaagtggtaggtaggagacgagggtgcgaaggccttagccctttggtttggggtctgccgccttcaagaagccggggctttacccctccgggccttccctgcgtaccttatggtacagccgcgagattccgcgctgggtacggtcgctgatggcctccaactgctcccgataatacagggtttgctcctctcccccccattgacctttgtaattgatgagaacttaaggaagtttggcgcgaatgtgcaccactatcctggttttaacatactgtcaacttttccacctgaattgtgtttgggggtggggactgacggagctggcctctgccgaatctgttttgtggagttgagtcttcccaccagcatgttgtctacggttttgtgtgggtcactttaggatcaagaacttgattaccgggccccggcctcgttactcagaagtgctcttgacaatcgtctccttcttgcagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcaggtaggagggtgaggaggaagatgggatggatcttcctccccgggatcccatcccgggatgggatggaatgggatggagggatcttcccctaaggttcaaggcaagttcaaaaagggaggtcaggactgcgggggctgcttgctaacttgaagggctggctgggactggagacttgcctaggatgatccaagcttctacttaacgccttaacagtagttttctg

SEQ ID NO: 120381 - DNA, 1011 bp, Homo sapiens
gcaggcagtgccaagcagagacgcagccacaaatggaggagcgctgctcccgaacacctggagccagggcctgcatcccttctggctcttaagagtgtgggctcacaggtcccagggagtgggcaggggaggagttaatgggtgaccatgtttgctgctggtcacaaatgaaaaccctactccctattcccccctccccacagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaaggtgctggcgggcagggatggcagtagggggtctgggggccccttgcagagggtggtggctgggagctgcaggcctggctaggtgtcaccctctctccactctggtgcccacagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcaggtacctgggcatggcaggcaccgagggcacaggcacagccagcagatggtgtgactggcatgcagggcatcccagccctccatcacagtgacgggaaggggaggcagagctgcaggggtcaagaaggatgaggcttcaaacacaggggctgttgagtgcaagctgacgcacactgggtactctagaaacacatgctggatgatgggtgaatggctaaggtgggagggaaaaggagtccaccgagcatgcccggagcttattcttgcaaagcccacatgattcctggctgggcagcatgcccagcaccctgcttccctgagtggactctggcctctcaccaaggttgaggaggggccatgttga

SEQ ID NO: 120382 - DNA, 1048 bp, Homo sapiens
caagagggacccacactctggggcagctgagttttgcttcagaagacaagaaatggtctagatcatagcaactatgtctcctctctaaaagatagtggtagttcatcactctaaagcagccgtccccaatctttttgggaccagggaccagttttgtggaagacaatttttccacggatgggagcggggtggttttcggatgaaactgttccacctcagatcatcaggcgttagattctcctaaggaacgtgcaacctggatccctcgcatgcgcagttcacaataggggggttgcgctcctatgagaatctaacgccgcggctgatctaacaggaggtgcagctcaggcgataatgctccctcgcctgtcactcacctcctgctgtgctgcctggttcctaacaggccacggactgtctgcagccccagggttggggaccccggtccagatcacaggaaccaagcctcctctctaaaagatagtggtagcatatccttctagagcacctactgtgtgtggcacggttctatgcactttccatatgttaactcattcatgctcaagtgcgtaaatattaccattttacagatggagaaactgaaacccagacaggttaagtgacttgcccaagatcacattgctagttagtaaacctcagagccagatatgttgcccaggaggtctgactccaggatccttgctcttaaacattaggtggtactcctcctcccggatgaaggctcagatgtgccctggggtccccttcaatgccctctccctcgagggctgaataataacgcaaatggtcctgcatttaaacatcggtttaaagagctcatgagggtcacccctcctatgtggccaatccttgctctagccttggtagaattcgggatcagggctctgattaggaggagcggttagccctcgggatgcggtacggggagacattgaagctggctccttcctccgcgtctcagtgttagcagctacgacagaggccagccctacgccaccgagtggtcagacgacgagagtgggaaccc

SEQ ID NO: 120383 - DNA, 1008 bp, Homo sapiens
ctgcggtgaactgagattgagatggcgccactgtagtccagcctgggcaacagagcaagactctgtctcaaaaaacaaaacaaaacaaatgccacccccacgctccacccaacacacttaaaattgccctcaacactttccatgctcctttcctgcttcattctggccccactgcagcagctcccacctcccgacatactatatccacttatttgtgtttatttaccctgtttccagcactagcacgtcagctccaagggacagcgagattggtctgtcctgttcactgccgtgcccccccgcctggagtgtagtaggtgctcaataaacatttgctgaaggtgtgacgggggttggggggtgccaggatcaggcctgagtttctgagcaagctggacagggtcatgaggagtgggaggaagctgtgctcaccgcttggctaagagaaggatgagagttgggggtgctgcaggcttagggtgagtgtgcactgttcagggcaaggagggaaggagtgcccaggaagtgcccaggcagtgatggggctgccgaggtccatgtgtgtgactgcaggggcccccttaggggttggagggccaggcccttcacccctacaagtccctaccccttccaccccactaccctccctaccctcagacgtagtcttctctgggcagaggcagaaggcagcggctggacacaaaggcataacagctctccctccaaaagctggaaagctcgaacctctgataagatgggtaaatttcaaaggggctaatgggtggggggagaaggctactgataacagggccagagtgctgccagcagcctccccccgaacttcccaccaaccggagggcccagctcctgagctggcctgtgagcaaaacaggttccgattgtgctcttatctgggcctgcggttttgtaaggcccggctggctctgcattaatcggggaaaggcagcggtcagctctagggtgtgagcagtgatgtggggcccctcc

SEQ ID NO: 120384 - DNA, 2486 bp, Homo sapiens
tgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacaccaaaaaaagctgttttcatgtgtgttggtgagttttattgcaccctcaagcctcctgtaaacttgtgtggccccataatggctctgtgatgtgtactgtttggtctctgggcctttcccttttgcagatgggaaaactgagaccctgaggttcattatatgtttgggaaattagtcctgggtttataatggggtctcctgccctttctggtgcccagtgaccaggaaggtaaggaaactgcctccaaatgacctgtatctccagc

SEQ ID NO: 120385 - DNA, 1111 bp, Homo sapiens
atttttgtcaagaaggaaataggaaagctttgtgacctgggtggaggaaggttggcattgactgatctaccatctgaaagatgggggagttatctctaccctcccctctctttggatgatgtgagaaatctttggattcagtgagaaacttagcaacttgaaatgtactgatctttggcctgccgaggttttgtatggcaaagaccctcaggccttgtctgtggattggggcttccttgtgactcactgggaaccatagatcttgcacttggtttggttgtcaagttgcactgctatgtgtaccatcactgactatcttcactctcttccaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttga

SEQ ID NO: 120386 - DNA, 1154 bp, Homo sapiens
aagccagtggttgctttataaaggcccacatgaagtgtgtagagctttggactggaaagcagttaaatttagggtaaaggggtaaatatttcataggaagcaaatgctgtttgttttttgagttttcttttttctttattaaatttattattttttccctaaccctcagaacctgtgactttgttttaagagagaaggtcttactctgtctcgcaggctgaagtacagtggcacaatcatagctcactgcagcctcgacctcctgggctcaagtgatcctctggcctcagcctcctgagtatctgggactacagccatgcgtcgccatgtccaactaattaaaaaaaaatttgcgcgtggagatggagtcacactgtgttacccatactgatctcctaactcctcacctcaagcagttctcccgcctgggcctcccaaagtgctgggattatagacataagcgaccgtacctagcaaggttttctttttgctgtgcatttttttttcctgcacagagacctttgagcattgtattggttctaaaccttaagggaattaaagtttttgttgctttccttgggtagttctagatgaatgattgttgttgggaactgctgagtcagggcagcttgttttaagctgctttacgttctattaggttggtgtaaaagttaactgcattttttgccattaaaagtaatggcaaaggccaggcgcagtggctcatgcctgtaatcccagcacttgactctgtcttgaaaaaaataaaaataaaaaataaaaataaaaataatggcaaaaactgcaattacttttgcgtgaacttgatacctctgatgtatgggaccccccctaccaggacttgcaaaatggaatctgagagccctttgctgccccagtgcacacttgcttgagtgggtggatgctgtggctgctgagatggttcatagctcgtctgctagaggcgtggttggctcgggctgacagccatgtggcattttggcaaatgccagttgcttccctcaccagtgctgctcccttaatcaggttgcctcacctgtctgagcttggagaccatgcttgtctccttggatctttgtgagggctaaagagaacatgttaggtgctactgcagcacctggcacgtagtggat

SEQ ID NO: 120387 - DNA, 2624 bp, Homo sapiens
ctggcccctgccagccaggccaggcctgtgagcagggcctcaccacacaatgtttgcagtataaatcaggacaggacttagtactaaaccctgtattcttctgtgtttgcattcagtgtacataagtgatacaaaaggagcactaggcggaagaagcactgaccaggactgacccaggaaatgaggaagaggagggtcctcatggtgttatccgataatgccatcagtatacaccaagagagcatattatttctcagccatacaacaaacttgcttgtctttttattaacctgtgtgaaccttcttatttatttaaatcaaatcacaaataaaagcaaaataaagacaggtatgtgaaagtcctgtgttgtggtaatttatctaaacaacaagctttcgtatacagaaagagtaatgcaaaaatctctcaatgagacatccttttttcattaggaatttcagccttcttttttttcctggaatgttaaaaaacgtctgactcaccagtcagtgtatttcataattcattcattcattttactgatacctgagtctactatgtgcaaggcagaactaagtatcaggaacagcttctgtcgtcatagaagggcagcctactcttctgatagcactgccctgcctactgatgaaaataggtgaatacaactgaaatggaatgattgcctgttttttagtactttggcatacagttgatgttttctatcagtgacagttttttagtactcctttttggaaaggttattttgacttctgtataattttagaaaggactctaagatattgcaggtttaccctcacataagataagtgataaccacatcactggctaggaatgattcttgctatttgacagacacaactataaatgattctgtaaaacaaatcagagagacagttatttttaggtttgctttgaggacaggattataagtactagatcttaaattttccttttaggagattgataaggatgagactgagctcatctttatgtctgtaaatgttctctaacaatattttagggctgagcacagtggctcatgcctgtaattacagcacttagccaaagtgggaagatgacttgaggccaggagttcaagaccagcctgggcaacatagtgaggaccacccctcccttaccacacccaacaacaaaatttttttttaattttaggaaattagccagataatggcttgcttgcagtagttattattgcattgtggaaatgcagttcaggacttggcccaactactgtaatcaatcagctggcctaaggcaaaagtctcttccccaacactggtgagcaggaggcgttgctgccttagctaatgactgtggagcctctgcgctttaagaaggcttgcctgctctctagccaggttgaacttaggtccccacgctcatacctatgatagctggtcagtgaaagcttagggaaagctgaggcaaaacaagcaacacctcagcccctatggacctgaacagtttcatatcccctagcagatgtggggctgttcaatgtagcctttggaaacccatttctgtgtaagtggtgtatgccctgggcaactggcctttagacctggagtcagataccagagtttttttctgggtttgagtatttataccctccgttagcatggataaatcagtcttgctgctagtccctatgtgataggacatgattattcctagagaggagtggctttctgcatcaagctcactgggttttataatcaggatgatggcttcaatttttgcttgggtccgagttgaattcagggttctgtggtaccatctaatgcatatgcccctttatctgttttccttattagtagtggtacaagtgtaagagaagatatttcattgattccaggttagctaaaatatttggcatctgtttttactacagataaaagttgaagagttgctaggccccagaagagagtgaatgttatctgtattgccaaatcctacttttaggctgggattgtcgttggctaccagaacctgttacaccaggtcttagaactccagtggaatctgaaatgtggatgggcctcccggtttgaaagtacctccatccagaaggtaccgcgatggtcttcctgcttggcctactgccataggactccccagacaagctgttcttggaatctctgccaggcttttcctctacaactggtgttatgttgcctgtgttctgtgatccacatgagacacctatgatactgtgtgtgggggagtctagatcgtaaaatagcttccaaatagagttggtgccctctctcttccttgaagtgatggtaattaatttgggggtaagaaaaatagagcttgttcatcaaactatttttctgttccaattaaacaacaacaactctaatatatagttcactgggtgaaagagaattaggtagctatttttcttcataaaaggcatggaacatcagtaaatagaggatcaacaataaccataatctaaactagttaaatgccacactgaatggtctgaaggccagggcactcaaaggaaatctgaaaatgcacacgtctttattcctgtttcttccaattgaatagaacctgctttatttatccg

SEQ ID NO: 120388 - DNA, 1044 bp, Homo sapiens
agggctgagtttaacactatctgtctaacatgtaaaccatttcatactatccacagtacctttactgcttttattcttattcttcattcacaacacacttgtgatttcgtagttataatcctcatttgaaaaaataatagggaagtattataagtaacttactcacattcacacagcaaattgaaggtgggctgcaggctggaacccagggatccagtttgagtctaatgttctagaccacactacagtgaggttgctggcaagtgaagtttgttggctattctctgaaggtagtttatgcacttagtgtcaggtcgtagagacctcttcattcatttgtgggaactgcaaaagaatgtgtggccggtaagaagcaacacagagcaaccaagggacctgtcccagttggctggcagattagcacactgtgtaccagaagggacttgccaggatactctgggcttaatattttgatgattctcttttgaaaacccagaagagccagtaaagtcctcgcagccttgctggtgtttacattggcatgaatgttgtgtgcattttttaaataaattaagcaaacataactatgggccttagaaaatgtcttttgttgtttgtaacattactatctgactgagaataaaaagtatctccaggaactttcctttttgtacctcagtagcttcaaagctgtccagctccattttatttgctttgggctctgagcattgtttgaggttgttctgatgctgtgcactcttgtggctgaagcagagctaatgttcccaagattgccagcatgttttattttggttataagggcccattctcttccccatactctgaattcagcattttaatttctgatgaaagttctcaaagtaggactcgtgaaatttataggttcaaacagataaagtataattcaaaagtgtaagaatggctcctggtatagatgctcaggtttcaaatgacttgttctcagctaagtctgctttaattgtataccagcaggaccagaacaaaatgtaaggttaagaactg

SEQ ID NO: 120389 - DNA, 1066 bp, Homo sapiens
tcagaaggagtcagaaaagtaaatatatgctgactcgcctcaaagattcataaatctggctccctgcttttgttagaaattggcttgcctcattgtcagctcagttgtggctgaactgtctgtcccaggtgaacagtgagatcaagtactggtgaaggctagaaagtgttttaatgatccctttttatgtgattagctgaagagcatctgacgatcaagttagggtagcataggtgctcactccgttgactcaaggctaaccttgctgtgaattctagcactctgactcatctctggggggccagagtagcttctgtttggacagtgcgaaactgatgaaaaacaattcacagagatgtggaaagagaaaaaaaagtcctgttaaagttacgtatgcctttttcttatatgccagtaatttttaaaatttcactgttttctaagaaggcctttacagagcaataagaccccaagtggtctgattcaggacagctggggataagagtgtggctggcagaatcgaggggctgttctttaggacagctacctgctttgctttctttcactaaaggagtaatgatttacactgggagctgaagaggaccccaaattcacttattttgttacttgaaatatggctcttatattgtgtttgttctttctttaaaaaaaaaagtgttcgaggctggtatatgccatatattcccactttaaactggattacagtctgagccactgttattacttccatcaaatgctggttcagaaggagaaacttattattatctttgtggggaggttcatcccgctcctccagagccatccctgccaagtgccatctgctcgcgcactcgtgcttgctggcttgcttttgtgcttattctcttcccccacccccacccctttcctctcttgacagtcatcctgtagagcattttgtatctggagctagcaggagtcagtctgcttctgttacatcagaaatcagctctttttctcacctgctgctatctatgttgactaaggcatagaagagttcttttctctccatccaggtgagggttta

SEQ ID NO: 120390 - DNA, 1057 bp, Homo sapiens
cacccacctatgagctttctggcttggccatcgctgcagttttaggagagggctgctgttcttggccagggcactgtacttgtcttcctgaattgagagcccattaattgttttcctctcctttagggactgatgctttttaaccacctctgtgatggttgcacacagtcatcacagacggttgggaatggtgggctggtattttctgccagctttaattaaggtcctaccagggtttgcttcttttggaagggctggactatggtgaggttattgacttatttattggagttgatgaactagtattaatatgttatctaatttttttcctggactttgtaggatcatttagaagtagcatttgcaagaactgtagagaaaagcttcccattagagatagactgttgactataatgcgttgaaaatgtgaaacttagatgccaaagagaaattggggtctcctttttttcttaatctaagcagaatcttagaaagcaatttatatgaagcatcgagcaggttccctgaaggcatttctggctaaagttgagtcagctccactctagctcttagggctccttagaatagggtgtaggaagtagtcatcagtaaatattcatacatctgtgcactgttcagagcagtgtacatcgtacattaggagacttgaggaataaaaggatccctacccactaggagcccgcagtacagtaggggaaatgaaacatgcacaaagcaattagagagcagttcagtcaaaatgaagtatgaatttgctcaatagagagcaatacagtcctaatatataatttgtgttttgggttttgtgtttgtgtgtatgtattgtttttttgagatagagtctcactctgccacccagactggagtgcagtggcacaatcacagctcactgcagccttgacttcctgggctcaagcaatcctctatctcagcctcccgggtagctgggaccacaggcgcccgccactacgcccggccaattttctgcattttttagtagagacggggtttcaccgttttagccgggatggtctcg

SEQ ID NO: 120391 - DNA, 1958 bp, Homo sapiens
acatgctatagagatttgtagcctaagagcaataggctataccatatagcctaggtgtgtagtaggctctactatctaggttttgtacactctatgatgttcacacagtgataaattgcctaatgatacatttctcagaacatatcttcttcattaagcaatgcatgactgtatgacagaaaagcaaagcaggtgttaaattgggtattttagaaagtctgaggcatgccaaattcttggtgtcttttggtcaaatagattgagaagatagccagggtgatagtatcttccattttgtctagataaatgctggtcctggcgtaattattaataggtccctctttcactctcatttgtcctagtttggacaacatatggtcattctaaattgcccccaaagggaagagcattgataaagttgtaattctcataattgtaaaatacatgtaaaataaagtgaaaaaccacaaagagataccaattctaggaaacttttgatttctatctattgatcgttctctggaataatgatttccaaagatgacggtgcattggcatcaactggtaagctttttataaatagagtttcatggatctcaccacagacctctgctgaatttatactagaatttgaatttgacattaccaaaaatgtagctatgcatgcaatgcaaatgtaccaggcagctttgttagcaagcttttaaaactagcatatagaagaatgtttcattctgtggtttggataatgtttggggtttttggtggtggctatcttgggcctttaagggtaagcctggcattgaaatgagttacctttttgtttcagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggtaggtgcccttggagaagagaaggggtaggtggtgggccttgggacttgtgataccccttcatggcaaacctagaatcctagactgccgctccccagaggaggttctttaagactgctcagctctcctgccaatagcaacaatgcaaaagcttaccccttctcccgtttccccagccccatcttcatgtcctgtggatgttgcttcatccacatttataatttactcctgtctctctgctatggtttgggtgttgaaagagtgaagttctttacctttagtattttaaaaaaagaaacaatgttgctcaattatttattctaaatattgttgttgggctttgctttatttaccctgtttgcatgtcttgttgatgtcttttcagtccttatggcccatcgacttccttatccatgacccagagaggccccagtgatattttgacttttcaaatgtggtgaataagtgagagttgtttgttgagttaactgtgattttaaatattctgattgttgtgaggcacttttctaggtgtttgatttcttgatctgttttcttctatgccaattgattaaacagtgtcttccacagtttgctaaggtgatgatggtgcctggttgttggttttggttggttgaataaagccctgatgctgggagttcattgttgtaggtggttcaagtggtggagtcctgtaagcattcctgtgtattcttctctgaataataatgctgcatattaagcctagcatcctacccatattaccacataaactgtta

SEQ ID NO: 120392 - DNA, 1021 bp, Homo sapiens
ttattattattattttttgagacagggtctcactgttgcccaggctgaagcacagtggtacaacctcgacctcctaggctcaggctatcctcccacctcagcctcccaagtagctgggtctacaagcgtgtgccaccatgcctggctaatttttgtattttttgtggaaacagtgtttcaccgttgttgcctaggctggtgttgccataggctggtcgcaaactcctgagttcaagcagtctgctcacattggcttcccaaagtgctgggattacagatgtgagtggctgtgactggcctcaggtgctttaaaagaaaatctccttaaggccagacattttagaatcagggtctccatttgcttactaagtcctcattgtgttctcatggcacatgattctacctccttggctacttctctgggacatttgtggtccattcttcctgttggtgccaaagatcacaggtgccaaagacctgtgggtaaagatactatggcttgggaaatgggactgacttaaccatagctttagttccctgggtatttgggttcctatgttcctgttaggtgtgagtttttaaagctatactaaaagctgggtgttctcagtctgctttaacttaaattatgaccttgagctcatcacttttacctctagacttcagattttttaaatctagaaaacgaagcagtttcattggatgatctcttccacttgtggttttattataacagatggtaaagtatctggctagcagctagttcttatctcagtgatcaaggcattctggtaagaattgggaatggtcattgtctatgaaacaagcttattaggccatctttaccttttctttactttttcatttgtttgattaaagtaatacagtaggcagggggtgaacgcattctggaatataaggtctagaagtggtacaagatgattgagattgtaccacgtagaagttgtattttgctgttcatgatgacccattgcagcagtaacttaggagggtcagaact

SEQ ID NO: 120393 - DNA, 1019 bp, Homo sapiens
ttgttcttttatgttgaactcaaaaaggcttcatctgcttctagaagatcctccataagatgctcactgtttcagttctggtctctagaattctctaataccagaaatatgagtagcccttgaaaataagattccatttttgttttttttttcttttttgagagagggtcttgctttgtcacccaggctggaatgcagtggtgtgatcacggctcactacagcctcaacctcctaggctcaagcaatcctcccaactcagcctcccaagtagctgggaccacaggcatgggtttttgtttttggttttgttttgtagagacggggttttgccaagttgcccaggctggtcttgaactcctaggctcaagcgatcctcccacttcagcctcccaaagtgctgggattacaggcatgagccacagcaacctgccaaatttcatttttgataagagaaattctagcctaagctgtgacttgtatggaaaatattttagaaggaatgtttcaaaatgtaaatgagatctgaaattctaaaatattatgttatgagatgataggctatttcatctttgaagaaggaaacctgccgtcagttgcactgccaccaggtggtggtgattgtttgttttggtggtcatttccagatagttctgtgtgagtcaaagtcggtatgaaggcccggcatggtggctcatgcctgtagtcccagcactttgggaggccgaggcaggtggattgcctgagcccaggagcccaagaccagcctgggcaacatggtgaaactccatctctaccaaaaatacaaaaaattagccgggcatggtggcacacacctgtaatcccagctacttgggaggctgaggtgggaggactgcttgagcctgggaggcggaggttgcagtgagccgagatcactccactgcactccaacctgggtgacagagtgagacccagtttcaacaacaacaacaacaacaacaacaacaacaacaacaacagcagcagcagcagcagcagc

SEQ ID NO: 120394 - DNA, 1048 bp, Homo sapiens
gccccattcatggttggtgacctcattcacccatgcggcttcagctgtcgccagtataccatacacggtgatgctcaaattaatatctatagctgtggcctcttttctgaaccccacacccatgttttaactcgttatgggcagaacttttaacatctcccagacacaatttatatctgctgggcatggtggcacacgcctataatcccagcactttgggaggctgaagtgggagaattgcatgaacccagaggctcgagatcagcctgggcaaaacagagagaccctgtctctacaaaaaataaaattagcctggcgtggtggggtgagcctgttgtcccagctacttgggaggctgaggtgggagaattgcttgagcctaggaggtcgaggttgcagtgacccatgatcacaccactgcactccagtctgaattacagagtgagcgcctgtctcaaaaaaacaaaacaaaacaaaaaaaccaaccttatatccttctcattggcacccccctgagataatcgggtcagaaacctgggagccatcatttgttctgtcattcctaatcagaaactgattcctattggttccactatatcctgtgtcctggagatcaaaaacaaataaatagtaaatagtacttgccttcacagagctcttaactggactcatggcctgtgggccagtgggaactttggagttgtttctagacatcctagaattagtgatctcatatatgtttttggagccagtggcaactttagaaatgttaatattagaaagagtctcatagtgcttatgtgacatcattctttgcctaaagcctttgtacctactgtaatgaagctaaactccttggcacaggatataaggctcacgatctggcctggactcattttcactcccatcttcagtcatcccctaactcccccacagtcagtccccaaagatgccatatgctttcacttctccatgcccttgctcatttgtctcattgcctgaaatatccttttatttcaccaaactgctgctcatcctcaaggccctg

SEQ ID NO: 120395 - DNA, 1034 bp, Homo sapiens
gtttctgtggaaaaactggcaacaatcagatatactgtgaaaatggacatgtgttaccttttagtagagagagctgtcccctaaacgtgggcctgtgcttcatctccatggctcttcatggacatcattcttaggttctacagattcagtgtgacgtgtggccttccctggagtcacctgaaatacttgtcttgaggaactgccttgcttttgccttttgtgcttcttcatagggttagactattggtcagaggttgttggttctgataattccttttgatcagttgtgtgagacaatatatggcttaggtatatgtggttaggtttatgtatgtatgtgagaaaaagaaagaggcctcttctacagtttcataataaactgcacccagcataggaccattgattgcctaacatttttttcttttgcttgaactcaggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggaggtgagtatgtccttgtgcagcccagggtaaaggaactaaggtaacatcttataacatccccagtgttgctcacagagcctgtcaaattgcataacagggcatggcctctttttaacagtcacctcatgcaggtaaatgatttgcattttatgactaattgattagtctagtgctctttcttttatcctaggaatataatttagtgacctgtacgaggtattatattttgtgttctaaataaatatttagtagtgctgttgtttttattatataagctggtagatactgtaagaatactaaaggcagtccttgttctcaaagtctctagacacaagtcatataaaacagataatgcacaaaatgtgcatacttcttccaacctacttgtcaaactgctaa

SEQ ID NO: 120396 - DNA, 1586 bp, Homo sapiens
acggctctccttgagggtggggacggggcggagtaatggtctggccagaagcctcccccgccccccacggctggaccatctctttcctccttcctacttttcgctccatcgccccgcagcggtgaggtcacgcggggacgtcacgagtttgtgacgacactaagaggcgggcgtccgggagaggaaggggcggggcctgggcgggcgacgcttgcgcagtgggcgcggcgcgggaggaggcggaggcggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggtgagccggccccgcagtgccagcgctggcagcggcctcgggggccccgaggggaagggaagggacacttgagcttggcggcagggcgagccaggcgggtactgagggccaccccttcccgggacggggaggacgagtcggggagccccgtgggcatagggagtatttgggggctgagcagggctaaaggagagttagggaccacggaggcaggaggggcggaagggagatggtgggggcgagctcctaaggtttttcgaggattaggggccaagggacgtgggatgaggggaaaagacttgggcatccaggcatagtgggtagacttgggaggaaaagggttatggtgttggctgagagtaaaaagcacaggagatctggatttggggagtggggaaaaaggttggggtttggagtgaggggctgaggatgccaggattgggcggaaactatagggaaggattaggtgctgtggaacaacctgagcactggagagcttgggagttaggagctgagaacagattaatttatgtgtctgtctctttccatctgaggatagatagggaaaagggggtgatattatgggggaagacaagggggtatggtgagggagatgactttcttgagagttatgccagggaggagtaggatctactagtaaatcgacacatggaggacccggagtgttagacttgggacagggcctgggaaccaccttaggaaaagtgggggaaatgagatgatcttgggggaaggaactttctgaagggacaggactcctggcagagggttcatctggggtcaccagaatgctgggaatggagaggggcttatctgaaagaaagctaagttgacagatgtttgggaaaatggagaacttaggctgggagccaagtatttttggcttcaccttgtagaaggctgaattgggacagaa

SEQ ID NO: 120397 - DNA, 1169 bp, Homo sapiens
gagttcaaggttacagtgaaccatgatcatgccactacaccccagcctgggcaagagaatgagaccctgcctctaaatcagtacatgaataaaaataaaaagtcaggtttagcttttccagccccggccccggcccctgcagccgcagagatgttgatgcctaagaagaaccggattgccatttatgaactcctttttaagaagggagtcatggtggccaagaaggatgtccacatgcctaagcacccggagctggcagacaagaatgtgcccaaccttcatgtcatgaaagccatgcagtctctctagtcccgaggctacgtgaaggaacagtttgcctggagacatttctactggtaccttaccaatgagggtatccagtatctccatgattaccttcatctgcccccggagattgtgcctgccaccctacgccgtaggcatccagagactggcaggcctcggcctaaaggtctggagggtgagcaacctgcgagactcacaagatgggaagctgacagagatacctacagacagagtgctgtgccacctggtgccgacaagaaagccgagtctggggctgggtcagcaactgaattccagtttagaggcggatttggttgtggacatagtcagctacctcagtaaaattggagaggattcttttgcgttgaataaacttacaaccaaaaagaaaaaaaaaagtcaggtttaatgagggtataatttacatacaataagatacacctgccaggtgtggtggctcactcctataatcctagcactttgggaggctgaggcaggaggatcacttgaggctaggagttcaagatcagcctgggcaacataaaaatcccatcttaaaaaaaaaaagttaaaaaaaaagacataaaatatataccttttaggggagctatcccttttatgtggaaggcgttccagctgggggctacatgttggtgatttgaagtctctatgtgaaaaaaatgagcttcagccattgcagcaaaggagttacttggggcaggttgcactcgggtctggactgtggcggtctcaggtgtacaggcagtgtattcaatggaaagtgggtaagcgctggactctatttgggctcaaattctctttttcccacatattaactatgcaatcttgttcagattatatca

SEQ ID NO: 120398 - DNA, 1378 bp, Homo sapiens
ctcctcctcctgcaggggcgatgataccacctccccccagccttcgtaagtttaaacttttaatcttaaggggtgtgacggggcaggctatcctttgattaggttagattatctcaccgttggctttcaaatgctgttgcatttgtatgtagatagtaatataaatgtataaatatataaatgttgaatatagatgcaggtagtaatagaaaacaactttagtggtataatttctaaaataactttagagttaacttttgattgcattgtcactaagatactgtatttgtggaatcccaagtgtggatctaagacagatttaaatggaaagaaagctcagaatgaacctgtgattagatgagctaatacatgaataggagttgctaggtacattaaattatttactgctatgagcccagcactggaggattaaaatagctgataaactccttagtcttttgccctattttctaacccacctaacaccaaaatctataccttagaaagataagaattaggctgggcgtggtggttcacacctgtaatcccagcactttgggaggctgaggtgggtggatcacctgaggtcaggagttcgagaccagcctggctaacatcgtgaaaccccatccctactaaaaatacaaaagttagccaggcatggtggtgcacgtctgtagtcccagctactcaggaggctgaggcaggagagttgcttgaacccgggtggtgggggttgcagtgagctgagatcacctcactgtgtactccagcctgggcaatacagcaagactttgtctcaaaaaaaaaaaaaaaaagaaaagaaaagaaggaaaggtaagaattagatcattgaaagtggagtggatcatgggcccagctttctgggaaagtttgttgtttctgtgtgacagacaagaggagactgagtgctgtactgggtcgtactgtactgtagctctcctgggaggggtcagactgaaatcacattcaggacctagactcaatcttgcacacaatcacgggtataaacccagggaagtagactgtttgtaatagttgcacactaatgtaggtggaccactaatgccctggcaaaccttttctgggcacctgccatcctaggacctggtcaggcctcagcccatagcaactccaaggttacttctctctccttctctaccttgactggctggcactcaactccattatttttgatagcggaatagtctatggtatgaatttaccataatttacctcactattttctttctttcttttttttttttttttttgagacagagtctcactctgttgcccaggctggagtgcagtggcacgatctcagctcactgcaacctccgcctcctgggttccc

SEQ ID NO: 120399 - DNA, 1054 bp, Homo sapiens
tgaccaacacctacaactcttctggaaaaacaagctgcaaagttactagagtagcttcctaggcagaagtatcagtatgtgtgctgcaggtatcacttagaggagggggagagtgtagataaagagaattcctgccttactgacttgtgagcccaaaacacaatcaaatgacttcaatggctttagcatccttaaaccaggctcacaaattcaaattcttagaggttttagggatgtggtgaactggggaatgcatgattcatctaaagaagtcttctagaactcagcttcagcctatggttgacatttgagaatacaggcttggtgttgccttttctcctgagtttgctttttgttttctgttttttcaaaccaggataaaatgataagattgtgggatttgtgttaaaataattgagtaattagagggtggacggggataggaatgggtggggagtatagataaagttgtccatgagtggataattgttgaagctggatgatggatacatggatgttcattatactcttctttactattcttgtgtatgtttgaacatttccataataaaaagtttaaaagaaaaaaggaatctagacttttgtatgaaatcccaatgttgtcaactgattcaaagtaaattcactatggagactaaagaaaacgagtttccagtttttagtctttggtctatgtccatccatttcctctaagaaattcttcaatataggttaagcatgggcttttatgtcgtatttagaagttagtagtattctctgttcctgtttaaattggtcttaaattctgtacctgttggattttgtgtctttgcatattcttgtgtttcaccatttgtgataaggctatattcaagtttgaatatggttttctcttgaaccctttgctgcaaacctttaatcaaaattatttagttaaaaataaattggtaagatttgatatttaaaaagaatatagataacgtgaaattatgtggcgtaatagtaaaattaatatccatgaacccaccacccagctgagaagtagaacattatc

SEQ ID NO: 120400 - DNA, 1051 bp, Homo sapiens
gcacgatctcggctcactgcaacctctgcctcctgggttcaagcgattctcctgtcttgccctcccaagtagctgggactacaggcgcgtgccaccacacccggctgattttttttttttttttttagtagagacagggtttcaccatgttagccaggatggtctcgatctcctgacctcgtgatccgcctgcctcagcctcccaaagtgctgggattacaggcgtgagccaccgtgcctggcctgaacatataatttttaaagaaaaattttagcagtatatgcttacacattccttggcgaacacagtgccttttttattaatagatgaagtaggaataagtatcacagacattggggaaaatttctgattttctcagcattgggcaggggactgaggaagaggtcacattatagttgcaatttcaggactccaggaagaggtggtaaattatgagtcttgttaggggaaaggccaaactcctggggcttttgtgtttgtttagcttggaaaagctgcctaatcacatgtgacatttgtgtctctgtgtagtctttaccacatacaggctagcctgcctggggaggaactatgactctgtggcttcccaaacctgatggggaaagagagagacgggaaggcatatcaagttaaataaagatatagtgtattaaataaatactgtaggtgtttgataattacttgttgctgatgatgccatttgacctacaggagaatggcccacagcagagaggatacaccagtgagtcatattatgcttatttggacatgaagtttttcagatgataaagtatcttgttggaatgcaccctccttagtagtagagtattttggtaaacgagatttgaagagaatggtattcaatatgattttcttaaatgcctaccctaggccaggcactaatctgggcactggagatgcagtgaggaagaaatataaatgccttttaaagggtttaactcttggttttcatgactgctgctcaatgcaaatagctttaatgcccagtattcatttaaatagaccttg

SEQ ID NO: 120401 - DNA, 1007 bp, Homo sapiens
tagagattgcaggtggccgagatcgcgccactgcactccagcctggtgacagagtgagactccgtctcaaaaaaaaaaaaaaaaaaaaaaaaaaattactgcagccaagcacagtggctcatacctgtgatcccagctatttcagaggctgagacgagaggatcacttgaggccaggagttcaaggctgcagtgagctgtgatcatgccgctgtactccagcttgggtaacagagcaagaacctgtctcaaaaaaataaaaagactactgtattatcattataaaataatttaaacatctaatatgaagactgtgcagaaagtctcccataattctgattgttggtctacctcatttgttgtagtgaatatggctttgccgaaaaggtggtggaagggatgttcatcattgtcaattctatcaccatcaagattcactccaaggccttccacgcttcttttgaattgtggcagctccagggctatagtgtcaaccccaactggcagcagagtgaccttcgccttacccgcatcactgacccctgccgaggagaggtgacagccccatcattgtgaagggagagaatgggggaatattcaaagtcagactgattcttaaaggatattattcccattttgtggatttcctcaaatgttccccattcctgggaacccagaggcctttctgtccagtgttactgctacatcctttcctcaattatggatccccaattcactgctttttcttggtgggatcccaactgagagtgctgggagtctctgccttgccagtcttttttccttggacttcttgcttcttggttaatttcattcacaggattaagggattgtactttctctccttccaggttttaacatttaaggaaataacttggcaaacactccgaattgaggcagatgctacagacaatggtgatcaggacccagtcaccactccattgaggcttattacgaaccaaggcaggatccaaatagccctcaaaagaa

SEQ ID NO: 120402 - DNA, 1048 bp, Homo sapiens
gtgaggccatggagacccgaggccagtgggcccagaagctggtgatggaatttcagagcaaaatggagaagtggcatgaagagacgggtctgaaaccaccctggcaccttggagtagactctctctttcggagaaaagcaggtgggttatgaggaactggaagactccagttgcttagcctcttgccatttatctttgaataacagtggagataaagcaagaactagctaattatcccagctgtatgtaatggagagacatcagtgacttttttctttacagagacctctttgactccagggatagccacagtgttgatgtcatgtcatcatttctattcagtagactgttgccttggtcttaagaataatatcatttttgagttcatccaggagctagacagtgttaagctctctttcctacatataacattaatgatcttaggatttttactttccttattctattagtaatgagagttgaatgtatctgattctttttcccaccttatttttatttagattctctttccagtcctcgaaagaaccctcttgagagaagcccctctcagggcagacagcctgcctttcagcctccagcatggaaccgcttacgctctagctgcatggtggtacgggtggatgacctggacatccaccaggtgaggacatgaggaaacatggttggaaagaggtggagcagtttacttggaaggcagctggaacagtataaacaaagttttggaatttggggactatttacctcacttctgggaagattaatagtttggtctgtttctttctgagcatggctggtgagatcaggacttgggaattcccccagttttactgtgaatgctctgctttgaacctcccgctgaaaaaactaactcgcgtatagtgcgaggcaggtgtgagaacacctggaatatatgtgaaagacactgtgttccctgtgacagacttcagagggatggtagaggctttatgcttcctaagcagaaatggagggctgctctaagtttgattgttgatactaacaaaaagtt

SEQ ID NO: 120403 - DNA, 1010 bp, Homo sapiens
gcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaagtaagtggctctgtacctccttcactcatcccatctccttctcctagttctgatcattgggtttaaggcctcttactatgtgcatttctagattgggaagtaccatatagtccaggagaatgcatagaatggcctatttaatgggcagttttcaagccaatatttattgcttcttagaatcagattatctcctttttcactgattcactattttttcccctcaagacaggccttaccgtgttagccaggctggtcttgaactgctgggctctgcaatcctcctgccttggcttcctgagtagctgggattatagacacctgccactgtacccagcttgcttcacaattattgatacaaatatgctatatcagaataataataatggcatatatataatattattttcagtgggctttcatctaatttttttgtttgattt

SEQ ID NO: 120404 - DNA, 1022 bp, Homo sapiens
aatcattgacataacttgtggatttttctccttgaactcttcctccctgttccctttactggcggttgttgcaagatggtattaccgtatttaactgttaactacttattgttcctcaggtgaaagaactgcctatcctacaaaaagaacttatagaaactaaacaagccttggccaatgccaaccaggataaagaaaaacttcttcaggagattaggaaatataaccccttctttgagctctgaaaccagtggctcagccatctgtgccaaggagagaggctatcaccagcaatagcaccacctaggacagagggcactgtccagtgctgaataagtcactacggatgccagagggactggggagcactcacttcacttgtgtgggtgtgctttccactagctgttcttacttggactgaggacaagggcaaagcatgattgtatcccaggaaactggggcttgccctgtgtgtggcacaagcatcatgtcttgcctgtataaagccttttggtcctctgtgtactaggtggaatcttctcaacactgtagggccatttcacctcatggtttcatggcagggacatttgcttccttcacaggcctgtgtgaacaagcaaaagtacccacctcctcggtcacccacagagccaccaaagattccatgtcccagagcttcccatagcagacctgaaaagtccatgacctgagctttggccatggtagtggagtggaacaggaaatagtccagcagaggagtgtgggggaagggggcaggagaggcacaagaataagggagacctggactctgcctttttgggaaaaggaaccaagctcatagcaatttggctgataacacaatcagatttttccaggttaagcttcctttctgttatactttcatcattgtgatgctgtggtagaaagtaaataacagtagtggctcagtcatttaatctttcccctctataatacaacttacttgaaatttaaatcaagaaaaaatttctgacgctgagcta

SEQ ID NO: 120405 - DNA, 1001 bp, Homo sapiens
aaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagccactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatg

SEQ ID NO: 120406 - DNA, 1041 bp, Homo sapiens
cctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccataatgattgttgtatatccgttgataagaatctgaaatatatgggcttttatattgtttattttcatctcagtcttggggggggaattattacactgtttttaacagtgcttgaagtactcttttatgagataaaattttaatggttctactagaaaaagtgctcaaattttcacaaaatagccaaaaccagttgtattggaacaccaaaaaagaatgatcaacttcccattccaaccagctagacagaaaatgaatacacctagggcaagttggaaaacagtttaatgatcactcaccaaaatccacagg

SEQ ID NO: 120407 - DNA, 1159 bp, Homo sapiens
ctcaaaggatcctcttgcctcagcctcccaagtagctgggactgtaggcgtgcactaccatacctggctaatttttaattttatttttatgtagttatttgagacagggtctcactctgtcacccaggctggagtgccttgatcatgcgatcacagctcactgtaacagttagctcctgggctcgggtgattctcctgcctcagtctgagtagttgagaccacaggtgcgcaccaccacccctggctaactttttaattttttgtagagacaaggtttggccatgttgcccaggttggtctcgaactcctaggctcaagcaatcctcccaccttggcctccctaactgctgggattataggcatgagccacagcatatggcctataggaaatatattttaaactgttgtctatgataaagcctgttatgagacgttatactaatattctcttaaaaaggaaaaatgtctgtttatttccttagcaagcttaagaaaagttaacaagaattacaggactcaaaaggattatgtgattagtaaattattgtgtgataatcagactttctccttaccctctgtttagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcc

SEQ ID NO: 120408 - DNA, 1128 bp, Homo sapiens
taatattctttccatgtggaatcatcagcagtaaagagatctatagatctggaagcagaagagctggctggatggaggggactttgctgacatcccctctgaaaaataaggtcagaagagtgggcccgggggagggtgattttcatgatccatggcatttcattacccttgtaaacagatactggagctgtgctcatagccaaactggaaaactagattatttagcaggttttctttccatagctgagccataatcttcccttaggagagatactgtatcttatccttgatggtacagtcagtgcctagaactgaaaaactactcaataaatggatttgttgttttgtgataaggatgatgtcttcttactttgcccaagcctggaaagtaggccaaatatataatagagtttctttcatcttcccagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcagtaagtcactttcttatcattccccatttcgaggctctcacttgaccacacaaatttaataaatttttcttggtgtttaaattttcttttataaactcaaaagaaaataaaacgattaatacattatggctgggcatggtggctcacgcctgtaatcccaacactttagaaggccaaggtgggaggatttcttgaggcctaagtttgagaccagcctgggcaacatagtgaaaccctttctctaatgttatgttatgttatgtttttttttttattttttatttttttgagatagagtctcactgtgtcgcccaggctggagtgcaatggtgtgatctcggctcactgcagcctccacatcctgagttcaaacgattctcatgcctcagcctcccgagtagctgggactacaggcatgcaccgccatgcccagctaatttttgtatttttagtagagacagggtttcactatgttggccaggctggtcttgaactcatgacctcacgtgatctgcccgcctcggcctcccaaagtgctaggattacaggca

SEQ ID NO: 120409 - DNA, 1021 bp, Homo sapiens
atcaaagtatatgggatttggccaaagctttatttaaagaaaaatatatagccttacatatttttattaacagccagaagatattgcaaataagcacctaactcaagaaaccagaaaaagggcctagtggagtgggtcacgcctgcagatctagctacctggcaggctgacacaagaggatcacttgaggcttcagtgagctatgatccagcctgggcaacagagcgagtctgggggagaaaaaaaagataaagaacaaaataaatcagaagaatgtaggaacaaggagttaataaggatagaagtagacactaatgaattagcacattaaaaaacataaatgataaaattaaaacattatttaaaatgtaaatgtataacattacaaaatatgaaaggctataggcactaatatggagatctttaaagttataaagacatttaatgttcaagtttaggccaaataaatgtgaaaatctgagaaaaataggtgattttttaaaggaaaatacaaaccaccaaacttgaagcacagttagaaaacttgtataaatcagtaactaaaaagaaattgaaaagattgtcaaagatagactaccttcatcccacctattcccatattcctgtatgagtttaaatttgaattcctctttagggacaagttaaatctcattaatgagttttgtagtatacttaagattctacattaagtcagagggggtgaagtttggatttgatttttattattaaacagccagttttttaagttcaggggtacatgtgcaggatgtgcaggttttgttacataagtaaatgtgtgtcataggggtttgttgtatagattatttcatcacccaggtattaagcctagtgtcccttagttatttttcctgatcctttccctcctgccacccttcatccttccatatacccttcacccttccatataccccagtgtgtgttcccctctatgtgtccgtgtgctgtcatcatttagttcccacttattagtgagaacatg

SEQ ID NO: 120410 - DNA, 1053 bp, Homo sapiens
gccgagacacgcctctcggggcatggggacagcgccttgtgggcccccattatgcaggtggaaagggacaaacaggcccacctgtacgcgcctcccgaagtgcgctccttccccaaaggttttgggagctcctgggacaggaaatacggtaattcgtccaggcagcgtagaaacaaagagataaatgtaacgcgcacctacatttccaagtccattctttcagcacgcataaattaaatatgtaataggtgcggggacctagtcatacccaggtgaataaaacgccctccccctcgtatctcaatgagggaagagaagaaaattttaaaacagaaatatcctcaccacttcatcctcccagtacgtgaactagttcattaaagtgaaacgttcaaaggagacaccttcctctctttaggctttcctcttagttttaatgagattaaccaaactgatagaaaagtgtcagacttgtaaaaacaaacctcaatcttcagtactggcgaactgaaaaaaatcatttaattgggtagaaactatgtgtgttttgttccctggtactagcactgtttctaaatcgaagtaggcagtcaatagttgtggatgaataaatgaattggataaattctgctcgagctatatgactttttgttgttaaggtgcttgcggaatggaggggaaatgctagcaattctatgtacacacaggcccgcggtttcgggccagttgaaatatacaaggttgagtccttgcctgaaagtttaccagtcccggggagcctcattccacgacaccgccatacaacggaactgagttttctcccagtcccccaactttactctgaggggttaacgaagggattaactgacattgcatttttagacaggcgaaaaggaaaaagttatttagtaaacaaaactgcgctccttcacaagtgctggtttcctagcgaggaggatccatagtctgagctctttacgtccaattttcccgcttcccactgtcgccaaaccaaagttaaaatgagtcctctagtcctctacgcgcgcctca

SEQ ID NO: 120411 - DNA, 1050 bp, Homo sapiens
acacattatttatttttatttttgtagagatcgtgtcccactatgttgcccaggctagtctcaaactcctgggctcaaacgatcttcctgcctcagcctcccaaagtgctgggattataggtgtgagccacagtgccctgcctgacacattttaaatggtgttttttcatgcttggggatctgttttccaagcatggcagactagaaagagtaaataagggagaggaatcattcatatacccaatgtttacccatgatatactttgtgccaggccaagtgattgctagatgcactgcaaaatatgtctgagacctgggacattgtacgtggtctgtcagaattagcccctctcttcatacatgttctgttcccttacagagtttatagtagtatgatacgtctgtgtaacaggccaacaaaaaggagacagagaaagcacacaaatttagcataatttatcctacctcccggctgtttgaagctattaacataggtgtatatagccctatatacctatgtaagccccaagcatcagtttactgtatctttgtgctatgatttatgtttattatgactgttagccatcaaataaagattaaattatgttcaatatagcttgttagtgaaagaagaaaaaaaatatagttttctatccaaaatggtttaaatataatttttttacttaaaaggataagcaatagattatctagaaagcacagttatccagaatgtctaggcttacagaggctctggattgcatggattatactttatataatactaactcattttctgattgtttaatggatgcatgccttcggtctataccttgggagcttgggataggcattctatcaaacttcttaacttacagtattttttagttctgggcacgtagcgggcactcagattctcatgtaacaagacagtttgctatgtttagagttatagtgaaatactgatttccaagaaagaaactcctgtataagaatattgtaagatttggttaaaagtaaattctatcaactaaaaggccaaaaagatctgag

SEQ ID NO: 120412 - DNA, 1034 bp, Homo sapiens
ctcccgagtagctgggattacaggcgcacgtattttagtagggacgggatttcactgtgttgcccaggctggtctcgaactcctgagctcaggcagtctaccctcagcctccggaagtgctaggattacaggcgttagccaccgtgcctggccttttttttttttcttttttttttcagagacagtgtctcactccttcatccagactggagtacagtggtgcaatctcagctcactgcaacctctgcctctcaggttcaagtaattcttgtgcctcagcctcctgagtagctgtgattacaggcatgcaccactgcacctggcgaatatttgtattttagtagagacaggggtttcactatgttggccaggctagtctcgaactcctgacttcaagtgatctgcctgcctcggcctcccaaagtgctggaattactacaggtgtgagcccccacgcccagccaagaatgtcttaaaatactccctttaagtgtgattttgttgggagggcagccctgttcctgcattttggaattgctgtacttacatttttgctttctctaaagcagagtgtggttcccatgttaaaaaacaaaaggaaacaaaaaaaggtaacatgcttggaaatgacttttgtggtagttactttatatgtaaaaatctagaaggtgcctaatcttaaactgagtaaggcatttacttagaattaaagataatttacccagcctgggcaacatggcaagacctcgtttctacaaaaaataaaaaaactaggccaggcgcagtggctcacgcctgtaatcccggcactttgggaggctgaggcgggtggatcacctgaggtcaggagttagagaccagcctggccaatatggtaaaaccccatctctattaaaaatacaaaatcagctgggtgtggtggcctgcatctgtaatcccagctacttgggaggctgaggtaggagaattgcttgaacctgggaggcagaggttgtagtgagccaagatcgtgccattgcactccagcctgggca

SEQ ID NO: 120413 - DNA, 1105 bp, Homo sapiens
agtaaattactgggtttttagcccagaaacactaaggaaaccccagaagtagacagtggagagtttgttcttagaaaaatcaggctctcctgtgggtaggaacttggtctcttttttggagagctctcagaaaatatttcccacactgatttccaaaggattattgggagattttctgtggtagagaaaattatatcgtataatatgttacattcatagaacatcttcacataactttggtgtggttagagttaatggtagtaatactggaaattatatggtatgtcttcatatttatcctttctcagtaatttgtagatcaagtttgtttagtttacaaatcaaaaaagagtttttaaaacaagtcagttgtctctgctttgaaacaagatagttgtatctgtttgtgatattattaccactgatccaggaagcagaactgcctcctggcctacttaagtggtgaggacatactatggtggctaaggatcaggttctgacccaactctgccttgtgacttaggcaaattaagtcacttttctgcgcctctgtgtcttcatatatataatgggcctgggatggtgcctatcttctaaagcagcattaaatgagctaaaggatgtaaggcatataatgcctggcacatggcaagggtttggtaaccctcagctgctagaatcatctaatgggagccaggtgcttgccacccttgatgaatcagagtgaggaccctgttaaggacatatcttttattgatgttgccattttaacatttataataattcacagcagaagctcccaaccttttaaactatgaagagtcccatagttttaaaaagcctgaaaattggcaatggtggcaaagttacaaagcaatccaggtccacaatcctttgtttgaaaccttggggccagatatgttttcagggtgctgactcaatattgtatattgagtccctagtgggactgtggcagcaccctggaaacattgtatttctacagcaaaacctgtaaatattgactaaatgggataaatatgaagccgcttcatatcagcgtaggtcaggttttgcagctaaatgactgctgctaacttatgaaaat

SEQ ID NO: 120414 - DNA, 1065 bp, Homo sapiens
gtgtgtagggcagagaatccttgttcaaatgaatagcagagcaatggcagtataccccttgggtcatatataataaaactacaggataggtttcttgcccttgaaatctcattgtaatagtgctgtgagccaccaagagtttccgccattctagttttcaggttgtgttcaggaaccattaatactttcgcaataacacaagttcttgttcatccagggatgtttatttcagcgttaaattgtaagtaaacaagcatgctacaatttatgaaagctgagtatgtgacctctgttcagtgtcaggatgaaatcaaacgctcataatctgacaccttgaatgatttgcgtgatcattgttgtactgcatgattattaggtaaacagtttatgtaagtaactataattagttataatttttacatggccaaatcaaatgttcacagtttcttgtttatttatttgttggttctccagcatctgtaattagcatcactgtcagcatttttcattgatacctgtgtagactgtgtcctcatcacttgctggttaccttatgttaaaaaaccaagtctaggttttctccctagcagtcctttagaagggacgggtggtcctcggctctattctctctcactatccaacctcaacctcagtagggtcttcagggagtaggagctccagaccctgggaccgtgtggcctgcccagaggttcaacagcacactgttgggatgagagagaggccccttcacctctgagaaggaatgaacaacagattttattttagagtactgtatagattgaaataactgaacatttctcacctaacagatagtaaggatttcaatagacatttatttgcagaattagttttctaccacaaagtcgattggggttagaaaaaggggtgcactagtagggattctttgatactgtggttagatggtcattgaaaagaaaatgatacattttggatggattgaaaagcgaaattgattttggatgacatttttgactggcttttgtgtatttgtgtggcatgcagcagtgaatggctgtgtttggt

SEQ ID NO: 120415 - DNA, 2067 bp, Homo sapiens
ggacatggagatttatggaggatgagaccaagtctcaaccacagtatacttttcaacaaatattgctaattggagttaaagtgttcgttaatgtgaaaataaaattactttggattgagactgctgctggagactgctgtagaagaaaaattagacaaaatgctctctataaagcctctattttaagaagaatgattcagagaggaacataggtccaagaaattttcatcaacaaatgaaaactgaactgccaggtttgccagatgtcttattttaaggaaatttttcctcatttggtctcttgtaaaagtcttccttttgcctctgaaatataccctgtccctatgtaacttaaaaataaaattttcagagtgttcaaagttccttctgtgtaggatttgtaattctgtgtaattcagctgggaattgtattgcataaaaataaaggcaaaaaataaccacattgttggattacagagttttgggaaatttccttaatttatttagtatagtccatcgtggtctgtcactcagcatttgttgagtgcctgctgtgaacagacaccgctacttgttctttaaggcggcagcaatgtgccttaatgtggttgtcctcattaatgttctaccctatggtcgtcctaccttacatggtataatagagtagaatggctgatatttaagggagggcctctcccctttatttagacacacaagtcctgggcatctctcttttggggacaacataaaacacccctgcctagtcctttatttggtccaccactaatcctatcccagcatcctgtgtaggcctccatggggcctacatactctgtcaggggaagagccaggagagaaggaagaaggctttgaagagccagccccagcagcctgctgacagttttccttctctccccactgtggaaggactgactaccagtggagaggtggcagcaggcttttggctaagtggagaggctctctcttcctgtgtagtttgtggagaggcagcgttgactcaaggtacagttagaagtcagcgatgctttcttttgggactttccatgttgatgacctcttctctttaagtcaaaccaagctccgctgccccacagtgttccaaattacttatcaaaattcctatgaccactgtgtagctagattcaacttgatgttataaaaccagtttttgtaagataatctgtattaaagtgcaagtgaaatggcactctgttaaactaacctgaaatctgatgatgtgctgtgggaaaagagctgtttgaatagaggttctttgcttccttccagctgggtggacaggaaagacatcctgtccctacagaactgactgccactgctccatatgtcctccatgctcactggcctcttctccggacctaagacccgaaggcctatggcccagatgggtctcacctctccaagcatggctgcccagcttagggaattatagatgtttctgttctggccaaggaggagctgagagtgggggctgataagcagcttccagaactctgggattgtacaatccctggagagaggaggagactgtctcttgttaccagctgccctcctttcacctggtagtatacagcctcttcctaaagagccttactcaacccccctcactttttctgtctcagactcactccagaaatgtgttttctgttccttgttctgccctctctgccgtgttctaccctctctgccgtgttcctaggaccagaccctgctagttccttctagaaactgattttacccatgattgaaaccaaagccttaagattctgtgggtgtggaacaccttctggttgaaaaccaaaggctgtagaattccatgcagatgtggattgttgattccattttgaaggtaggtgtgatgtgggagaagtcgtgtgtgtagtggttcggagtatggtttctggagccagttggcctaggttcaaatgccagctctccacttagtggtaagttaaacttcctgtgctacagttttctcacttccaaaatgggggtggtaatagtatctacatacacagtcaccatgag

SEQ ID NO: 120416 - DNA, 1032 bp, Homo sapiens
ctagggagctgcacaattaaacttcaaaaatgatcattaaagggattcattctttctgctggggaggtactgagttggctatggttttatattgtgcagttgcaatacttgaatagcacaaaacaatgagactatcatgcaggcagataaggattatggacaaacacaataagcattggaactttgaggagaagagagctgcatttttatagcttcatttcttcatttgtccaaaagttaaaaatagaattaattatgccccataggccacctggatttctgattgatacagaaaacttacacaacatatctaaaggatagcctatgtcaagactttctttatcaaaatatgcctttgggtcaaatcatagtctcttctgaacacattttcgtttgttttttatttttattaagcctcttccttagtggatgaacatggttttttaagcaacaaaatacacgggcttagaaagtagggtttattgtccctgtagaaagcctttagattagtaggataagctgatgagcaacttaatgtctactttctatgctaagaatcactagagttccagcctttttataacatcgctacattttaattttttatttgcatatttagaaaacaataacttggaaatgacacagtctcagatgattagcatccatctgctgagctatttctagtgcaatgggcctggtggacctacatggtaccaaaggaatcttcaccctatctggtttgtcgttagtctctcacccaagctgaggggcacaaggactgctgagaggagcttccaaatgtagcagctgatgaagactttgggtctcactttgtcatccaggctggagtgcaatggcacaatcgtagcttactgcagcctcgaactcctgggcttaagcgatcctcccactcagccttctgagtagctaggactgaggtgcacaccgccatgcccagctaactaaaaaatttttttgtagagacaggtctcgctatgttgcccaggctggtcttgaactcctggcctcaag

SEQ ID NO: 120417 - DNA, 1056 bp, Homo sapiens
cacagtgcccggcatgtctacacatgcaatcagtttttaaaggaatggagagaggcctttgaggggggattcaaaagccacagggcctcaccagtcatattcttccatgccctccacagtgctttagatgccatcccaaaacataggtgccgccgaggtgcatagggcaaggcttgctgcgcttcagcatcatgtgaaagcaggttagcttttttgacatgctaggcctctcaatactattatacttgctcaaacttctagaagtttccatgaatgatttaagtcctggggagcccatcatggtagactttacaaatgcagagacagtagtgtggaaaatcaagtgaattgtccaaggtcaaaaaatgacaagtggcggaggcgagttttgaagtcagtttggctaaccgcagagcccaagctcctaacttaggttccatagcttcatcacgcaggcttgctgtgactgctccaggacccattaagatcagtctgagcatttgtcttgcaagtcaagggcagctattgcatttctgcacaatctttacaggttaaactttgcttaggaatctcctaggctgtgtttaaggttgttttctctggttcttgatgcattatatgctgcttttgtttgtcggtgagcagccctttggtgcttacagttttagaaaacctaataggacagctgtgatagggaggaagacctagattgtaagtaactcttttcttgagctgccaaaaaggaagaaacttgggtggagggggatgttactaccatcctgtctgaagctgaaataccaaacaaggagattagagttctccagtttcgtttagattttgtttaatgtgttccccagtccccaaaacttctagatgggcttttggaggagaaggtagagaaaaagaaggaaaaaaggcctctggttggaaacgttgctgctttttgcagtgaagtcactatcttttttccttttcttttctaattgttttgagggagttttagtgctgacataggatgtccaaacttaatcacctttaaaccagtcatggaggcaa

SEQ ID NO: 120418 - DNA, 1090 bp, Homo sapiens
aatgcagaaacagaaataagaacaaaggctttgaggattaagtaaggtaacatttcagcttccctcctatggtatttttaagtcagataagacactccaattatagattgttatttttttaattaataagacatctttacaaaggaaaggcaaaatcgtctcttgcatcttaagacacgtctcctggtgcttttttgtccttgatccttgctcgttggctcgtcttgattatctgatctgtgttgaggtctctctcaaaccttcagtcaccagtacaggagtgagaggtcaatacctgtgactggcggagaggtttggttctgtctttgatgacctttcaatgagctgtttttgcaatcctgggagtactagaagaacagactcttaagcgatgacactgttgtcttgaaacttgactctgttcagcaaaccattgcagtgtaccctcagtgctatgcatctctgcagtgtatagctgctgtgtgttatcaggagtcatttggaagtaactggtctggttgaacaccacacagaaatctttactaattagctagctatctctaactttggtttgtgacttcggtctgtgaaatctatgtctctctcttttttttttccctgatagcatgtggagagggccaaatgtgaactgtgttgacagcactggctacacacccctgcaccatgctgctttgaatggccataagtaagtatcaatgtactacattcctgccttcacccttcagaacccaggccttcacgttgccttttcatttcctagaaaagtttgctggctgagcttagtggctcatgcctgtaatcccagcactttgggaggccgaggtgggaggatcacatgaagctgagtttgagagcagcctgggcaacaaagcaagcctccatctccacaaaaaaaaaaaaaaaaaaatttttttaattaatcaggcgtggtagcatgcctgaagtcctagctactcaggaggctaaggcaggaggattgcttaagcccaggagtttgaggctgcagagagctatgattgtgccattgcattccagcctggttgacagagtgaccctatctctaaaaaac

SEQ ID NO: 120419 - DNA, 1189 bp, Homo sapiens
atttatatctttggaaaaaattgtacttggattatgcaagttttaaacaagcctcttacaaatacaactccctgtcatttgggttggaagttgtgtgcaagtttgagaggagacgggcattccttatatgataagccattctcccctttcctctctctgctctgaactgaagcagatacttttctcagttcctagaaggagggagatattgatgtttctcagtaagcttaggactatttttctaatgactttgccgagaggggattgttaaattacctgtaggattagatcaaagttttccctcaaaaaataggaaattatcctggcaagtccatctgtcaggagactcatgcagctctcagttagctgttaaaagcatgactttgattctgaggggggcagcttcattctgagacatgagaaaattaaaatagtgctcccaaatctcttgatttggagattgtgtgtatatagctgttaatcagccttcctttccccttttgggctgtattttctgggtaggtgagcaacagacatttaaaatcatcagtgaggatgtttgtttataacatttgggaatgaaaagtatctgtttagaattacttctttagaatctaagtgcaattttactccttctagctaaagtggtcatttctcttctctggaggaaatgcataatgaagtttgcttgtaactaatattcttcaatgttggaaagactggtcatccattaaagtccttctcatttaagaaattttcagcaaccatttctaatcctctttgctcacgtttgccttgaaacacagctgcttggatttttgagctacttgagtgtgctagcttaacctgctcacagctgcctcctgcttggagtatcagttgataagtgggaccccagcccagtgctttgagtatctggtaggcaggtggtgggcagaagctgggcaagatgtctgcagtagcttgaagactttaatggatctagctagtggttacaagtactatattgattcattttaaaaccattaatatggttccagtaggatgcttagattaaaggggggtaagagtaaggtgctctggaggttgtctttcttattaacttccctttgaggcatccagagggcagattcaagttgttctagggttgggttccctcagggctgtgtattgctttgatatatttcat

SEQ ID NO: 120420 - DNA, 1102 bp, Homo sapiens
ttccccttccccttccattccccttccccttcccttcccctttcctttctttctttcattttaaaaagggtctccctctgttgcccaggctgaaatgcagtgattggcctgctctttaaattctgttttctagtcttcagaataggaagatactcttatcttagtttttttgttttttgttttggaagtagagtgatagagtgaaaaactcataagtcataggctttcatgtcagaccagagtttaagttctggggtgcgacttattagttttgttgacttaagcaagttacttaatttctctgagcctcagtttcctcttctgtaaaatacggcactataatctaccttgctggattgttttggagtttaaataagataatatatataaagtaaaaatatctggtaactagtaatatttgagatactaattttttaaagtgtatgtaatgtatttctgcaaaggcatttttggaatctgtttttgttactagtagatgacgcttaatgaaacattattcagttagtctattcagagttttcttttatggggaggaaacttgaagtgattgttttcccaacagtggttaatttagtgagcttataaagctttgataaagggtaagactttggttcttgaaagtacattttcctatcctttaattttgcacatataaaataaaattagtttaaatgtagtaagaacatacttctttctttggaaataattccctttgcctcttccctgaaaggccaattgatgcaaactacattaagagtaaagctgaggccaggtgctggaattacaggcataatcccagcactttgggaggctgaggctggtggattacctgaggtcagggattcgagaccagcctggccaacatggcaaaaccccatctccactaaaaatacaaaaattagctggatgtggtggcatgtgcctataatcccagctactcgggaggctgaggcaggagaatcgcttgaacccaggaggcagaggttgcagtgagctgagattgtgccactgcactccagcctgggcaacagagtgagactcaaaaaaaaaaaacaacaaaaaaaaggaaagctagccagtg

SEQ ID NO: 120421 - DNA, 2194 bp, Homo sapiens
ccaaagtgctaggattacaggcatgagccaccgtgcccggcccctactagttatttttaagctcccatgtaattccaaaatgaagccagtttgagaatcactgatagttcttgccctgatagttgtcaggctcaaaaagcctacagtaataagagcttatcgtgatggcttgtgtcagtgatggatgtggtcaccacagatataataaacttgggtattacagttaccagaccatgtctggcatgactgaaacctaagtaagatgctccctatactgtgtctatgagtgtaactttctgcagagatgtggttagaccatttttaacatgaggcaggaaatttgccagtagtgattatgaccttgcctttagcagggcagctttgtgagagctgctttcattctggcgaagaagaaatagagaaaagtttttttgtttttttggtttttttttttctttgctggatggtttagacttttacagttctttagccctaatggcatactttttataaaatcaaggacaatttattctggttgttgggagacaacttggatataaaagagacagtagtatttgcttcagagtaaatagtttttctggattggaattttaataagaataagctgactttcttggctctttctatcacactcatcttgagatgtacaacctggagaatccttttaaacttctttgggttactactctgccccagaattactccacagaaagatcctgtgagtttttgttaatgtaggtgttggttcatcaggagaaagtgataatcaaccagagaaatgttgggttaaaaaagagagaaattgaagggacagctctaagtttgcttaggaaactcatggcatagcttaatagggccttccaaatgggtatcctaaaaggtttgtttggcacagggaggacctcaaagacttgctttctgcccagcatttccccttcctccagactttcaggttacatggaatttgcccctcagggcccagtcatatcataggaggccatggctggcaggccggctgtatcctctggccagcgaaggctgttggcactttcctgacagctgctctccttgagttgtgtttgagctcagtgcagcttcctctgcatcctctgtttatttgtgtgcatttatctttgcatgtgtcctgctactactttttctgtccttatttcatttaaaaatttttctttgccatcgttctcaccttttggggagttgttcccagcagctgtggatctttctggtatacttggtatagttggaaaaaatgatgcagtcaaatgccagatcaaaagcagatggaattgcatatgcatgtttgggtaattcctaatccattacttttagtgttattaatagaattaaagcaattgcagaaacatttaattttgaccttttgaccactgaaaggtgcacaatattgacttaactgacaaaccccctcttaagctttctttcccaaaagtagcagaagcctcctggataaatttaggaatctcaaaatcttgtgggagaattattttcatcagtgcttctcaaaaaggagaggtcatgggacttactttatttctgctctaattagacattgtcagtagtaaaagagcataattggaatgactaacattttgcctctggtggttgataaagcacacaattctcccattttatcccaaattctgtctttagtttgaaacaaaattggcattagaggactgtgggttgtgagcttgaattgatagcaatattacatttgaatattttgcacctctcacacaaaacatgccagcgtttgcctctttcttacataagaaacatcttcccgtgctggctgccattttaatgaagtagatactgcatgcgttgcttggtgcaggctcctggggtaggcacagtgcagtgtcagggtcccttatttctctgtgactgagcccgagtgccccctttacctggaaatggcttttggctgataccttgagcgatttttagtctgctctgttacttttcactgttggctgattgatttgcatgcaagaagctgtgcagatgaaaaacttttattaaaaagcttatgtgtaaggcaatggatggttgacaaatccagaatcagaaccatagggttgaatgcctacaaattgtaaaaccatttgaagtttaaactgaaataatagcagtg

SEQ ID NO: 120422 - DNA, 1011 bp, Homo sapiens
agagaagtgatgaaattaccccccaatttttacatggtgttgagagtagtcattaaaaaagtttgatctgtcttctcgggaaattggtgtgattgtcctccaaaaagtgcaggtgctgtgggtaaagatgatggcttaaagagagcagaagagatgaggaaatcgatcttacatagttttcaagagatgaatgaaaagctcactgagcctggtaatcaagctggcatttgaattattgctctagcacttactggatggtgactattatttagggaatcatttaacttctttaagcctcagtttctacatgtagaagggatactaattcttacctcatggttgttgtgaatattaaaaagaaaatgcttggcatagtgtctggcacagaaggagtagtactcaataagtagtagctgttggaagccagctgagttaggtgaattggtagaggactcaagtcagttgtttcttgagtatttaaaagggctcaacattccagcaactggagaagagaaagcaaatggctatgaatacccactacaagaactggcagaagatcaaggggagcaaagacagcaaatatgctattaaattaggcatggttagaaatcgtggctggttggaagctgatccaggcaaagctggtatattgaaaactagggaagtttgggggccagaggtcagaggtccaatgacaggtagagaacagacgctttaggagttcaagaagaagggggagatgtaatgaggtaatcaagaccaagtcaatgtgaaacagtccgaagtcccaaagctgggctatacctatgggccccaaggtgagtacagatggctcctaatctgaagattctccactgtgctattacatgtaatcccaaaccaaacttataagaatactggccttccctggcatttgagttttattctgcctctttaaaagggctactcagaataaatcagtctcctttgcagagtcaggagaagggaaaccagcctctctgtgcagtgtta

SEQ ID NO: 120423 - DNA, 1086 bp, Homo sapiens
aggtgtgcaccaccacacccagctaatttttaaattgtttatagagatgaggtctcgccatgttgcccaagctgatcttgaactcctgagctcaagcaatcctcccaccacaggctcccaaagcgttgggattacaggcgtgagccaccacacccggcctctttatcctcatatccacctgggtgcctcctgaggacagacacttcatacatttgtccatgggatgagtggttacagtgacagttctggggcctgtctcagagtttctcacttcagccctctcaccatattaccttctgtcccttccttctgctgttcagagttataaggatggtgaaggtaatgaatgcttgtgaagtgctttatatcttacagagtactttcatgtaccttatctttgatgatccttgtgacagacctgtgaggaacggagaagtagttggtctcatctgtgagcaaagtgtgttgtaacggaccctgtgtggaggataataacaatttcaacatctattgagagcgtggcatgtgctagacacggttcttaatgcattacacgtataatttaattaccgcaacaatcccccaattaagatcccagaattgcacaaagaagtgatttgcttaaaaactgcttcttgatcagtatattctattgttagcaccttgtccctaagagaccttatattatccttactttgcagaaggaagaaaccattgagtaattcttttcccacccattgatctgccaaaaaaaactcatcttggccttggatgtagtttttaatgggaacaagaacaccagccttagggtcttggatctcggcaagcttttcagataccaaagtgtctttcttaggaattgcctggctaagtcatatgattataagaatttctttccatcatttcttatattccacaaaatattggtggattgtggtttctctaataggattatgaccctcagagattcttcctccacatatttccttcctccgtaagtttccattctttccttctacccacttccttccccttggcatgtgtctggtattgagcccttggcatctgtctctctttcatcattga

SEQ ID NO: 120424 - DNA, 1787 bp, Homo sapiens
agacagcaacaggagaggtacccaggcaggcatctcacatccctaagggggagaagtgtgccatcatgacatggtggagacctggattctcatcactatcatgacattaaagggatttttaagtatcatgcagcccagcccagtcactttagacgctgaggcccaataagatgaaatcactgccaaggccacacagctagagaacagctcagccaggaccagagccagatcttcaggcttctaggttgaagtcttctcctgcaccacctggggtaaccactaagactcctcatctgtaaacatagttgacccttttggttctaagattctctgagctcatgaatagttcttgagagttttgagcaaactagggaattgtttggtataggtgcaatagatcccacttatagagaaggttaagttgaatattatggaatgtgagctagtgctggacatagtgttatttactctgatgatgtgggttaaaatctttaatggggctgagttcatgcaaggaaagcccctgggtgtgccagtgtagtgctgatgttagattctgatttggccaattatttatgctacttcagggcgaggtatttgagtgtacagtagtagctggcctcatgagctagtagtgtcagatttctaggatgttagggaagtctcgagagaactgcaaatgtctcctggcattgacaaattagaccattttgttttcagtggatcaactaaggttaaacttaaacaaatatgagcagctgggagattttggaagaagcaagatgtgcacattctcaaaaaaaaaaaaaaaaaagagagagagaaagaaaagtctgtgctccctgaggaaggaaggatgaggcgtggaactcggaatggccccctccgaggaaggaagcagttatttctctgccgttttgtttctgttaaggaattccagaagttgcaggttgtggatcatgacctcttttttttttttttttttttttctgttgctgcttgccagaggaagggagggcgggtggcctttaaataacactttggcctttatggaaatgtatcagatgttccaggagtgggtctccctgctcgcgcttgctcactggtgctcttacttttgcttcatgttcactcactctgtcctgacttgtgtcctttctctaggttatacttaacactcttctcgccttatatagcaaggtctggtcgttaatgttaacagaaatctaacaacagggaaggctgccagatagcattaatcaggccagtgtttggaatttcataaatgctctgactttgggtacaaattgaacattaagaacaatatgaaaactgtcttccttcctctctcttcttctctcctctccccctccccagcctatccagtttctctctctgtttctctgtgaattcctctgctttgccatatgcttgctgcattggaactttgttgatttttgccacgtttaattttttatttctctgtctctccgtccactccaagaccacaggcggagcagcagcagccggagccaggactctgcggaggggcaggacgggcaggtcccagagcagttctcaggcctcctccacggctcctccccggtgtgcgaggtggggcaggaccctttccagctgctctgtaccgctggccagagccatccagacgggtccccccagcagggcgcctgccacaaggccagcatgcagctggaggagacgggtgtgcatgctcctggagcctcccagcccagtgccctggaccagagcaagagagtgggctacct

SEQ ID NO: 120425 - DNA, 1032 bp, Homo sapiens
tgtttggttttctgttcctgtgttaattcactcaggataatggcctccagctgcatccatgttgcctgaaaaggacacgagctcattcttttttatagctgcaagaggaaggcttttctattccctgcttctccatggttattcttactgtgctgtcctggaaggccaaatacttcttccagcagaagggtcctgcccatcccacattcccagattggtcaggcagaagagggataagtggttcaggaaatgaagattggggagtagaaaacattgggagtcagaggcccagttttctttcatagccattattagttggaaatatgtaccaatttctctgtgacctatggcatgtctcgctgagcagaagaatgtgtttctcaaagataggtaaacaccatgggaatgttaaagtaccacccttgcaagcttcttactgagtggaagctgcctttgaagtggactgggtctgtctctgaggaataatttcaagaactccatttagctctccaagaggaggggaacactacagctgacatgtccatttgaacaatctgtacacttaatgccctacccaactctatttgggtaggtgctggaaagttatgtaaaccaaagccaatccatttccagtgaaggaactgggttgggggtgggggctgtgcttccagcgctacctccagataaggtataagatgaagcttaagattctgattaggcagagacagaggaatcctgtgcaaaagattttcattgcttagtaaacaaagatttggtgagcctgtgctagatgcctggccacttgtggaaagtcactatgagtgagatagctctgggggaggggggtgccaggagattacacactggagtgtgtatatttgtaggaatgtatgctctacctttgttttttaaaacagagttttactaatttacagtcagctataggaaaacttcaagataaatttaagaggaaggtgaagataagtgcagtgtgctctgaaatggccatagaggtcaagagagaaaaacatc

SEQ ID NO: 120426 - DNA, 1153 bp, Homo sapiens
cagcatttctgggcagccttatgggctccactgtttcctcctggccaagaaatacaaaatcacctgggcaaagctgggcttaattgaggttggctgtgtgggctcgtaagccagtgtctctttgcatcgagaggagtttcatttgctgatatcacctgtgcagataaaggttgcaggtgcttacaatggcccagggatctacatctatccaagatctaggtgctgtgggccagttctctagtgtgactgaaatgcaaaagccctgctacattttaaatttgaaaaaacttaaaggcaattgaggtcttattggaaagaattcagaagatcaaggtttgcttacgtcctaaacattaacagggccctttatgtgtaacccttcaatgttgtttcttagtgatactgtacttggtttctgtggatatcactctgtaaagagaaactccaaaagtgtttcccccagtgattggccctaaacccagggccttggcaggctttcctggaatagggcattagttaatggctgctccccaccctatccctgaccagtgcctgtagccggctttgccatatcctgttcttgctgatttttttctttgttgtccttggacccccgggaggtggggaactctgctctgaaggctctgaaggtgcttgggcctagctcacctcttcactgtgagacctggggagggagaaggaaggctgtcgggtgggagcccctcaggctgctcctggaaagaagtgcaggaccacagatgggctcaggttcaggagtcagcagatccagcttcaagccccagctcctccatctccacctcggtgcatggactacctcagtaagctcactgttattattcttatttgtgaaactgaggcagttagatctgtgtttcagagtgttttaccaattagagatgtgtttaactgcctagcacagttcctagcatgcataaagtgttgactaaatggtagatattaatgttactatcttgcttggagctgcagagaatgggaactgaggactggagtgtgttcagaccttatgaaatgcagagctcaggccgggtgcggtggctcacacctgtaatcccagcactttgggaggccaaggcaggtggattacctgaggtcaggagttcgagaccagcct

SEQ ID NO: 120427 - DNA, 1051 bp, Homo sapiens
tgttctccagttggggaacatgtatggctaatagatttgggagtcattttctccaaatacagactgctccttattgtgggttaatgcagccctgttgaactaccctgagcaacatgacttctgaaagatggcctggttaaggtaaacctctgtgatcatatctgttaatgacactagcattctccctattttctattgtatttttggtgacaaagaagtcatagagtttgcctttaaaagagctcagcctaagaggagatctgaatccaaacttcagtagttattttctgtgttctccagtcaagtcaaagcactctttgttgtcttaatgatgcttgggacataatagagggcaaactgagaaggtgtacgtaaataaaattttaaaaatatacagataaggagtgggaaattcacccacatccctccatgcatacttaacctctgttaacattcaatacatatccaaattcggagtcttagtgtatttactgattataatttgcttttcttacctaataactgcacgttgtggatatcttaccatggcagcatcaataagacctggattcagatcgtcattctaaaaaggctgagtattctcttgtatggctatatcataaggttggttagtttgttgttgttgaaacttctccaaccattagatactgcacagggcattttccacctgcccttcaggtccagttcctacccttttctatctgcttatgtgtcgtgcattaataggccaaggggttgttggattggttttgtccctctactgaaagccaccactcctgggagggaccttctcccaatagctgttctctctgggttctagtaaacagtccttccctttgacccttctgacctaaggctcctcactgtgactagctcccctccctgcaccttacccaaacctgtgtaaataatcccattactaagttccttcaggtgcacaatttgtgccgtcttttcctgcagggaccctgagtgatacagcagtttttggcactgtttctatcaactctgagcaagcatagatggctgt

SEQ ID NO: 120428 - DNA, 1087 bp, Homo sapiens
attttatattattctaagcaattgtgtctaagaacaagtagaggtattttacataatcagtaatagtataaaattgaagtatatttgtattacagttacacgttcagctaatttgttgagcacctgctctgttccaggtaggctgtaagtgctggggatacagcaatgaacaaaacagacaaatcctcttgccctcatggagctggctttctagaaagctagaggggaatgagaatttaaaaagaatgaataggtaaaaatcgtagtatgtagttgatgatgggagtggttatgagaacaatacagccaagaacaggattagagggtgcggtgggaggattgctgccgttaggtgagtcagccaaggaaggcccctttgaggaggacgtgaaggagcaagctgtgcatgcttggggtggggagggagaagcatgagtggttattgggctactttctcttaattaatttctcctgtaagagaaatttaaaatcctaccctacacttaatattgtcttacaaatataccttataacttgacttttacttttaacttcctttttctttagtcatgattgctacctgttgcctttctcatcttggtttttttccttgatttctttattttaagctgttgggtgcatgcttttaaacatgcacatacccacatttttaaaaagctattgaactagaatgaaatcataatttctcaaacttgatcattgttcttgttgtcatcctaggcaaggatgttgggtgagttctggcagaggggctgggttataggtcattgtcttaggaaatgcctttccataagctcattgcatactcaaggcagaaataaaatctgaaaaccaggatcacgaagcaaagggaagagaattcaaaattactaagaccagaagatggccagaaatctcagaaatgggagatccagtgagggaggccaactgattgggtgttcatggaggcagggaaggtgagttgagggtatgccaccaccacttggaacacagaaatggtgctgatgtcctaaaagagcactcaccacaaataatttgccctgatgaatcttaaatacatcctctc

SEQ ID NO: 120429 - DNA, 1031 bp, Homo sapiens
tggttcactgcaacctccatctcctgggttcaagctgttctcctgcctcagcctcctgagtagctgggattacaggcacctgccaccacgcccagctaatctttgtatttttagtagagacgaggtttcaccatattaggccaggctggtctggaactcctgacctcaggtgatccacccacctgggcctcccaaattgctgggattacaggcgtgagccacggcgcccagtcgacttctgcattttgtatcccagttaagaagactttccttactctaagattacaaatatatgtatattatttgtatatatacattatatatattattacatatacatatataattacatatataatatatacttatatgtaatatacaaatatatattatttgattacaaatctattttttatatatatatagttacatattctatatatatacacacacacaaacacataatttcctcctgatattttatggtttcatttttcaggtataaatctttgtttcttcggaattcattttgctatgaggagtgctagacatcctgttgatttttagcaacaatttgatctagcccactatttgattcacttttcctggtgatgaaactaaagctttgagagctgaaatgacttgcctacggtcttagggttgataaatgtgggaaaccagttggaactacatcttctaaggattgtatttagaatataggtgagctaaacctttatttcagcattaattagcagttacttttcatttcctcttgtttcaacccaaattattgcagctttatcttactttttccctctaactgcagacaaaaatattggtctttgtgtatgaaggaaagcaacttacgaaaggagtctcctgggagaagcatgtgtttccttttttaccgtaatattaagactcaaagcatttcttccctttactgctctctaagatggggggctgttaggtttttcttttgtgacttgaaaagtgaggtgatgatttctggcaaattctaaaatttggaa

SEQ ID NO: 120430 - DNA, 1759 bp, Homo sapiens
acctggcttgtgggaagttctgtctgcatctggggagcaccatgtacccttgtcaaatttgtggctgtgccttttagtttagtttagacagtgcctctcacttacattaattaaaagatatttttaagcctttgtagtcttggtattactcaggccggtatcattgcatcatttgctaaattttatgtaataaggtaattgtgtctacatttcttcactgttgtgctagaaaaggaaataaaacatcataaatctgaagtgagcttggtcagaggcagtcagatctacaaaagtgaggccgaagagaggaagcctgagccgagtgatgattgatccctgtgacatcacagaaggacaaatgggctaaggacagacttgatcacgaatcctggcatcctgagccaaaacccagatgcaaaaacttaaaggggatattttacaaaaagtgagggaaacagctcacttgacactggtggcgatagcctgtgggactcattacccgcgagtaagtggcaaatgttggcttgggaacggcctcgccctgagtaacaggaagaaaggcgttggctggcctccctggagccctcttctcagctgcactgccagtggctgagcaggctggccggaccgtgcactttactttatcagcaggtatttactaggtgccaattatgtgtcaagcttggtgctaggtgctgggtgcagggggtagagttaaaggacacaattccttctcttaggaagtttccttgaaggaagttgagtggctcctgaattctatctaaagagggcttaagagcagccatctggttgaagtaggggctgggggctcatctgaatggtgtgcttcactgtttggctttgttttacctgttttatgtcttagatcaacaaaaagaattttctaaaatacacttctatttatatcttaaataagaataagaaaacattagttgtttatatgtaaaagcattttatttttattggtgttggcttggcaggaggctattgagcttataggtgggtaaatgtgccccaccccctgggtacccctcttgacatggccattgctggcctctgtttccaccctcatgtcacattgacacatgggtcttagggtagatgtttgttttgagttctacctcaaggctggctgcaaactgctcagaggttgccaacctgggcgagtcgggaatcagcctcacttctcagttccacagttgatttactagtcatccctggatatcagtttgtctttctgttaaacagaataaaacaagagcgtttcctgccggtttcctgtggagtgtggcaggccagtgcttgttggcttcattcagaaaccaggccttttggaaatacagagccatgtcctcagtgactgcccttcacaggtggctgccccacctctctccgcttgcctcctgctttacattcagagcaggaaagctgttagcacaaggttcatttaaaaccccagttgaggaggttatcatagcatccttaattctagtgaatggctctagttttcccttcagcagttggagtgattaaatgtcataatatatcaggggagtaccaattatgaacatggatttcatgctgggtgcttttacattctttgattggtgttgggcatagtactaacttaccttggcagcacctttaattgtggcattcatgaattgaattggactctgagcagctggaagggtctggggctgaggactgctgccagggcttcacctgccctgtcaca

SEQ ID NO: 120431 - DNA, 1129 bp, Homo sapiens
ttagtagagatgtggtttctccatgttggtcaggctggtcttgaactcccgacctcaggtgatccgcccacctcagcctcccaaagtgctgggattacaggcgtgagccatcacgcccagtccatcctgttaatttttaaagtcatttgccttgataaaaagttgacagctttataacatttctgttcctcccagttaggaaggaaaatggcccacacacttaccaaattaaggggctactgccacgtgcgtccctgttgaagtgggacagcacagtgctctgcacagaagccattctcctgaaagaggcaagtgtgtgtttctgcccagggctgtagagaaggaagggtgagaaaggtcatttttcccaggtctttttccttcagtgctcagccctcgagaggcctaagtcatgtattaggaagctcaggcttctgtaacaaaataccatagattgagtggcttaaacaacagatgtttatttctcatagttctagaggctgggaagtccaagatcatggtgccagccagcatggcccctgacaaggaccctcttcctggcttagaaacggctgccttctcactatattctcacatggcagaatatatgtatctccctcttctatataaaccctaccctcatgaattcctctaaccctaattacctctcaaaggccccatctccagataccttcatagtgggggtgagggcctcagcatatgaaatttgagggaacagaactcaggccatagaaggtatcttcatcaagggctgctccatattctgccacctcctcagttgcaaaatcagtggggtatcttggcagagaggcaacaagaaaggtttaggccctgtattgctagccttgttaccttggttaaactatttagcccctccgagcctgagttttctcacctgcaaaattgagagattcatgtggataatgtctgaggccctgcttgctgaatctgcagctgcctgcctcctgcggccctcgtcttcctttcctccatttccactgacttggtggtgagagcccaagggccaagtttgttgatccctgtaccagcttttctcacttattcccacttctgggggcaaaggaaaaaagaggagtttgagattttg

SEQ ID NO: 120432 - DNA, 1037 bp, Homo sapiens
attttcagctatgtagaagcatatttgagattctgatgcttgtgcctgcctacacacagacacacatggcctgagcacaaaagtatttgagaaaaacaaggctcttattgatcatttccttcagtctcagactctctctacaccagttcacttattactcaagcatctgattctacaagaggcagaattttcgaagatgagattcctatgccctggctgacagtggagctttgaagcccagcctgggaccctctggcctttagccagggactctttggggtcccagtaagcttccccttcacccctttcttctctcccgtagacctcagggattggcccacctgtccaggtgtctgcctccactgtgtcttccctcttccctcgtatcccagaactctggggaaggaataatgttttccagtgtctccccagttttgctgtgtttgaaataagcacacaatccccttttaagattttattgcatgttaaaacaaaaatgggaaactgagaggtttgcggaaaatagccaataaatagccaacaatggggatgttataaagttatgagaaatactaaaaataacagttgtcctgggtcttggtcaaacgttaataaactagctctttccttggctcctctgactgccttctctctagatattgtcttgaggttgtagcttccactccttttctgaagagccctacctcctagcacatacacaaagcccctagagaacagttgttggcagcaatcaatgcttacaaaacagctgagactggtgggctgtgatcgctctggaatcttcttgcaggctgagattggagatggcctttgaattgtgggcagctcgggggtctcccactgcaaaggtctcacaaagtgtagaggattgcatgaccatcttttctgcctttcctctcccttcatgccacttttcttgatgtctttcctgagaaaatttgtacactccataattgcaacttgcaagactcacttgctaacaaacccaagggtgtaagtccacagggcctttcctg

SEQ ID NO: 120433 - DNA, 1641 bp, Homo sapiens
tgttttcaggaaagatgaatgagccttcaatgtagttcacatagctttcacatactccagaattttgaaggtgtatttgattttctaattttatttgatttcaggagacagaggatacaaacatattctactagctaagtattctaatgtgctgcttatcatgctaaaggaactcacagatgtagggatccatttcttttgaccctgattaatatgagccagtttcccagggtgtactcatcctgggaacactgataattgagttttcagactgtcaagtctggggttagcctgggttccagaatagagaaagccacaccacaacacagaagctgtgctgagagcccttcacccagaaggctttgtgacagggaataatggtgccatcgactttcccacattcctttctctttgtttccttcgcctctcgggcatgtctttgcttattagcatgttgaacagagttcatcacaaatgaaactcagaccagtgttaatcttacaatttattatcctctaaaagatctgatcctgaaagatttttccagtatttcagtatgagacttttcaaactacagaaaacttgaaagacttgagtagtgaatccctgaatatccaccacgtagggcatggattctataattagcattttgctgtacgtgctttattgcatctatccatctgtctacccctcagtgcacttagcaatcatgttattttttgatgcatttcaaagtaagttgcagacatcagtactctcatccccaaacactttaacgtgtatatgattaactagagttcgatgtttgtttatagttatttgggggtaggggggtaaaatttatacaaagtgaaatccattaagtctgttattccatgagttttgataaatacgtacatttgtctaacccaaattcctatcaagatactgaacattactgtcactcccagaaagttccctagtgccttccttagccagccagtcctcacccagcctcttctggtagttttccactctaaattttgcctattctagaacttcatataaatggaatcactgcagcatgtgctcttttgtatgtcttatctgaaaggttttaactagtgctttaaactgaagtctagggactctgtcaacttcatttatacaccttcttcctgtttcgcaagttcagaggtaattaggagtggtaaactgcaggaaatctcaaggcagctgatggatcctgatagtgtatttgtattaagtatgtatgtatgtatttttaaaccttaagtatatataatttggtactcagaatcctacatttgaccaccctgatattataagacaggtgttcccctgtagaatctgaggagctaagacccctttccctggccacactgctaaggaaattgattctgagtagaagtttaggatgttttctttggcctggttttatccacagccagaccagcagtgtgctgtaatgacattcagattgtgaaagaaccagaccgagagacagttacttggaggctggtgggggtgcccgaaggaccaactggcagattaaccagtgtttttaggtaactgcaggctttctgaggtttgtgtacttcctcctcacccctccccaccatgcctgggtgaaaagtagat

SEQ ID NO: 120434 - DNA, 1022 bp, Homo sapiens
tctcctgcctcagcctcctgagtagctgggattacaggcatgtaacaccacgcctggctgatttttgtatttttagtagagatggggtttcaccatgttggtcaggctggtcttgaactcctgacctcgtgatccgcctgcgttggccttccaaagtgttgggattacaggtgtcagccaccacacccggccctgtgttccttttgtccatgaaatcattacttactcatatcgagaaacctagagaacagaggcttctgctcactggccgtggctccctccacagttttcagtcctggttcccagagccaccatcgctccagcagcaatgtttccctgggtgctagcagagagggctgagctgagcttggtccgttttcgtcagtcttggattatgctggagtctgcagaggtggctttcctggctaaatttgtggatctgttttcaggatctgttgcttacactcagtcaagccatctcacactctgttgtagcttgcaagcttttccaagggtcaagtgtttgcgggaaatggatgttcaggactgagacaaacactgttaccattttcaaagctgtgctttgaccacagggatgggagggatagcagtcagttccattgaggatggtttctgctttctgtgtccaaggagcaggagccaaaatcacttgcatatgcttgagagctgtgagtcagaaacagccattgcctcttggatttgataagtcgggagatgtggcagcacctcgggaagagccctccccttggaagggttaatgctgagctcttcccgtgacatctggtctcctgtctgatcccacctactagttttttgtttgtttgttttatttttgttgttgttgttgtttgagacggagtctcgctctttcgcccaggctggagtgcagcgcggtgatctccactcactgcaagctccgcctcccgggttcacaccattctcttgcctcagcctcccgagtagctgggactacaggcgcccgccaccacgcccggctaatt

SEQ ID NO: 120435 - DNA, 1047 bp, Homo sapiens
gttttgtcttctttacccaagaactgaatttgcctgcctgctttctacctgagcaggcaggtgagtcactggaacagctgttatcagaagaggaaaatgaatgcccagcccctgaaaaccagcctggcccaagaaggcaacacttcagacggcgtgctggcccaggagacgccctgcttgccagctgccagagtctagctgtggatcgggctcctggcccactggccgcgcagcccggcggaatgcgatgctgccgtcccagcagagccacacctgagcctgacccccgagccccggcccatgtgccccattcagccccttgctgccttgagcctctgagcacaaagggccggtggccatggtttgcttattccgggactgctgggggaaaacaagtaaaagtctcttttctccccctgccgtgttctgtgctgcttgtgttgcatgtgctgggtcccggtgaacagccgccgctgctgcttccctcccggagccctcgctgtgtgcctgtgtccctcagctgcatgaagatgtgtgctctctcctgactggtttatgctgcaaggtcgcagaacttgcccctcgccacggccccacaggggctccagaagttgcatggatgagaggagcggcggggcttgtgggcacttaggagctccctcagccccctctagtgcctgtggggacagactttctgaaatatcttcagcacgcacgctgatgaggagttgacctggagactgttgggatttggcttcccccacccccgacctgtgggcagagatcatgcatgtgcagccgtggccctggagcagctcagacctgggggtgtgagtgggcagcagccgcccgaggctgggcagtgtgtggacagcaccaggtggtcctgtccttggctgtacacagaagaggagctgcgtgtctgctgctctctggtctcttgtatatagtttggctgtttgatggtaatgactatgatgtggcaatgccatctatcttcctctgagtgccgctgctaccgccttaatggtttttcccttttcaagc

SEQ ID NO: 120436 - DNA, 1035 bp, Homo sapiens
tgctttccctgcagcttcacctcggcagcattctcttcctcctgctcagcaaaaccacagccagaccagattctgttcttcctgttctctgcctgcagccccgtggggggcaccgctggagacgcctcctccgctcccggtgcccgctccagccctggcggaggtgggcccgtctcacactcctggctcaccttctcagggcatcatttccaggggtcctggatttactcaggacctgcctgtcctgcctccctccttgtacggaccttggctttgtcctttgtcctcttcttggcctgtcagacacaggattagcaggtgtccctcaggcccctccgggtgaacttcagcttcacccctgcttgtttctctgactctcacttctcacttctggctctggggacttcctttccctttctacaagcacagccatgagttttaaaggatttttaaacacattgtccagcaattccggttgctgttgagaggctctgcgcactgctgggaagggagggcctccgtgtttcctgaatcttttccttcctctccattccttccaccagtgccctggacagggacccatgatctctcacctggaccgcagtggcctcccccaccccctagctgctgccagaaggatccatttggaatgcattcctaggcacgggcgggtgcttcactggcttccccgctgtgaagatccctcccaggccctgggctgggtcccaaggcgtcccagggtctcgtgggcgctgttctctcctttggtctttgtgcagaacagcctggcagcctgtgccccccacacagactctgccatctcctctctggtcatttcccatctcctttgagactcatctcggacaccacagagactgtccttcccaagccctgctctcaggcggtttgggtccctgctgtgcctctgctgtggctagcacctcccctctcccgcagtgtgtttgaattgctggtctgccccctgccatctccactcgacccttgaacttgctaaggtcactggcatcttcaccc

SEQ ID NO: 120437 - DNA, 2591 bp, Homo sapiens
ctggccaagatccccctctccctggccccagggattcaagggctcagggtggtcagcgtgaggagggtcttctggcacttccagaaagctggccctccagggaaatgaccctcttaattgtcccccaaccctgccaggtctcgcccctggaaaggcagcagctcctctggcctgggcgggcctctcatgctcctgtttccctccctcgctgggctcccccaagggcaaggccgtcaaggggctgcagagagcggcctgcaggcagcccccagtaactgcgccatccctgtgtctgtgtctgctttgctctgcaccccaggtgccgctgccccccgatagtcgctgttgttactgtcacacctgcaccacccaccgtccttcctacctaccgctgccatctgttagtcctggagtcaaggtctttacgcctcctgctgtcttgtgtgtcagtctccccgaagtgaccgtgagcgctcttagcctctggcggcctctccctctgcctgtgtgacattctttcccctcttcctgagatgccctctgcctgttctgtgtgtgcttcagccctctctgtttttctgttgtgtgtcctctctccagaggtctggggtgactgctgtggtcttgccttggggtgagctctctgggcctaccagagagacccgaggctggacatttgcaagccccatatccccttcctgcccagtgtgagtgggtctggggcttagagcaggaggcccgcctaggacaggggtcctttaactgagcaatcccaagaaatcccggagagaagctgtgcctggaggtggccctccccaagatgctccaggagggtgtccctcctccgcctgcccccaggggcctgctctttggccgaggagaataagggctgcccctcccagcacaggggccacagcctggcctgggggtgggaggggcctgctgcctccagccctggcacagagctccctctgactcttgactgcttccttgtttggcagctggaaccacctgatatggaccaagatgcccaatcccatgccagtgtctcctgggttgtggaccccaaaccagactctaagcggagcctcagcaccaagtatgagaccactatcttctaaaacaacccactccctgtctccactagtctcactgtgcctttgccatccgatctttctgctgtcctcaactctctccttccagctgctgatgccaaggccccacctgcactgggacctgctcctcttgggcgggcggcagcgtagacgctgtacacttgcagctctcgcacctaccaccaccgaacactgtgaattctcccccttgggctgaggacagcttgagggggtgagttgcctttgaggtgggcatcaagagggctcaggggttctgttgcaccctggaagcctccacgggcaggcactgtgaaccccgacgggcagggcagtctccagcaggatcccaacggcactgatagctccccagggttgggctgggctctgtgtggctccctcctcctgtctgctgtactgagccacagctgggcaccgttgccaagagctagctgactgttctcacctctcctgaaccaaccaaccactgtgaccacccagtgccagagtccccagcactctgctcacagccggcctgcagccccaccccactgtcctccgctactccgaggtgctggcctcactctcatggctaggcccttgtgagaccttgagctcagtgatgtggctggaccagggacagactgctttctgtgagggcccaagatatgcgccaggcccttgggtccgtgctgactgccccacttggggctctgggtatctgaacactcacaggctggctcacacagcaggtgtctcagtcctgatgggccttcccctccaaggaggtgggtggcatgtgtgtggacagcccctctatcttcgccatggagtctcaaggcctggcagccttgggcctggctctggagtctagctcactgaggaggaaggccttccgtagaaccaacgaggaggcggcctgtgccctgcacacacggcgcaccttcttccctcacagaacagagctgctggaggacagggacctggaccaagtggcctccattgtcctctgggagctttctgacactctccacggtgggggatcacagatagacagcgccgtccagcatgcccctgaccacctccctcagcctcctgactcctccgaaaggagaggccgtcccatcgcagcagctcagaagctgggatggtggagctgagtctttgaagaggcaccccattctccagtgtgggcaaatcagtttggatggcaggagacaggaaggaagcggcgcccataggcagccgtgcacacatagcagagtccactaggaaagccagtcggccagggcagtcaaaacccaagtcgataaactgggtgggtcctgcgtacccacccatccttgtgccttcctgagcagagtcactgagccagaggcagtgggggctgcaggctgtgggtgctcaaagcaggcatggagggtgccccggggaggctgtgagggatcgtctgtcctgctctgtgtttcctttccattt

SEQ ID NO: 120438 - DNA, 1015 bp, Homo sapiens
tggtagatgatttttatttgcttgtttcactgtccatactaggcaaaacaaaaagttggcaagttgttttcagttgcttaaaatattttcagaaattttattagtctgtgaattcctaaaatctgagaactaccgctttagaagaccaaatgactttggcactattcagtaacatctgagtattatctgtagggagagtttagctttcatcatgtatagcatcagagacaggaaaaggaacgtggaaccttaatacttagatgaatgtttatttttgcaaatttcaaattattgtttctttgctgctataaatacgattttactttttaagagaaaagtttttcatctgtttcacttcctgcttttttttataaactagctatttgtcctgccttcccccagtgttagactactattctgaaagtttctagcactgtcgtggggcatagagtgcagaaaacataaatcactagaatagttgggtgagtctgtgtaagaccagtttgattaatctaaatttggggcctactagattgagtgaatctctgaataaaatagaaattcagacttgcatgggctcattgttgtccaccatcagttctttctgtcacaggtctgacagaaaccgttaatgaagtttccaagctgagcaacaagattgggatgaattgtgattactacatggaagagaaggttttacctccaagcaggtatagactcttcttctttcttcatgttgctcatcctggcttaggtacttagcactgatggcttcagatcagacttgaagcatttttatttaatgatacaatgagtatttaaacttgagaggtctcaacaacttaaacagaagagtactaagttgtaattattagtaccaaagaaggccaagaagcaaatgttacttagtcaacaaataaaccaaagcaacacttgttggaataaatatggtggatttcagatctctgacaaacttggaggaagcagcctgtagtactatctgctgctgcataac

SEQ ID NO: 120439 - DNA, 1395 bp, Homo sapiens
tgatcccagacgggaattgggttttctcagcgctttgctaactcaagaaatagtagtgtcctgggcccagtctctagctcggttctgtagtgggtgttcttttgtgttcttgttggggcacaaggtcttctccgcgcttcgtggtaggtccagtctcactgggactcatgctgtatttctcttaatctccagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgaggtaggatgaaaaatccgtttttttgtacacacaatttaagtttttgaggtgtctatttaaatgagtccatatataaaacaactctcagtaaaatgaataatcaaattcctttttaaaaaaatttgaaattttgtgtattaggttgacttggttgttatattacttgaaaatgtctttgtccttgggatctggatttttaaaatctatttcggttaaattttatctctaatttctctttgagctctcctcattcctgaattttagagctgttttggaattgcttagtgctgtgtaacttttgagcaacagaagtcttatcaaggcaggctatgaactttgatttgttgtagttggaaagtgtttctgtgtatatttccctccgtccctcaataagctgctgtagttcaatccccttctgaagattttctcttagctctcatttagcattagtgaattagcagtgagtctgtttacatatttgattgtgttttgccattttggctgaaactaaagacttcagagaggctgcagaaataaagggaacctcaagcgtccacttaaggtccagttcaccttcatgtttacctaagcagagactcagtggatttttggtaaaggtctacaatctccttaactttttatttttaaatatcgtaagtctgctggaaagtaaaaaataatacagtgaatgcccacagtgttaatattctgccgtattgctttttctctctccctgtatttccccctcctgccttttaaaattgcaacgtcttgacttcttttaatttttgttgttgttgatgggtttttttttttttataaactagctgttttttgagacggagtctctgtcacccaggctagagtgcaatggtgcgatctcggctcactgcaacctccacctcctgggttcaagcgattctcctgccttagcctcctgagtagctgggattataagcatgtgccaccatgcccagctaatttttgtatttttagg

SEQ ID NO: 120440 - DNA, 1017 bp, Homo sapiens
tcccctccctctgattagggtgtgagtggcaaaagtgtatcaagtctctgtgaattcagaggaggcagtgtagacagctgaggaggtatacaagcttcagagtcaggcctggccccaagtcctggctttcttctttcttagtctgtcatcctgggtaagttaatctacctgagcctcagttttcccaccaataaaatggggataacaattcctgccttacaggctcgtgatggagtgcctggtatagtgcctggaacatagaaagcacttggtaaatggtagctatgagctctaatttgtgtctcggggtgtctatgtcttcttaaggtagagtaggaggtgcaagacagtagggatggagagactccagagctacctagtgggcaagtgaatattcttctaactgcataatgtataagtgctgatgacaagggcagtgtgctggaatgcatggaatttttggaaccttctcagtaggtatgtatgacagacaggaacctgttgggggtggtgagaatctagcccagttggctgtgctcacacccagtggcatcaaagcctaatctgggacaaggctgcttcttcccaccagccactactatacctttgttatcaaacccttgggcttttttatttttattttttttttgagctctgtcgcacaggtcagagcagtggcacaatctcggctcactgcaacctccaactcccaggttcaagtgattctcctgcctcagcctcccaagtgggtgggattacaggcgtgcaccaccacacctggctaatttttgtatttttagtagagacagggtttcaccatgttggtcaggctggtctcaaactcctgacctcaagtgatctgcccaccttggcctcccaaagtgcttggattacaggtgtgagccactgcagctggccccaaacacttgggcttttgttcttctgagaagtagtggaaagaacaacaatagcctctacctattaaatgcctacatgtgccagtgccaggtgttttct

SEQ ID NO: 120441 - DNA, 1002 bp, Homo sapiens
cagttccctctaagcccacccccatttttccagaaggtggagaagagggtggactgcttagaaattcctcaggaatccctttgacctctcttctctcatgacatgtctcagaggtggggaaagcctcggggtgggagagtacagagacttttccctgttttcaaccccttccttctcatctctttgagtctctgcagggtggaataagagaaaggggactagaagacactaaggccagaattactgcaggcagagaaagaagacagtcatcagcagccctcaaatgagattgttttttgaaaccttcaggaatctgagagcatgagaaccggtttgagatgtgagcagctgggacctgttgtaagaggagccggccctgggtgtgagtttgggaatgtgaagtgtgcattcacacacgtgtgaatgtgtgtgcatgactcagggtgtgtgtgtgtgtgaagtgctctggtgagaggaaaaaggaagtggggcaatatgcattttgttttagttggagaagtaaagaagtggaatggcttggtccagtgccttgaactgaggacaggggaagggaacgaagggcttcagaccttttgagaagatggagctggaagagcttgctgcctgaactcactcagtcctttcccccagctctggtccccaaatgtcagggtgtgggcctcctttgacatcccgtatccctagcacatgaccacttataagaaagagtccctgtcagggctggaaactgcagagctgctctgaggctggcagtgcctgcaagaggcccagacctggggacagcttcttcaggctcagaagactggagtctggaaacagaaggactgctgggccttgggtatagaagcgaaacaacggccaacccagggatgtctagggggtacaggagctagtcacctgggctaagaggggacagagactcccctcccccactggccacttaacattggactggctactctcctgttcctatgcccaccc

SEQ ID NO: 120442 - DNA, 1013 bp, Homo sapiens
ccctgtggttataaccatagccctagagagctgtggggtttggatttctgagcctacaccaggggctcttcaggtctggtcactggtggtaacaagctgaggaaagacctgggcaggggctgcagggctggagggaagatccaggataaggaaacacatctaaggaatccctctgaaagtggggagtatcaggatatgtgggcattggggggagggctggggaaggggagtgcttgaagggtagaccctggggagcaggtttacagagaggacgtttttacaagtttctaattatatttatttggagttttcctctggcggtttgaagctgttaacagcaggaacctgtatccctggtgtttgtttttgtttctaaccagctgcttggccccagcatagtgaatccaagggcaggcaacacctgcccactgttgcattgcccaccctttccttattgcaactgtgtctgtaccctccctgcccactactcagccttgctctcttctgctgctcccatgcccaaagcctcagagcatctgcattcccactgctgatttcctccctggatcatgtacatttcagctccttccgctccacggttatatactggatgcatgcttcatgctgaactaagtgctgaggtggagttgggggaggtacaataatgactaaggcatggattcctccctcaagtgcttagagaacacagtgggtagttagagagcactggactgggagtttgaagacctggatcctggctttacactagctacttgctctttcctgaggtatcctcactgggccccagatgagagaggacagtttgaagaccacgtgaaccaacctgcatgaaaaaactgtacacttagtgaaattatacgaatctgaaatgagtttatttttttcaattaaagagataatattactaatcacaaaaccagaacctacccatgcccactgcctgcctctctgcccctcactctacaatgttctgttcttcccccacttcacta

SEQ ID NO: 120443 - DNA, 1057 bp, Homo sapiens
tttgggggtgagagcctactgttctccctgccccccacccccaccatctagggtgtggcctggcagctctccccagatccctccccgccaagttgtcagactttgttttgttaagccaaaataggagaaaggctagggaatatggcagcaagcccaggcacaggggggaggggaggaaggacagggctgtggcctgtccacagaaatggtccctgctccacaaggaggtgaggctcagctgcctttccccaccctgcccctccaacctcagcaccatggccatagctctgcctgcacccagagccacttcccaggttcctacattccctggctgctcattgcaaccagctgcaacccccagttacctatccgaccaatgtgaccaatctccatccttaccttcatcactgttcctctttctctggcttctttcctggtgtcctctgtcttcatacccagtttacacaggtgagggaaagggaggcatggcttcacctaggtgacatttgaggttcaaaggtccccttttcccccacttgcttagcttcccagctctgccctcagggcagcctttttacacttagtgaaatattagctgacaagggtgtgaggacttcctggcttaaggctgggcttagggggtagtagttcttaagactgcctttggtgctgaagtcttgggatataccctggaccctgcctgtaccccatgaccccactgactacctatcctgcacagatgtggacgagtgtgccgagggcaacggcggctgtcagcagagctgtgtcaacatgatgggcagctatgagtgccactgccgggaaggcttcttcctcagcgacaaccagcatacctgtatccagcggccagaaggtcagcccatgacctgggatggccccatccctgccctccccaggcttctcttcccagctgtccctcagcagcccctaagtctcaccctccattctcaactcagctagctccttcttctcttgtccttcaactcaatcacaccctaaaggatctaggaacagacaccctgttagggcaaaatct

SEQ ID NO: 120444 - DNA, 1149 bp, Homo sapiens
gagtctgagaatggcttcacggtgagctgtgggacccccagccccagggctgctccagcccgagctggccacaatgggaacagcaccaactccaaccactgccatggtaagcaccagcccagaagccctgttcccaccctactctcttacattaatcccttatttttgttcttcatcaatcccctggccttcctttctcctggatcctcttttttgccctgtaattctccaaccctgctccctcactccctctgccctaacatctgatccccttgactttcataatctcactcccccagccaagcccctggcttattacccagcttctcaacaacccctacggcacccccgacctccatgggcatcccatactgtgctgagtttctaccatccctctagaggctgcagtgctgtccattaaacaacgggcctccttcaagatcaaggatgccaaatgccgtttgcacctgcgaaacaaaggcaaaacagaggaggctggcagaatcacagggccaggtttggactggggaccccattccagttggctgtctggccactaaatcctccttacccctcagctcctctgcttccaaaaacccaccagaaccctgaactctaggcagagcagaggaaaaagcagctgtaggcatagcacccaaggaagtcccagaatattcccctccaccaactaattaggaccctagactaaaacaggattgagagatagttacagttagagatctggggaggtctgtctgggctgggagtgagaactttccaggggatgtccctggggttgacaagccctctctcccaggtggtgccccctgctctgaatgccaggtcaccttcatccaccttaagtgtgactcctctcggaagggcaagggccgacgggcccggacccctccaggcaaagaggtcacaaggctcaccctggaactggaggcagaggtcagagccgaagaaaccacaggtgggactgggggcactgttgggaagaggactggaaggggagggcagaggtggggaaaccacaggtctcagcagcaaaaggaagggatggagcctgtactaggggcagaccctgcctggtgccaagcctaaaagctagtccctcttaccatgcccctcctagctcccagcttt

SEQ ID NO: 120445 - DNA, 1177 bp, Homo sapiens
acctcaggtgatccacccgcctcagtctcccaaagtgctgggattacaggcatgagccaccgcgcccagcctaggataactttctgattcctctctgccagccgttttgcgtctcttggaaagccaaacggtgaccatgcttcttaatttatgccttcagggtctggcttctcctttctcccttcctttcctgtcacaccatgcatacatacatacaaatacacatccttcaaccatttattccatggcttatgagacctgcaaatgagttccacagtacggaaggcatagaccactaggcttcttaattgatgtcaaggcagatcttggtgagcaggtaaaaacctgctattgtccaccaagtttaatttaggtcctccaagttggagggttaagaacccaggcaaagctgctgctgaatctatggaggaggctggccctgggacatcaaactaggggttaactggattgaatgaggagtcaacgctcagggacattctaggtctttacaggtcagacagaagagaggtttttaccattggagggaaatggaaagatggtataaataggatcccttcatgaagcaacccagaggcctctctgcagcgtgtagggtgtggggcgacagtattgtggggcttccattcatcttagtacaaaacctcacctgctctgagcctggaaatgggagggcttcacgcaccaagtaatgcacaccagaaaggcacttatatcctcagcaacatggcagttcctctttacttctctgcctccctctttctatattatcaggccatgcctattcctacaacctgagacaactcttggagtcagaagaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagaca

SEQ ID NO: 120446 - DNA, 1104 bp, Homo sapiens
gtgattgcttgtcctcacaggtgcatgaacgagctcatacaggtgaccgtccatacagatgtgacttccccagctgtggaaaggcctttgccacaggtaacctgcctggtgggctgcttccagttgagggtggagggttctcgttctgtttgggacctctctgaagggaacccaacaccaggctgctttcctggagaaactaccgtcagagtactctgacttgcagggtgctctctctggaggaaaccttgttacgggagtgcaaggcagcatggttcaggccagcagaaggagcctggagggttggtggagagacccagcctcttgtgtcagctctgatgccaaccagctgtggattattgggtgggccattgcatctctctgggcttattttcccctctgtgaaactagtacctttagccatgagttctctaagtttcttttcatgctcatgttctggtatggctccaactgctcctggagagggaagcagggcagagtgggcttttccagcccctgcccagggcaggggtgggatagaggcagacatgggcttcttgagccaaaggaggtggagagcctgtgcatgaggtggacggtggaggatgagaccccactgggtgctcatctcaccccctgcctgccacatatggacaggctatggactgaagagccacgttcgtacccacactggtgagaaaccatacaagtgcccagaggagctgtgcagcaaggccttcaagacctcaggagacctgcagaagcatgtccgtacccacactggtatgctgggccctgcccactccaaccccattccctgggcaaaaggaattcagcttgcctttcagacttagacctggagcccagtgccatccccagcttgctccagcatggccctctttcccacacccctcctcacatcccaccatttgcataggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtg

SEQ ID NO: 120447 - DNA, 1050 bp, Homo sapiens
actgtctagcattgtgggaagcacttgggctttggaatctgatggagatggatttgaactccaagctcttgttcagtgtgggtcttttggcaagttactgaatcccttgagcctcagtctccctgtctgtagaaagaggacaccaatacctaatgaagtggctaagagtataactgcatgggtttgaattccagttctgccagctgtgaccttgggtgagaaatatctcagggctgcaggagttttcatttgtaaaatgggtatatgagtagttgttatggtggttaagcaaatgatatgtaaagtactttagctcagtgcttggcacatagtatataagttttagttattactgaactgaacagtgtgtgtagagaactcagccaggatggggtgaggacaagcagagaggtggggagcagtcctctggcccagttttggttggggtgcagaaagacacactgccactctactctatcccaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggggcccagcttgtagggagcatctgtaacctctccccacttttccagcctggccagcagcctaataccttgccactccaactcttcgcccctgccataaactcctacttctgcctgctctgtccgtgactgctgtcccatcacgtccctcacatcccagccacctgcccccttcctgtccccctcaattcaccttcaatgtccctcatctctaatgaggtgggccccaccctacccataaccttccaccgaatccctgcccggccctcctccagcttccagggttctccacccttcccagactgtccccctgaactccccctccaactcctccaatctgtcactgtgtttccaggttcttggctcttagcttcctgctgggtttctccttctttgtcctctgggctgaaagactagagttaat

SEQ ID NO: 120448 - DNA, 1456 bp, Homo sapiens
taatggaggcagagatttggtctgttaggcacaccttagtatcccaacccctggagcagtgagtggcactcagtaggcactccaaaaacatctgcggaatgaatgaatgaactcttaacaagcagggctatgtggaagtgagttgtcatggatagtgaggaccctgttactggcagtgttcaagcgtgatctgcataaacactgagtggcgattatgtactgggccccgtggaataatagcaagatggaaacgcacccacctagccttcaaagagcaaaggctacagagttgtggggacttaagtcccccataacttatgatgcaagccatgcaggctcctggcagagtggggtccccagggaagatagccaggagggctaggggcttgagctggagcacccttggggcaggtggggccctgacccagtgaggccagcctggctgcggccacctaccctgtgccaggtgctgccagaccgcgacggaaagcgctgcatgttctgtgtgaagacagccaaccgcacgtatgagatgagcgcctcagacacgcgccagcgccaggagtggacagctggtgagtgctcgctaggtggcttgggtctgggtggtccttaggcgcctcatctgtgaaaagggggtgataatactttgtccagcgggaggttggagagtggactcgggaaactcctaaggcccctttcgggccgtgtgcgaggatcctactgacccgctcccgctcttcggcagccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggtggggttagctcccggcgccggggacgggaccggtgggctgggaggctggccaggggcggagcgccgggggcggggcctgggcagagggcggagctcctgggttgaggggcgtgcactggggtggagcttgaaatgagggattgttgggacagagtccgcgggtttgaaaaagagatttgggatggggcttccgccagggacagaacctggggctaggaaaggggtgtggggcgaggtccgagcccgtggatggatggggcctggttcggagaccttggctgtgggttggggcttgggcagaaggagccgttgaagaccgtgtgattggggattagactggaccaagtttggactagacttgaactaagtttacagtgaaaccagtttgagaggcaagcgggacgcgt

SEQ ID NO: 120449 - DNA, 1117 bp, Homo sapiens
cagaccaggtaggcctgaggaacctcttctggttctctcaccacccctcctggaacacaccccagttttcctgcttgctgtgcacctgcaaggtgccttggcactagaggctacacagtacacactcacccggcagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggtgaggcctggggtgggatggggtggaggctggcagggtgagctcattagggcacaggctctggagccaggctgccttccctcaaaccctggccctagcagctgctggctgtgtgactttggacaaatgcccaaacttcttggagttagtctctcacctgggaaactggtaatagcgttgttatgaagattaaatgagatgatacatgatacttagtacgtagtaagtgctgaagaaacatttgctgctatctttgttcacatcattattaatctggggaaaaatttttccttctacccttccaagcccctgtcttgctatccttgtactttggctctactccttggagctttaatctccataaattcaaacacagaaatatggaacatagaaagggaaaattcctccatgatcccccccacctcacaaccactgctaatggctccgtgaaatgttgaacagaggttcttggattaggtgctggaaaggtggtgtagtgcagtggcttagagctcaagtgtatccctgggcaagtcacttaacctcttttgaacttttttgttgttaacttctgctctggaagttaaataagataataaatatgcttagcacatcttagctgctcaataaacggaaactattattatggttacattttatcttttggaagtccatgagtcccatgaaattggaggcaaactctattcatgtatgtattaataactctatgagcatatatggtttttctctggggagatgatcagtagtcttggtcagatttt

SEQ ID NO: 120450 - DNA, 1030 bp, Homo sapiens
ccagtgtctgcttacttgggagtgagcagactccttccaggattggggaaatatttgctgactcaggctcagaatcacatctcagggtggtgtgtaagggaccgacgaggagccagattaccttaggaacactctttgagttacggtgggtataacttattagagttgctttgagggcccctggcacctgtcagctaaagctgttggggttttttctatcctgcagtgttgtacagtgttttgggcatgcacgtgatactcacacagtggcttctgctcaccaacagatgaagacagatgcaccaacgaggtaatcccattttctttactcaggggtctctgaccaccactgacacaggatccagatttaagatcctgaccttgaagatgaaataatttcactagggcttattcccagattccaggttcctgtcacagcatctggtaccagttgcttatgcatagtataggcatttattaagtaattattgaaagtctatggcttacatagttttttcaggagcatggagattcccacctttgcgcccattaaaagataaactccacagggcagggagttgttttgctgcctgttgtgtctaggatagtgcctggcacagaggagataatgaataaatttttgttgaatgagtaaatgaacgaactttcgtctttgcctatatgggtacctagggtgccaggccacaaagatggtgtccatcattctctcttattagggggcaaatatatatatatatatatattttgtttgtttgtttgtttttgagacgaagtcttgctcttgtcccccagactggagtgcaatggcgtgatcttggctcactgccacctccttctcctgggttcaagtgcttctcctgtctcagcctcccaagtagctgggattataggcacctgccaccacgcccggctaatttttgtatttttagtagagatggggtttcaccatgttggccaggctggtctggaactcctgacctcaggtgatccgcccgcctcagcctcccaa

SEQ ID NO: 120451 - DNA, 1059 bp, Homo sapiens
gaggatactgaggctcagactggttaggaaaattgcctaaagttgcacagctaatgaatggcagagctgggatttgaacccaagtgattaaagcccatgtctttgatcactacatagcagggccttctaggaaggatggctggctggatctagttgttccagtttggaaagtacctgcttgactggccagactgctgttggcttcagaaaatagcagtctcttgttggtcactgagaagaggcaaaattttggcaggccttggggcctcctgcagagtctcattccaggtcagtggacagaggaggccctgagaatagtcgtgcatactggctccctggatctgctccaagacagtgagcagcccctagaaccacaagagactggccagccaagctgtgggcccggcctgtagggtggaaggaactcttaagagaaaaaaaaaatctctgctgtgattaatcaacagcttcagtctggtgaagtgaaaagagaaaagttggcccagatgtgcacatagggagagaaataagggagggaaattgcctttattcatgttctcccttaggccagtcgttaccccacggatgagatcaccttccttttacaccagcctgcaagaggtgtgtagtggtagtctcattttacagacaaggtgtaggatcagagaggttaactcgcccaagtcaaacagctaacaagtggtggaattggaatttgagccctgttcttctcagttcagtagccctgctgttcttgctgatgtcacctcagcatgggctctccaggtatgtgcaaatagttatgcaagtgttgcatccacaggcttgtgagcagaggctgaaagggagccagggctcttggtacttgccctctcaacatgggccctgcctaagctagcaggactcactatacccaaaccagcagtggcattatatttttctcttttcttgcaccttgccatccccgatttatttttagagagccttttctatttctgttcccatttcttggcttggatgcaggggctggggtgcagggatggcgctagaaatcagaag

SEQ ID NO: 120452 - DNA, 1064 bp, Homo sapiens
caggttgggaactagacgccacctcttgatggaaagagtggcaaaaggtttgtagccatatttaatccacagacagccggtagtggatacctggatttgaacccagatctgtgtgactcagactcacagtctgtcatgccatactgcatccctttctgcttctggttccttgggagttgcaaagcttgctggctcttttgtgtggttggagagggctgatttttcttgtggtctcccacagtggaagttgtactagtcatcccccttttcacagatgagcatccaagatcactgtgtcttagggaaccttccaaaataggtttgctctagggatttgctagcttcccccaagcttcagcagtgatagccagacatgcatggaatttccctgtggagtttccctttctgcgcttagtggccttttgatgcacagtgctcactgggtgggattcctgctgcattgtagccagatgtggaggctagccctattttgagttatcccagatggtatccagcccagtgagtcccatacttgactcaactggcatattcaccagggagttttggggaaaatgtagattcctgggccttcctcatgcctattgaattagaattcccagggatggcgtccaggaacctgcctttaaagctccccattgatttgggagtacagcctggttgggaaaccaatgacttccagaggctggcaccctccctcagcccagtcatttcagaaagatgcctttgaagtcactgatcagaggaggccacatgggagagaatgatttgtccagagggcctcacacttcacaaccaggaagtgactcctgaaagtgtccaggaagtttctatttgaatctgctcaaatctttgatgttgttttgcatgctttgatagtatctgagctttatggtggcctctgggtgtttttctttgaaagtgtttgcagagagtagcaagctcttccagcagtcagcagacactccctaaccaggagctacttggtctgatttatttgaaatatgaaattcctttgcttggctgtctggttggtatctttggtg

SEQ ID NO: 120453 - DNA, 1060 bp, Homo sapiens
ctgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactct

SEQ ID NO: 120454 - DNA, 1114 bp, Homo sapiens
agggtccctctcttctcccccaggctggggtgaaggggcatgaatataactcactgcagcctcgacctcctgggctcaagtgatcctcctgcctcagcctcccaagtagctgggattacaggcatgcaccatcacgcctggctaattttttatatttatttttgtagagatggggtctcaactagttgtgcaggctatcttgaactcctgggctcaagtgattctccatcctcagcctcccaaagtgctggtgtgagccaccgcgcttggcctcttgactttcttgaatcatctttgccagctagctcccactgacctggggccttttcagtagggggagccagaaccgggcttggggtcatgctgcagggggagggacgtagcagtgactgggctctcctccacaggaccagcttcccaggctgcagcagctgctgaagaccttggaggaggtgactggccccacagtgctcaccatagcctttcttccatcttctacccagaccccaactatgcccaaggaaggcccaatgcagtgatatacaagctggctgggggagggggactggagtaaaggtctgaggacagtctctgaaggagcttttcttgaaccaagtgtagacttaccatctaaccccaggtaacttcctcttctctggtagtgccttccaggatctcaggccactccttctgccacctgaaggggtggcttcagtgacttgtcactgagggctctgccagccctaacatgagatttgtctccccaggggttagagggattggaggatgcccccccagttgagctacagcttcttcacgaatgtagtcccagccaggtgagtccagatgactgcctggctctgaggttacattctctgtcccttatctttttctatttaagtttatgttttcctacctcatgtgggaaatgtgggaggggattttgttgttttctctctcagcgataggggtcaccctgtgtagtatcttttagcccttggttccttcccctagggcagctctcccagactttctttgccctggagtatctttgccctgctctgtctgctgtccagttgcttgagacagcctagcagaggcagagtgcatgtcc

SEQ ID NO: 120455 - DNA, 1119 bp, Homo sapiens
cttttccggttagcgcggcgtgagaagccatgaggtgagttggtcctgaaagccctatccgcgttcatccgcgccttcaggtgccccgccgagggttcggatcctgtaggccgcgccgcggacccttgcgccacctgcgccgcggggcatttctcaaggcgggtcggcctgcgggtcgcccttcctaccaggtccgatcactgagagcctccctcttccaccggggcttgggtctgggtctgagctcccgtcgctctacttggtgtccggaatctacgggggagtccgccgtgggccgcccgcccgtctcgaagcctagacctcggaggcttccaggcagtccgagcgtgtggactccgcggccctgagcgccctgtcgcttctctcccgcagcagcaaagtctctcgcgacaccctgtacgaggcggtgcgggaagtcctgcacgggaaccagcgcaagcgccgcaagtgagtgccgaccctggggcacggcgcgggtggcgagggccggcgggtgcttaacccccctcctctctcgaaggttcctggagacggtggagttgcagatcagcttgaagaactatgatccccagaaggacaagcgcttctcgggcaccgtcaggttggcaccgttctgatcccacccagccctcagtgcccccgtgcttgcccctcccctgcaggctcccgctgagccggaggcgggcacgtcggtactgatgtgctagggtagttcagaccccctgctccgggcaggcgcggctggacggacccccaccctgggtcttaaaacatgaggggaggcgtgggtaggcctcggccgagcccgccggccagcctgagaagccaggctggctgctggtgaatgtgaacgctccgggtaaggctcggtggctgctgcggtcccagacccttcaccggcccttgggacccagggctaggcgtaacctgttggtgctgtcccccaaaacgcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaa

SEQ ID NO: 120456 - DNA, 1299 bp, Homo sapiens
taggaagcagacattcccagttgtcacgtgtccagggtccacagctaagaaataggcagaattcgagcccaggcagtcttgaccagagcatccgttgtacagcggttatgccatggatcatgggtcagcctggttttctgagagcatgttttgggaccagtgaaggtccagaggactttctggaaaccgtttgggctagggaaaagactgaggcggggtcttagagagggtgctgcttggaggtcacttacatgattgattcaagtgcgtttctggcctgccacatttgaggtgtgccttggtgaccaggttctaagcaatgccaatggcttcctctctctatcagccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgagtgggtctggcgggttgctatgggtgaaggtgttggcagggtctaaatcttatccaagtctctaaatatgccagtaagagcacccaccaggattgaaacttttggagtaaccctggtcttggcccgggtccaagtacctgctcaccaggccactgggggaggaaggacaggccatctgctattcgtccaccaacctgacttgatcctctcttccctcctcccaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagttccctctgtctgcctgtgattgagggtggggggtggtttgtcagctgacaagtgagggccttggcactgctgatggctagttgtgtagtttgtcactttgatgatggatagttgggtactatagggaagaggatgtttttctgccatcaaaatcaggcagtcttgcatatgtgatagggttgctaacggcattgaagctttttgacaggattggtccatgtaaatttaaaataaggattttagtcagcatttctgtgttaagaagaccacatgtggagtatcctatgctttgggttagtaatgagtaaatgttaaggaaaacaaggcacagcaaaccagtacaaaagtataa

SEQ ID NO: 120457 - DNA, 1015 bp, Homo sapiens
tgttgagtgtgggtaggccttggggccccccaagagatgatggcattgcaggggttggcggtgatgacacaccaggacctaggaggagccctcacctgaagctgttccaatccaaaggtctggcacacaagtggttacatgactgacccacaaacaaataactttaatttttttttttttttttttttgagcaggagctgggcctttgagggcccctgctccaaccccaagctgcatttatgatataacccatcacagctggattttaaaaatacacaaaaaaatatataatatacattataaaacctaggtggggtttggaggtggcctgagcgatatgcaaacagtgaggaccttcaggaagctcgggcagggtcgggatgaggaagggaaggggcacagtacttcatatgaaactcataaatacccacaggtggctgctggacaggcccagctggctctgggggcctgggtgttaagaagggacagcaggtgaagggttaaccttcagtcccagaactgggtctgggagctgctactctaggcaggtagattgaggtggggaagaacctaagggagcagtgcccaccaagggtttgtcagattcaagcctcaggcaagagaaaaatcaaaagccttctgctactctctccctctgggcctctggtctgcccagaggctgggactccttcctctaccttgctctcaatctggagggtgctggggggtgccccatcttcctggggcccctggctggcttgtgggctaatgaggtgctaatggggtctagtagctgctgtgctcccttcttcatgcccagtctgaaacaggtgctcccctaacccagcgcccctcgatgaggctccactccacactgcagagcctctcccctaccctgcggccagcccccgccccagggaggtagtataaacctgggctctggggacaagcagccctggatgagaactccagctctgcccacctctcctgtgggtccctcaacttcctggagcct

SEQ ID NO: 120458 - DNA, 1148 bp, Homo sapiens
cctgcccatcatgctcccccaagggtgggtgggggtacagtggccacacatgctggaggctgaaggtgtcccctatccccacctctctgaggtcacgcgaggctgggcagagcagggtgatggtgggtcagcgccccggacaggctgccccaccgctgagccctcctctcctctcttctcccacaattaaagcgcagaacagtggcagggagtgtgtgtgctggggtaggtggggaggcctcctgggtcctgggcctgaggcctggcaggtagatgaatcctcaatcctggacccccccaggggtgccaggcaggtgtggagaggagatgctcaccctgcatccttaaggaggcgcagagggcaccctagtctttgacgagcttgtagacatggtgctgggccccgtgctcactggtggagacttcgaagacaaaagcaatgacaagcagggtctcctgggagtcccggctcgtgaccacctggggggtgagcaggtaagagattcaggaggtcagggagaaaagggccacggggcagggggctgaacagaccattctcctttccggatctatgcctctcagccaagcgatgtgtctggctacccaacttggaggccctggcctgtgggactccccacgacccctgctgcccccatacctgcaggatggtgaagttctccagcacgctgttcatcatgtacttctcgggcaggtgcttcagcttgtggatgaagttgatcatgtactcgcacatgggcgagcggtggatacggtacacaaagcgcccgttctccagcctggcatactcagtctgcagagaatatggagaaggcgtcactcggcctgcctgctcccagccccaccaagccacccagagcccccactcacctccaccttctctaccacctgtttgccaaaggagcacaccttggtggagacgctgatggtcatgctatcagcagagctgtactgagagctgaccccatagaaggctcccgggccctcctggatggtgctgttgaggtcggcctgggcatgggggtggggggtgttaggtgctggcagagaccagaagtattcccgccacaccacatcagagtcctgcccaaggatccatctctggcactctgcccacaagccatgaggat

SEQ ID NO: 120459 - DNA, 1053 bp, Homo sapiens
gcctggcgggggccttcagccctcctgggcccctcacccacggcgctatctctgcatagctcaggcctttccttggccagctctccagccccactgtgcctcttttctggctgaagctctgtttctgcctctccttccgctctttctgttctttttctctttctttctctctctacaggtctctagccacttgcaagttctagccaggcggaaatctcgggagattcagtctaagctgaaggtacggggcccctgccacctggcctggcctgcccagcaccctcctgggtgcaggcctgtcgctgctctgtggctccagcctgggacaggcaaggggctgagaagctgtgagggggtccagaaagaaacacaagtggcagcaggaagcccaagggccctgtcagtgagggagagggagaccatctgggggccactaaggcccacccctcctcttctctgtttttctttttctccttcttcctgactgctgcttactaactgcatggggacttccgtgggcagggaggaggccccggggctactggccggcagggctattgaggtgggcatggcagttccttgcagagctggctgtcctgcagctgcggatctcagagtctggggttcatgactgaggcccttctgagggcctcacgctggccgtgtgctcttctccctgcccacagcggtgcagcagagggggcctcttacccccaggcccccatgcccagagcctagttccagaacatatggacagacccagagggcaccagcttgttttccctcactctgccctttccagggcttgccccagctggcaggcactccctctgtggggacggggagggtctgctgagcttccttgggctcctcggaagctaaaacccatgggcactgggtggaggtaggcgcaaagacgtccctcagcccacagccctggtgctgcacatgtcctctaatctatcttccttctctccctcacaggccatgaacctggtaagtagcacagccctccccagtgggagtgggggaaagggtcttaacacctaatac

SEQ ID NO: 120460 - DNA, 3181 bp, Homo sapiens
ccaaagtgctgggattatagacatgagccaccatgcccagcccttttgtcatttttgaaaaattgtaaacccatcaggatttttttttcaagtaagacttacgattttcccaggaaatgggatgttataggagccccatcatcacacctgttatcttgagggtcggcagccagcctgaaaaatgtggcaggagaggtctgtctgcagagagggcggcctccctacagcatagttggcattctggtcctgtccccagtctccaggaatgcccagacttcattatcccacagctgtcccatgtgtcaaccaaagaaaggtgaagctcccactctaactattggtagcacagccctgacctacccagctagatatcctagagaaaatcattgcaatacctcgtgtttgggacctgatacacagtctggaggagccaggaattatttcacttctttattctctaaccttcttgattgcttatttcttccttaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagggttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttttaaaaaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagagaggtcaggcgtagtggctcatgcctgtaatcccagcactttgggaggccaaggcaggtgcatcacctgaggtcaggagtttgagaccagcctggccaatgtggtaaaaccctgtctctactaaaaatacaaaaattagccaggtgtggtggtgcacacctgtaatcccagctactcaggaggctgaggcaggagaatcacttgaacctgggaagtggaagttgcagtgagccaagattg

SEQ ID NO: 120461 - DNA, 1227 bp, Homo sapiens
aaaatccttaactatattttatatatttcctcaatacttccaaatagaatattaacagtttgggaagatttgaggcttttggcctttgactagaattatatcgattcagtgtagtaaaacagctcagctattcagaggctctaatcggtgctatgatacagaattttggagaacattattggtaatgaaataatgttatgaagccatctgtcatatagctgtgttctgaatatatacagagagatggccagaattagtgatcagtagcagaaagcaatgagtgtctgtacagttacttaactttgttgcttatcagcatcacaactgcaagagtgatactattatgaacctacttaaaattaccaatctttggataaaatctggatcagcagtcacacacatggaaaaaattatttttaacatggaatttgataggcaaaatttttcaaaacattagtccattggggaaaaattaatgaaaggttcaaaaccactgacctgagacttttctcccagaatgtctctgaacattttgtaccactaaaaacttccctggaggcacctttataattataggtaaaagatcccagcagtagtcctagcgttagctgtaaaacttcaaaatggttagtagatagtttcctgtacatattcccttcccaactcagggcaggtttcaatctgccatactgccctcccgggccttgtctttccagggtgtctgacttggcatgttatgcatttgcacagagtccagatgtgtaggtgagagcagagatgggctgaactaaagatctgtatttcatgccatctgcatattggaattctgtttccattgatctgttggtttggtttatacctaaatgggtaaagcctctctcctgagtaggattgaattgtactcagcttttaagtgggaatgattttgccattgaagatgtaaagtcctcatttcaacctctgaatactaaagagaagaaaaatagagaactctatttggctctgaaaataattattaagtacaggtaacagcataatattaagccaggcattgtgcaagcgagttaaacagacacgatttttgccctcatagctgacagtgttctgcaggacaggagcattaactcacacctggtcagtgtttttcttttttctgacttggcagcagagtggcaagaaggctaagaacactgaagtgatgtgggattcttgcgcccccttgtgctt

SEQ ID NO: 120462 - DNA, 1051 bp, Homo sapiens
catagcacagctgatatacaacgaaggagctccgtgttcttattttgttcctatgtgtcagcttttttttttttttttaacttttttgggtagaatccaagacttgttcccttatttgttcctagacttgttctttttgtactttttttttcctgggttgaggacagaaaggttcacgttctgccaagtggctccttgggggagtggggtgcagcttttcagagctgaacggattgtacccttcacaggagtcacgaagaggcctgcactgtggctccaagttgttatcccaactgcaagtcctcgagggccactaggctctgtgaccagagatacaagaaagaaagcagctaacccgaagccattttttttttatacttctccaagtagagaagagagagaatttgtcagttgccttggattccagaaacagcatgcctccttgaacatatttccatctcagtttcactctggaggctcccagcagcagccgacctggacacacacagcatatacctgagctaggtatgctgttgtcttcggccacgtgcccctggcatttccaaagccccaccctttgtggagctcaaggactgcatttgtgttccttttttattcctgcacagtgctacctccacgttctgtacattcaacttttttttttttgagatagggtctcactcttgtcacccaggctggaatacagtgagcgcgatcatagctcactccagcctcaacttcctgggctcaagcagtcctctcacctcagccttccaagtagctgggactacaggcacacgctaccacacccagctaattttgtttattttttgtagacatggggtctcactgtgttgccccagctggtctcaaactcctgggcttgagccatcctcctgccttggcctcccaaagtgctgggattgtaggggtgagccactgtgcctgaccacattaagcacattaatataaatggaaacatgaccatttatattttgttagattcagaaaagaaatcattgtcctgtgggcctgtacctttgggctaaga

SEQ ID NO: 120463 - DNA, 1070 bp, Homo sapiens
catttccagacaatccatttttctttctcctcattgggacaatatcttccctttgtattgttttaaatactgagactaataaatcttttttgttttaggtcaagtgtatatagttttaacttttttttccgtcctttccttatgtttctgtcacgcatgaaccccaaacaaaaacacaggctattggtcaggcaaggtggctcacacctgtaatcccagcactttgggaggccgaggcgggaggatcacttgaggtcaggagttcgcgaccagcctggccaacatggtgaaaccccgtctctactaaaaatataaaaattagctgggcgtggtggtgcatgcctgtaattccggctactcgggaggctgaggcaggagaatcgcttgaacccaggaggcggaggttgcagtgagctgagatcatgccactgcacgatgcctggggtgacagagtgaaactcttgtctcaaaaataaaaataaaaaaacagactaccaagagccataatgtctagttatgaggcagtatgagtccaaaaaacctgattttctggggacacacagggtctgaatttaaacctggctctaccactgcctgtgtgtgacttctcaggaagcactctgtgtctttatctgcaaaaagggagcaattggtaagagcttgtagtccaagtgcttcttatatgcacattaaggcttaatggtcattcatagtcattatttgtatctctattctctggaggaaactcttaattcaagggcattaacgctgaattccttctgttaccatagtctagattatcttttggttaggtcttgggattcctcttgtggtgttttgtttttcagtcagatgagttgggtgccctggttccttcttcacccaggctgacaactttctgtgtaatatggaagtcagggtaggtgctgccagaatatcttggcgtgggcttccacctctgcaggatcatgtgcgccacacgtatcttgactgaatcgcttcattttaacctgggagagattgtagaaataatatttttctttagtcttctttaatcccatcaataatag

SEQ ID NO: 120464 - DNA, 1034 bp, Homo sapiens
aactaaaatgccatatgcgagctctaccaagccactccaactctagcccttgtttggaggagctgactcaagagttaggccctttctagtttggcccaagtttcttagaccccattctgtgtctgcaaggggaacacatcaagatggtattaatactggtgagttaaaaaagagtagtgagtactcacttcggcagcacatatactaaaattggaacaatacagagaagatttagcaaatcgaaaaaagagaagaaaagggtagaacgctttagagcataaatgtccaggggacatttcggcccctagtgtctacaccatttctgttcattcttcagtttttctcatttctcaggcctgggctaggggtaattcaattaaattattaactgcaggaattagatttgaagctggtttctggactatattgatattgagagtgatattaccaggtcatagaatcatagaattttagagcttcattgagatcatgtagttcaaaagtagaataagttagatttgaatttttatttggaaggtaatagttgttttattgggcatggaatgagtataacagaacgagtgatttttagtctctctacaagttgttgatctaaagtaaagtagatcagccagtgttagaaaagaagcattttaggaaatctctagatttgaatataggctattatgttacagaagtaggaataaaggattttctttcttttttatttttatttatttatttttttatttattttgagatggagtctccctctgttgcccaggctggaggctggagtgcagtagcgcaatctcagttcactgcaacctccgcctcccaggctcaagtgattcttgtgcctcagcccaagtagctgggattacaggcacgtgccaccacacctggctattttttgtatttttagtaaagatggggttttgccatgttggccaggctagtctcaaactcctgacctcaggtgatccacccgcctcggcctcccaaagtgtgggattacaggcgtgagcaccgcg

SEQ ID NO: 120465 - DNA, 2092 bp, Homo sapiens
accagtaaatgttttcttacacagagctctaaaacatgtttaatctggtataatttaccactaggcacaggaaaataattatagctaacattcctttagtttgtctctgtatatccacacttaacaacagcattttcacatgatagacaccctgacatatgaatgaatgaatgaatgaatatcaggtgctagattaaaagctctaattcagtatctaatttaatcctctcaacaattatcatttagctagtgtattatccacattctatcagtgaagaaactgagcttcagatcactttaattaccttgcccaaagtcataattgaagtggcagaatgggactggaatccaggtctaactcaagtgctatagtggtgtgaagggaagactggtaagggttggtgttcatggagaatttgttgctgggtgtatacttcttgtttagatttcctgttttgaaaacattcaaacttgatcaaccaaaagaaatcatttgcataaatgttattcagttccaggagccaggttccacgcctgttagcatctgtccgtcagttctgtaagcaatcttacagtggtgtgtgttcatcctaagtagtacaaaacagtgcagaggaggaaggcggacagcttaggggaaatctgaccaccatgcgtgttggaagtatttctcttgttctcctgcttttagaaagccatctctgcttgctttttcagggggttattaagatcctactctcttggatactgtgctctattaggcaggagacacaggcagaaagaagctcacttggcatgaattaggcaacagagaaaactcttgctcagtgggagtaacctgtcacaacctggttttctctggccagataaccagtcttgtcgagtagtaatgccattacaacattcccattcagatcctcatgacccagtaattgttttgagaatgagtgcaaagctatcagacaccaactactataattagaaaagggaaaaatagacacttaccagagctaatgtctttaggctggagcatttacagctttttgttttttgttttttaagttatggagcctctttctcagttttgcttcctaaaatacaaattgcatggtttaggggttcttgcatttcatttttgttactgctgtgcactctctttccttttttcccccctattttaatcggagtacaaattgctgtcagcacatcgagttcatgtgccagccacattcagaacagggtgttctgtgctcttcaaaacaaaattgctctagggcagtaagagaacaataagtcagagctccagtttaagtgatgttttgcagctcgcttgatgtggttacactccgattgcgcagctaagcttgggtaatttggtttggtttgactttgtggggatttggaggacctccctccccctttaagttacatagtctttaagtcaagaaaaaaatgttgtctctttttaacttgtttatttctttctctaccaaaaaagccctaagtagaagcatcctgtatgtacttttattctctttgggcatgtcatagatgatttacttcccgtaaatcatgctggttgggattagcaacagacctcctgagccctacaggctgcactcccagtgagtcacgatggttattattaaatatttattaagttagtatttgcactaaaagatgccaggtcaaaaagcaaccacagggcttccacagccagagctgccatggtttttgttctgttttgttttggtaggaatttttaagataacattaaaaagaataagtggagctataggagctaggctcatctgcatctgttactgcaatcagggcccctactgtggcaatcagcagtctttccgtggctccaagtggtgtgtgagttcttgtcagcagtctcgtagaacttttcacatcagtgttccaagtttagaaaccagttaacccagcaatgccctttgctacttgtagatgtagagaatcaatgggctgtattcaccatgaggctgtgatacctccttttactctgacattccgaatgttgtcagtattacaaggcgatggttttggttttttatataaactgggg

SEQ ID NO: 120466 - DNA, 1924 bp, Homo sapiens
gagccactgtgcctggctgactcctctttttcttatctcctacatgtcatccatcagcaaatcctcttggctctacctaccatggttattagagacctaaaattgtctctaataacagtcttcaaattaatgatatatcttaatagtaatcttatctaaatcacatttctcaaggttccggggaaagaataacattatggactcaaaaaggtttttactgaattgtaaacttttacttccttttcataatttgtctctgtgtggaagagaaaacttaggttagtttgatgggatttattctttctcaaggaaattttgatttttactctttatatgaggatcctaatggttacaaatcagtttttagaatctgtccccctacgctttttcttgtgtcagttaagatgaccatcttgtaatttttattcaaagtttttctttcatttaaaaagttactgtgttctaaggtactctaattgatatgattatgatgactgatacttcagtctttaagtttaattgcaggtcttggctacattgctacttttcagctttgctttcttagaaaatcaaatctgacttacataaggttctaaatagctaccagttactcttcccccatcccccagtctctcacatcgtctgatttgtcaactttagtggttggaagaggcccatcaaaatgctggctgtatgtggttctctcgcctctcagtactttcagccacatttgaatgcaaagaatgcagacagtcagcagtatttttaaatgtgaaattttcaacagagtgttctacaggttccagttgttggcgtacctcctttccctctccaaatctcactgaaatgatagatggagggaacaaagattttcaaaagaagaagaagagatcaataatagtgctggaaaggagaggaatgtaagagtggatcagaaattatggagaatttctggaatatgtaaagttgatgaagttgaaccaatggaaactagtctcagcaaatccaacccgagacaggtgtaaagaggacttaagcagaggtacacactgttcttctcaacaggcttaggcggaactccaagctcatggtcatctggtgtgagggagcccaagcaggctatgcagcaatcatcagggttgttataaaacaagatggaacagcggggccagtaaacctccagtgcagtagttctcaacttttcctgaatttagaattacctagggagcttttaaaaattctgacacccagaccagttaaataagaatctcacatctcagaagatggaactccaggcacaagtatttttttttaaactcccagattattctagtttgcaggcaaggactgaaaactactagactacggtctgactgtgactttttctcccaagctaaaaccagtaaggccaggttctaaaataaaatagaaaaataataaaataaatttaaaaataaataataaaacaaaatgtgcctcaaaagactccaagtgttaggacttcgactagggaaaatgaatgtattttttgaaacttttttttttttttttttttttttgagacggagtcttgctctgtcactcaggctatagtgcagtggcgcggtcttggctcactgcaagctccgcctctcgggttcacgccattctcctgcctcagcctcctgagtagctgggactacaggcacctgccaccacgcccagctgattttttttgtatttttagtagagacggggtttcaccgtgttagccaggatggtctcgatctcctgacctcgtgatccacctgcctcagcctcccaaagtgctgagattataggtgtgaaccaccacgcccggccttttttgaacttttaaaacaaatttaaaggggaaaaaagtgtaaagacagcttttcacagtaaataatactaaagtgttctg

SEQ ID NO: 120467 - DNA, 1786 bp, Homo sapiens
tgcagtggcgtgatcttggctcactgcaacgtctgcctctggggctcaagtgattctcgtgcctcagcctccccagtatctgggacttcaggcgcgccccaccacgcttggctaattttttgtgttttagtagagacagggtttcaccatgttgcccagggtggtctcgaacttttgagctcaggtgatccgcctgccttatcctcccaaagtgctgggattacaggcatgagccactgtgcccagactatagttttatacttatattttatagcattaggtagtttatcaaaatgaagaaaataatataaatggacagtagtataaatattattcattgaactccattgatcccttatattgtacctctcccaagggaataaatagaaatatttcaatggaaagtcatcctaatttggggattctagtatgacttcagtatttaacatagaactataagagcctatctgtaaaaatcccattgaaaagataaacatatcataaaatacacaaattcaagctatacctacacttgctttgtatatgtcttttgctttgtgtatgtctgttgcttttatcataccatctttttctcttttctttttttttttttctttctgagacggagttttactcttgttgcccaagctggagtgcaatggcatgatctcagctcactgtgacctccacctcccaggttcaagcaattctcctgcctcagcctcccaagtagctgggattacaggcatgcgccaccacacctggctaattttgtatttttagtagagacggactttcaccatgttggccaggctggttttgaactcctgacctcaggtgatccacccgttttggcctcccaacgtgctgggattacaggcatgagctaccgcgcctggctagccgtaccatcttttaaactctattctttactttcttcatctaaggttatgataatcatatatactacatatattatatatgattatataagtatatattattatgttgaggattaagataatgtacaccatcgcctagcattcagcctaacaaatggtaagcactcagatgttgattattattgtggcagtgttaggatttttcactggttttataatggaatggtaaaagctgtgttataacatcttgggtcctgacttcatctgttgactatgcatgcgtacaaaccttggaaacaatgctcagccatcttgcttagccccaggaagttgggaaagacagaatcaatctaagggaactgattattactactgtggaatatgttacagaaattagagtgaagaggtgatgatttctcttactaggttttcttaactaaatattagaggttgtgaattattagaactggtcatagcccatttaaaaagaagctgaattaagaacaaggattttcatacatacttctataataggggttctgttcttttaccctactccccccagcaaatatattttcactaaaatggaagagggcaatagatttggaggatgaaagaattatttctaccctttttttttttttttttttttgagacagagtcttgctgtgtcgcccaggctggagtgcagtggcgtgatctccgctcattgcaacctccgcctcccggattcaagcgattctcttgcctcagcctcctgagtagctgggactacaggtgcatactaccatgcctggctaatttttgtatttttagtagagatggggtttcaccatgttggccaggatggtcttgatctcctgacctcgtgatccacccacctc

SEQ ID NO: 120468 - DNA, 1028 bp, Homo sapiens
cccaggctgcagtgcagtggtgcaaccatggcgtgatactcctgcctcagcctctccagtagctgggaccacaggcgtgtattttttatttttagcagagatcgggtctcactgtgttgcccaagctggtctcaaactcctgggctcaagccttgacatcccaaagtactgggattacaggtgtgagccactgcgcctggcattcttttataatggatgaacatttacaaaatagtttcccaatttagttgtttggatgtttttgtttagactcttagctaaatgattctctactgtatagatttatctcatgcttttcaaaaactgtatatttttatagtatgcatttgccaaattttagtctaacattcccatgaccatccttttaaggaaaaactttgaaatacttttatttagccatacggttaaaatttagctggaactaagtgatctgtgtttagttgatgaactgatccatgctattcttgcatcatgactttttcatcttcccttgattcttttccctatatgcatttaagcctgtctggttcttttctcaagcctttgctctctactcccctttcactcaaagcatttcatgtttcgcctttataaccctagtataagtatcaaacttctcacctgtgacttttgcctctctctacatctctcttctacttttaactttcatgtttacaataagctacctttctcttattttcagttcttaccttctcaaacttcagagaatccccactgcttagtgttcttgggagatgctagaggttacacaaaatgccacctcccagaaggtcgaggcattttttttctttaaaaaaaaaaaaccttttagccaaatacttactcataagaaatgctccattttattctcagtagtatcttcagaaagatttcagaggtaattgcatctacaaaataaagacttagtgctaagaaaatgagcaatccgataagaatatgtaaaataaaaaacattattactaaattcttttttttttttttttttt

SEQ ID NO: 120469 - DNA, 1026 bp, Homo sapiens
taactgtcacccacacttctctcctgagctcaggccttatctctgataaccttctggacatcgcacaagcaccccttgctcaacataccccagccagagttctcttgctctccataaaaagcaatctgaaatgttcgaattaaattgaagagaaagaataaaaagtcctgatgagtggaaccatgaaatgtttcatcttttttccctaagtttaaaaagatcatgaaagtaatacatgtttaatgttaaactatttaaataatataaaaataaaatctaagaagtgaaaattccttcttatcttcccaaatctcattctccagaggtaacactgtttgagcagtttggtaagttatctttccaaacttcttctatatataagcaaatatacaaacacatatatacttttttcctcttggaaataggatcatgttacaaatcattctgcaactcaccattcacttaatagtacatcttgaaaatccatctgtcttttcatgtgagtattagaagattgtttatgtggaatgggtaagacgtcacctgctccatattagtgatattttcagagattagctgtcttaaagggaaaacagtgaaaaagacattttggcatgtaatgaacaatatttgcataattgtaatccagtgctctaaaatgatcatacccacccacccaccaaaatctacaaacaactgggaaccatggttggtggctgcaaatatattggtataaattacactgtttgtgccaggtgcggtggctcatgtctgtgatcccagcactttgggaggctgaggcgggcgggtcacttgagctgaaggagttcgagaccagcatggctaacatggcgaaaccccatctctactaaaaatacaaaaattagccgggcattggtggcgcacacctgtaatcccagctactcaggaggctgaggcaggagtatcatttgaacctaggaggcggagattgcagtgagccaagatcaggccactgcactccagcctgggcaacagagcaagagt

SEQ ID NO: 120470 - DNA, 1055 bp, Homo sapiens
aataaactgatttttttaaaaggcatgcatctatgtatacacacacacacacacacacacacacacacacacacacagacacacacacaaaacaagtgaaaatttattgtttcttcccctgagccccattctccagaattagctactattaatggcttactatattttttctaggtattttctcttcatatacattttctttcttttcttttttttgagagagtctcgctctgtcgcccaggctggagtgcagtggtgcaatctcggcttactgcaacctcccgagttcaagggattctcctgcctcagtctcccgagtagctgggattataggcgcctgccaccatgcccggctaatttttgtatttttagtagagacggggtttcactgtgttggccaggatggtcttgatctcttgaactcgtgatccgcctgcctcagcttcccaaagttctgggattacaggcgtgagccaccgtgcccagccttcatatacattttctttacacaaatagaataattatattctgttctataaatagctttttttccccttcatggcattcttaaactttccatatcaattcgtttgtaactgtgtctttatttttaattatataattttccattgtagagatgtataatagaagtctatgaaggaaatccactcccctcctttttttttttttttttttttttttaactataatagtagtgtttctgcatgtatttttgcttgcttctgtgagaatatctacaggttatttcctggaagtgatattgctgggctaaaggatatttgcacataaactttcagtagatattgggaaattcgcccttaaaaatattcaacaaatttgtactcttactaaagatatgaagtgttatttttctgataactgtacacactttaattttgtggattagaaggattaaacttctgaaaatgaatccttgtcatagtagcttgagatgttcagaagatgatacattaggtaatatatatgttccttggcttatggtggttttacctcctgataaactcattgtaaat

SEQ ID NO: 120471 - DNA, 1144 bp, Homo sapiens
acaagttatgcagtgatgtgaagatacaaactaaggtcattaagttttctttaatttataatttatattaacctattcattgaaaaggatttgatagtttgtgattaaagcaaaacaggcaaagaccattaaaaacaaagacagaaaatgagcataaatcacttgagaaataatgagcagaatgggggaatgggaagaaatctttataccagtaatctgaggcaagatagtttctgtgtttgaacattaaatttagctctgagcttcctggcaagcaagagaaaaaaggaaacagggtgacttttatagttattgtccagtaaagaaagctttttcaatttttcagaagagagaaactttttctgagtcataagttataagaggtttgttatgtgaattcttacatatggaacataatttatatttctaattttgaaaattattgaatttcttctgttgctgtcttagccatcaggtaccattctatgcattgtaattatattggtcatattaagttcatgtccactgttgtcaaaagtggaaataccatggctggggtgtgtttatgtattgcctctagagctgtagccactgacgaacaggaaactgaaagctaaaagttcaggaaatgtattgtatttagactgtggaaaacatatatatgatactttactgaaaaccatgctcttttgaaaactgaaatatgtatgtatttaattagagatgaatattaaggattcatatcagatgcttaaatatgataatagatacagtatgtgcattgtaggccaggaatattgtgcaatgctagaaaaaaaggcaacagattattgtatgtattcagctatattctttcaagaaacaaaacagctggcacatcaattgaattcctcaaggatgtcttatttccagagaattccagagttttagttttagcttagttccaaggaagaggaggtccctgttttacaggatagcctatttcagtcttagggagttctaatggttaacttctgttttcatacactgaatttaactttgttttcctgtgatttattaatacagtctatagctttcttagagttgagaagaaaatgattaattgatcaaactttttttgaaaagttaattgcatctcaagtgt

SEQ ID NO: 120472 - DNA, 1059 bp, Homo sapiens
ttttccatttttaatatgactatattctagattttctgtaattcatgatatattttttaagattttggctagatttgtcagtttggattgtagtttcttttaacttgtttttgtttatttatttattatttttttttttttttgagacaggattgcactctcttacccaggctggagtgcagtggtgcgatctcagctaactgcaacttctacctccctggctcaagcaatccttccacctcagccacccaagtaggtgggactacaggtgtgcaccaccatgcccaactaacttttctattttttgtggagacagggtttggttttaccgttttgcccaggctggtctcaaactcctgggttcaagggatcgtctcactttggcctcagaaagtgctgggattacaggcatgagccactgcacctggcttattaatttcattaatactttgcttttacctccatttaacaaactttggtattaccatatatgagatattttcatgtgtatgtgtgcatttatattttttaaatatgtgactgagttttttccctttttcttagattcctaggctatttcaatatttttatacctgttgtctactctgcagctaatgacacagatagcagtatatgagtttttcttttcttttcttttctttcttttttttttttgagatggagtcttgctttgttgcccaggctggagtgcagtggcacgatcttttctcactgcaacctccgcctcccaggttcaagcgattcttgtgcctcagcctcccgagtagctgggattacaggtgcccaccaccacacccggctaatttttttttgtatttttagtagagtcggggtttcaccatattggccagggcgaacttctaacctcaagtgatccacccgcctcagcctcccaaagtgttaggatcacaggcatgagccaccgtgcccactgagaatttaatacactttatgtaagttaattttttatgatagttatctagctttgccagaccaattttgttagtaaatttaaaacattaaaaaattttgaatcct

SEQ ID NO: 120473 - DNA, 1048 bp, Homo sapiens
gtgcagtggcgcgatctcggctcactgcaagctccgcctctcaggttcacgccattctcctgcctcagccccccgactagcttgggctacaggcgcctgccactacgccagctaattttttgtatttttttttttagtagagacaagttttcaccgtgttagccagaatggtctcaatctcctgaccttgtgatccgcccgcctcagcctccgaaaatgctgggattacaggcgtgagccaccgcctccagccacaaatactttttagtcgccataagcataatcaagaaatcattttgcaaatggtaagcttttcatgttgtgtattctttcccatgattagagaggtaaaaagtggcctgggatgcataaagatgtcgtagacctctgcaatctgccacattatttctttaaaaaaaaaaaaaagcaagcttctggactagattgatttttactgaaatattaatttttctttattatttttaaacactgaagttgaattgtataattcacaaatgcctatacaaaacttttttccatgtcctcaatactttgtatcagattatttatatttctcatggtttggtttctttttcttgtcttcatttttctgaaggtaaaaggggattttttccccccttttctgatctgtaacttgttttgtatttggatgattaccctttataacaaattttatcttctaattatgctattaagcgagaagatagtggccggtcacggtcgctcacgcctgtaatcccagcactttgggaggccgaggtgggcggatcatgaggtcaggagatcgagaccatcctggctaacacaatgaaacccagtctctactaaaaatacaaaaaattagctgggcgtggtggcggaagcctgtagtcccagatgctggggaggctgaggcaggaaaatggtgtgaacccgggaggcggagcttgcagtgagccgagatcgcgccactgcactccagcctagacgacagagtgagactccgtctcaaaaaaaaaaaaaattcttctaaattagattttagggt

SEQ ID NO: 120474 - DNA, 1098 bp, Homo sapiens
tctaatgaagttccatatacctcctctccagattctttaatgaacctccatgtacccattccccagattcattaattactgacattttggttatttgtatttcatatatttttttgagacagggtcctacttgttgctcaggttgaaatgcagtggtgaaatcacagcatgctgcagccttgacctcctaagtacaaacagtcctcccacctcagcctccacagtagctgggattacaggtatgcatcaccatgaccagctaatttttaagtttttttgtagagccacagtctcactatgttgctcaagctggtcttaaaatcctgggctcaagctgtcttcttgccttggcctcccagagtgttaggattacaggcatgagccactgtgtccagccatgtgcttttttaaactgttaaattctcacagagatcataaaacagtggtagtattggtgtaccaattttttttctgagttttttcccgaaattttgttataagtagagaaacataaaaaacattgtgttttagctcagagattgactttggacaaatggtaattatgaaactgtttttgtctttagctgctttttgtcaattcatagcctggaaaagaaaaagaaggattaatttttatgcttttcattagaataaattagtttaagtactccgtatctgtagaataaggtactgttcatctggaaagtttggttagtgtaatatcttaggaatgcaattcctaagatactggaattgtctaaatgttcttcttttgccttttctttctctaaaaccttcatcattgcagtgctttaactgccacctcttttttaggccccaaacctacatcactgtttaaacttgaggtctaaatattcgtctatgtcttgaaatgaaacgtatttaaataccatctctgtagcagctgtataccaacatgacccctccccactccctccagccaaaacacttctcttcctgacttccctcttcagctgttaatgactccactattcttattggtcattttgacttttccttcttaaactcagtgagtcactaaattcttttgtttctaactttatgtctctttatctt

SEQ ID NO: 120475 - DNA, 1051 bp, Homo sapiens
cccagaaaatggtcatttcattatcaaaagcagggttgcaaatttcagattgatcttttcaaaagttagatttgtacttgttctcagtgttcctatctctggaaactaaagaacctcctccattgttagctgaaaattgcacagtgaatttgaaagtcaagatgtcccagtcatggacataatgctgcgataggttactttttggaatggagaaaacatcttagagattgagtctgcatcagaatatattctgaatgagcatggaatgttctttacccatgttagatattaattaattaagtttttccatgtttaacttttttaaaaaagcaagacaataaaaacagtcttgtaatctgaacacatattttgggttttgttgctagcataaaaattattacctagtggatggtaacactgttttgaaattctagcttggaggagatgtttgttacaagagaaaaggtgtttcattgaaacctaacagggtaatttacatggagagatacttgtttctcttttgagttattgttaggttaagacataaacttagaaaaattgagatgctcatctttcccatcttagatttactttcactatgaactttataaattcttttttttgagacagtctcactctatcgcccagactggagtgcagtggcgtgatcagaattattcaagcttatgtatgtgtgtgtattacacatatattacacatatgtataaatatcaaatatcttttttacattatatataatggtatatatggttgctatatgttttatgtgtgtatagcagtatctatctatactgccttatttcccaggcatatttatatgcgaaactttttttctgtgaaatcttattgtaccaagaggaataagtatatatgcccacaaaaagactgggtcatagcagcttttttcacagtaggaataaactactgattcacatagcaacatagatgaatctcagaaatactgttcatagcaagagaagccaggcacagatgagtatgtataagtgtttatgatgccatttatgaaaaa

SEQ ID NO: 120476 - DNA, 1428 bp, Homo sapiens
ggttttggatttacttttcaggagtatgttttccagtggaataaggcttactactgaatgggagctttctttgcctctctgagtgtagacaggagtgtttattttcattgtcttcccattttgttagattgtggacaagggaaaagttaaagcatattttggttaagtatttttaatagtctgggattctatccacctcctccataagggtttttactttagagaattataaagtaattctctaaagggagctgcttctcttggtgtttgaatcaaaagccaagaatcgacttgaaaaaaattcttattctggtgggaaatttttattgtcatactttcacttcaccattttctgtttgtctctcccccagctgacctctgcctgacagtctgcaattatggccctgaccaatttagagattctatacaaatgacatttttaaaacgagggttattaatactcattatttgtgagaaacactttatttagttacccagtttttttcttctaatgtgtcttggttgatatctgtattaggtaagatttatacttcggagattaagtttaagttaagaacaaagttgctaatcttgatttaattatgctagtttattattcattgaatggtcattttacttatttgcctaggtaattacagttagctaatagctgataagagttcgccattgaaccatcaactcttcaaccaataattgtgactattttagattaaaaagaatatagtggtctttattgttttatttctccataacaagctatgaggtctttgtatgtttctgagtctttaattcttttagttatgggaattttgggtgaatttcttttttaaaacatatttttaatcagttcaaatgaaaaacttaaaatattgcattaggcaacttattaaatctttagttatctgtttattcttggaaaataatgcatattttgggttcagtttagtttcctaaaggcttctctgcttaggatgaattagtctggagaggaaagaacatcctgtttgtatacctgtagaagaagttactgctgttaaaagctaagttggctttttgatgtttagtgtggataggttgaacaataattcatcctcacgttcggagggcttattctatgtaaatagttgaaaggaactggataagactgtagcttccattattttttatcatttatataattgctctttagtgtacttaaatatataaaatactattaataattagttgtttattgtccttattctgtgatgatgtatgtatataaaccacatacaataaagttgcatttcataaatttatttacatatgtgtattttagtattttaactataaaagttaaagttttattaactttaggtttaattaaaagcccattttaaaatttagtttttagatattttaattact

SEQ ID NO: 120477 - DNA, 1039 bp, Homo sapiens
atgcatgtgaatgagtctagtgaatgcgaagtgcttttaaaatgagatgtggtttgagcagttccacaagcatgcccagggtcactaccagtgacaggcaggactggccatataatttgcagggcccagtgaaaaatgagagtgcagggccctttgttgagaaagtactaagaatttcaagacggcggcagcagagcattagacccagcacagggctcttctaagtacacggccctgtgtactacacaggtcacatacccatggaactggtcttaggtacagaccctgcaaagaaccgtactgtgccttaggaaagggctgctcatcccacatccaggtatctgcagccatagcgcatgtcatctttgaattctgaagggcagtaatgtttagggaaaatgcaagcacatgtgtttccaaatgccaaggaaggcaagtgcagtgatcagagtggttttctgggagagtgggtggggctagcaaggctgccatcggaactgtggaactgactgttctccacagactctggcctagaaaaaaaaagaaccgtgtagctgtatctacagggcctgttgttgttgctgcggtgtattacaacacagcctggcagcctcccctgcctttctgtcttcctcctggaagagcctggtcccagacatgtgacacgtccacacagccctctgcagatttgcccacactgctcctcactgttccctcaattattaggcttttccaggtctgcatgctttttgctcacgctgtcccctcctgcctgggagtccctttcccccttgtccacacccctctgtctggcaaacacctacttcatcttctaagattcagctctactgtcaggtgacctcttcaatgacgccttccctgcctctcgtaggaagagctgattcctctttccttggcgccttccattgtgccctatgcagacatctgtcacaacccctgtaacatgaagaggagaactgacatgttacgtgtatgtcactgtctcctaatgaagcccttgagggttgggacatatata

SEQ ID NO: 120478 - DNA, 2656 bp, Homo sapiens
gcaaaatttgattcctcatagactacatgggttagtttgtgggtttccacaagagtaccttgtcatttgtctgtgttgatcagtggctttttctgtactgtcttcactgcaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataacctacatgtttccaaaaatctctgttcatttgttgtccaaattgctctgccctgagtaaaaggaggaaaagattggttgagtatgctttttta

SEQ ID NO: 120479 - DNA, 1045 bp, Homo sapiens
acagaaagatacttattaaagacaagtatagtaaattgcaaggttaaagagtttggattccttggtgtggtagctcacgcctgtaatcccagcactttgggaggccaaggtgggtggatcacttgagcccaggagtttgagtccagcatgggtaacatagcgagaccccatctttactaaaacaatttttaaaaagaaaaaagctgttgttgtttcctagacctgtgtatattaagtttaggctcatttgtttgtaaaaataatttggagtagctgtgtgtaaggcaaaggattgttggagctaataacataaaaatgctgtttaagaaataagcaaagtgagaactttggtttgggaaaaacttcagagagtttattttcatctccattattaagcagtattgacttgttactttttagaatgaagtttaaaatattgtttccttcattttctcagcacaaacatttcactgaagatattcaaacaaggcaatatcgttccttggaagttctaatcggatctggctataatacccctgctgacatttggagcacggcatgcatggtaatgttttttccccttggctttcacttgttaagtggtacatatcttgccctgtttgctaatttcagtaaaccagcaaattaactagcagaaaagaacgtaacacagatgatttaccataggtattctaaattctatgtctagagaggtccgaattcaaaaacctgtctggcatttcatttggttactgctaagttcctgttaggtgaaggaaccaaaagtttcttactacagattgttagtggggggaaataatgaaaacaactactaagaggtgttgttggttttgattaggagattacaagtatctttgcatttttagcactcatctattttcagaccaaagaaacccctggaaactgcttcattttgtacaattcagcagctcctcagatacctttgcagctcccaagatgtgaatcccaatcattcatagattcataaatggctattttgcctctggcaagcaactgttccagt

SEQ ID NO: 120480 - DNA, 2337 bp, Homo sapiens
aaggtgtttttatatttaattttgatctatggactatgggcatgggttcttctgttgtggatggtaacagtttgtttcaagtttgagaaccaaaaggaaaaaaaattcctgcgcttctataattttctccagtaaattcccatgcaccttcatcacatttgtactggtgaggcctctaaaaaattcgagtttgtctgaatgtaaaccaaccccacggactgctcagaagaccacactttgttatttattctgtttttatttgggtttataagagtatcccgcatcttttaatttaatgaaagacttaagtgctatgttagggaaagatttgtgaaatttaattaggaagtaattaaagttaacaactatctccaactgggggtaattaattagccacctgaaggctttatctgtttgtaatctccgcccaggctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttggtataaatagaacatcacgaaaattactgtacaacacactttaacgttaatttatcattgctatataatacagtggtttcatacatacaacacatctctgggggtatctttataagaatatggatcttgtcataaatgttaggcaggtaatatttaaatgtaatttgtaacttttctcaggaaatggaacatagatttcatttaacaattgggtaaaagtaagatcttggcccttccggaaataggttttagatgtttagtcatgtttttatgtcactcagtataagttctagaaaatgttttaatcttgtgagaaatgtttctgttctttcactcacacacatatgcatatatctttttttgttcgtttgttccttagaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggtacctatgcagctatacttcctcaacactccttccctgcacaacacattcacagatttctagactaaaagtatgattgtttttgtaactatagctttacaacaggtgtgtctaagttacgtttaaattgtaatctgtagctaactttatccatcatgtactgagtacacagcacttcatttgttgctgtgagggcagaggtttttaattctggaaactcaaggcgttgctgtgctctttttgtctcagaaaatgtaagttgtcacttgggtattgctgactgtattactcttaccttggagagctttattactcattgagtatttctctgttcattgaacagtcttattgatgatgcctgttgtctgtaggaaaatccacggctggaaattttcttgttaatccccttgagccaaaaaatgcagaaaagctcaaggtgaagattgctgaccttggaaatgcttgttgggtggtaagttaaacttgccttaatggtgttttgaagtgactgggaggatgaatgagaatttggacttagttatgcaaaacatccataattctgtacccagattgatacaacacttcagtgaatatttttttacatttaaaaaaaccttttactatggaaaagtttaaatatacttacgaaagtagaatggtaatcgtgatcatgaaaagtccttctgttaccccaccccactccagatacccatcacccagattcagtaatgtcaactcctggccaatcttgtttttaatatatatatcattattaactttcagacactcagtgcctatgttcatactcccctactcccattttcaaaattgatgactaacttataaattgtaacctccttttaattcacttaacatattttggacactttgct

SEQ ID NO: 120481 - DNA, 1021 bp, Homo sapiens
tttgatttttttgtgatttttatcattttcttttcaccgaagtatttcttctggctgcctatgggaaaatattacagcttttaaccttttagtttttgcctatatacagatatatacacagaacacttggaatttggtaatatctttccccttatttatcctcattttgcagttttgcttgtaactcagggagatattcaaaagaaggattttaactcagagaaaatgttcaacaactgagattatctgagaacagattttttattcttcctataaatgaaatctggccagttagtgtcattaacaagtataaatgttcccatagaagtagcttgtttgggctacagggaaacgtgaaatcaatatttgtcctttttaaccatcttatagctaaatcttagcttcctaaagtaagggtaggctatgtagtcttaattgcctgtgtttgtttcttagggggaagaaatttgtggcaatgaaagtagttaaaagtgctgaacattacactgaaacagcactagatgaaatccggttgctgaagtcagtgagtattagattatatgtatgaatgtgaagaattataaataaatcaagtttcattgaataaaaacacaccaagtggaggctctttagcatggataattttctctataaagttctagtaaccttaaagaggtaaaggaagacaacaatatttacacataccatgcatgtagtagggaactggtggcaaatgctatgatgagaattcttcttacacgcatgaaccaaaaaaaaacctttcaaatgaataaaaatattcactgagcatgttttacaggccaggtagctactgtcataatgtttttttttcctactatggttaaaaggaaagttgtgtaaataaatgtatagcatcttttttgttgtttttcaaatatgttatagaatacataatataaaaatactgtatttactgattccatttatacctggaaactgagataaattctatcaaaaatgtatttttagttctgtttta

SEQ ID NO: 120482 - DNA, 1085 bp, Homo sapiens
gagtgatctaccagagcaggaagaggagattctgggatctgatgatgatgagcaagaagatcctaatgattattgtaaaggtaagttcataaagaggtatgaagtgagacatgagccatctatttgcaatttctcgtttggatgtttgatctatcagcataaacacagttttattgctgtttacttgtatccttttctctaaaacataggaaatagtatttgttcttagtctgacttaatttatcaaagcctaattttatattaaatgtttttacctttttcctctttaaaaattataatacatatttaccttagaaaatttcagagctgtgttaaacagaaaagaaagtaaaagacttctgcaatgctatcagccacatataaccagtgataacattttggcatatagatttttacaaaataccttcttaccactttttttctcatagtgatggctgttaagttaaactggaatgacagacacttaaatggtgtcattaggttgcctgttaatcttttctgtttcttgatgagactttctagagtctttgggtaggaacacaaaatggaatgtatcataccatctagaagaatgtggtccttcttattctcagctgacaaagataaatatgaaaataccttgattcttgccactgttggcagccttttcaggccttcttctgttttctggttttttgggggtttttttgttttgtttttttgagacagagctgcccaggctggagtgctgtggcacgatctcagctcactgcagcctctgactcctggattcaagcgattcttgtgcctcaggcacccaccaccacgcctggctaatttttgggattttttgtttttttgtttttgaggcggagtctcgctctgtcgcccaggctggagtgcagttggcgcgatctcggctcactgcaagctctgcctcccgggttcatgccattctcctgcctcagcctcccgagtagctgggactacaggcgcccgccaccatacccggctaattttttgtatttttttttttttttagtagacacagggtttcaccgtgttagccaggatggtctcgatct

SEQ ID NO: 120483 - DNA, 1031 bp, Homo sapiens
acaatcatctatctccctctgaacatttgttttcagtgtttataccaatagctgtgagcctttatttgtttgtcataagcttttataatttaacagtgtgtgtctgtttttgttttgttttgttttgttttttgagacagagtctcactctgtcacccgggctggagtgcagtggcgcattctcagctcactgcaacctctgcctcccgggctcaagccattctcctgcctcagcctcccaagtagctgagattacaagcacctgccaccacgcccggctaatttttgtatttttcggggtagagacagggtttcaccatgttggccaggctggtctcaaactcgacctcgagtgatccacctgccttggcctctcatagtgctggtattacaggtgtgagctaccgtgcctgacctatatgtctgtttttgaagttgtttctatggaacataattccagaatggatttcatacttactgattttattacttaccttaggaagctggtttggacagtaattttcactttatttgcagttaaataattatggatttagtatacatttggtagtaaaattaattcagctctaacactgatttgtggagtcatttgggagatatattgaaaatttacttgaatttggccacaaattaaaaaaaaaatttacaagagaaaatacttaaatatctaacatttttattcagtaggaagtagagccagtaaatttgaaacaatttaaaaaatgaaatagtatttgatgctttttacacttagcagtgcaccttggaaattggttctatattccatatagtgcagccttactattttttttagggtctgcctttttcactgagtcttagaaatagttccatgtcaggacagaaagagaacctcatctagcattccattaagttgatatgccataatttaattaattaattaattaatttatttatttatttatttgaggcagagtcttcgctcttgtcatccagtctggagtgcagtggtgagatctcagctcactgca

SEQ ID NO: 120484 - DNA, 1004 bp, Homo sapiens
ttgtagagagagagtttcgccatgttgcccaggctggtctcgaactcctgagctcaggtaatccgcctgcctcagcctcccaaagtgctgggattacaggcatgagccactgcaccttgctctttttctttcttcctttttgtctttctttctgtctttcttttcttttgtttgtatcccagcctccttttaagtagctgaaatgtctaattaagttggttagagtactgtgttagaagttcaagcctcaactaaggtaacttgactctgttccatgacttctgactgcactcctgatgacttccatttactttgctaaggcaagctgctagttacaggaggtgagtcaggaagaagatttgaggaagaagcatgccatagagtttggtctttggagatagatgtggttttgaattctgattttgctactttttagcaatctgaccttagacaagttagttaaggaaacagtcttatgtatatatcctgactggcagttcagtcatagtgaaaactgatcaggacctaaagatataaaaacaaagcgtttaaatgaaaattttagaaagttttggaactgttacagtaaatagcatccttagtaatttagtcgtgttgtgtcacaggcagaagggattttcagtcccctggtactgcagatcttaaacccagggtcttgaagctggtgacagaagaaccaaaacttggaattcagggtccctttccagctctgtgtttgttagagtggatttcctttgggttcttttcactgtgctggagtatttgactttgggattttaaattttcttatttagacaattcttcattttacttttgtggacgctgtgcttttatttactaacattaactagttggtgatgatctccattttactttacagataagagaattgaggtttgtcagattactcccctagaaaattgcaaagctgggatttgaacccaggtctgacatacccaaagccctggctaccaatcatgtgt

SEQ ID NO: 120485 - DNA, 1208 bp, Homo sapiens
tctgaactctggtctctcttacctgctccccaacgtcttaacttgcctccgacgtcttcacggtaggccttaaggaaattcttgaatgaatttttccgtgtttactttgggttctaccaaccacacactccctttcatagaggagggcatggggcttttccctgggttagtcaacttcctgagcctgtaaggcgtatcggcttttttgcagtgtgccggcagaccgctgtgtatacagtcggtgtctgttaactgcttctcttctgtctaaacctcaaccagatgcagataatcttccggagtggacatcacaatagtaacgggagagttctttaacaaacattgatgattctggtttggcgtattaagcgccacatgtccagttttatcagtaggatgcataacagtagtttagtgctatcgtggcaagttcaaaagttggtcacagcctagtagaaactcaggtagcaggcttagcagcaagtgaggctaagccttaagaactttcatcatgtactaacgtttaattgcaaaggatcttggaaatcagctcttacacactttgtattcagagagagcttgtatgcctagttattaatacatcttaattttagatgtattatctttatagttttacatttatttgatgttttgtggcatcgtatgcggtctaattccctctgagctgatacaacacatttcaaaggccttcctaggtcaccccactgaatgacaataccagattaggggggtgtaggggtgtgtgttgtttttggaggctacctactgtttggggagagcacataatgacttctctctttcaatagaactaaagtggtaggtgacctcacctcttgctccattttctcttctgtcttatgaaatgtattttgtaagtgcttggtgacgaagtcttgtaaatgagagtttgtgtgtgtctgtttacctttggattatccatatatgggattattcaaaaccagtttttaatcctagatcgtttaatagaaacagcaaggtgctaacttggttctagtgtgcagtaggacttgaaatgttacttttctgtgcctagtttagttattctttgtggaattgatgagaatgtgttaaaacgttcttttctattgatacaaggaagttgcagtttttattatattactctgtattttttagaaatcctggtctctcagactatttgtccagat

SEQ ID NO: 120486 - DNA, 1021 bp, Homo sapiens
atgcgcccacgctggggctccggaccctgggtcctctgagcagacaagctcggggaactgccgggagaagcagaagggcacagcccaacccgaagactgcggtcatctgaacaaaactgaccaggaagggagctctctccgggcctttttttttttttttttttttcaaaactctgtcgaaatcccatcttgaaaagcgttctttttgaattcgcacttgaattaacagcgatccatagagcttaaaataccgactttatctcggtgagcactgtgccagcttgagtggtgtgtttccgattcggttgaaagcgtatttcctttccgtggaggggcggcggtggtagtgcctgcaagaacactgcagcttgagaaactggcaggctcactgattagtcacataccactgctcatttaagtattgttcgacaaaacaattttctcatttggagcaagaaagattcagatctgtaaggcgccctcaagatcaaaaagttattaacagtgctgggaggtattgtaaatattttttgagataattcctgcgaatactgtgttttaaaagtcccttagagagcttgcagggagttatctagttatctgcatttatggcctgaggtacacgatggttttcgtaaggatatggaaccacatagaaaaggaagggaagagatactttttagctttaatttacaccgtgagtgtgttttaaattaagtcgatagcatataatttccagacctgaaatatttcactaactgctctcttaacttccaaggttttataccctgtattttagattttctataatttgaaagctacggatcttaaactaagtatcagatttaactgttagctttttctgtgttttagtaattcgtattgtatgcgtcatttgaaaacgggcctgtaaaatcgtttttttgttttggaacaaattccaggcttttggatgtgttaatctttaaatatgatttctgtgtttcccaaagtcacatcatgaatttcctgtttggtagaa

SEQ ID NO: 120487 - DNA, 1013 bp, Homo sapiens
acataattttttgtgtgacttcttgaactggacctgaagtctacttccaaaaaaatctccgaattttattttatttatttatttattttgtagagatagggtcttactgtgttgcccaggttggtctcaaactcctggcctcaagcagttcccccaccttggcctcccgaagtgctgggattatagggatgagccaccacacccagcccctgaattttattttcaagaatgaaaataaatgaatagaatatttcaatgaataaaattcattcattgaaatatttgtcagtttccgaattttattgctctaaagtgtggtatactttgtaacatttacaaattattttaagcctatattattttaatttatactaagtatagtaaaaaaacaagtagaagcctgtgtgataaccaactatgaatcaaaatagagttttacaaatatgcctttccgttaaagggtaaagggaactagactaggtcttgcagttttaaggaactttatgcattgtctgtgaggggaaatgaagcaaaattgtttaagaatacattgttgcaaagcattgattttggggttttgggacagaaggggagaatctttgtggtgagtttaaggaaatacaaacaggaacttaagtgcctttcctctggggtagggttcttccaggcccttgctgttgattagaggaggtgggacactggtaaccatgaaataggaggtgacagttgagaattactcttagatcttattcaactgtttattcaacagtgtttattgaatacctaccatgggccagatagctaggttctggaaatagagtgctaaacaagacagaaacaagacaatccattctctcctggaacttacagcctagtgggtttaataactacattttgtggattgcttgctatgttctagcattgtgctgtgcactttatcatcagcataaaaagtatataacaaaacctttggtaaaaggatagcaaaacttgctaagaaatcaaatacaact

SEQ ID NO: 120488 - DNA, 1161 bp, Homo sapiens
agctcttgagtttagctgaaaaaggaagattagtctgctggcagattgagtgttttttaacttctttggcttttagggtttttcttacttttggatcatgttttaaaagtcatttttaccttctttcaacagttaaacatttaagttttatttgattttatttgaccctttttctgctttacattcctctgccttttccccattataatacttttagtagaggttagaccattgttatctgtcattaatgtcttagctttgaggccccaaggacttctctgttaaacttaaatatatcatatagattgaaagattatctacagacatgtgatcctataaaaacccatattatttattgtcctccctgcctttacagatgtaaacccctctcctcttttcatcagagctccccctcttttactgctctatcatcaggttgcagaaaataagttttcctgcaaacatagattcccatggcaacataacaaaaaggtaatagaacaaatgtttattttgtctagacctgctgtctgagtaccattagaccctgaacatgttggctcctgttatttgaatatgtggttacaaattccttattttcctcaaaacttacttctcttaggccttggtgatattgtcactgtgcctgtgatatgaaggaaggtgtgtgtgtgtgtgagtatgtgtgtcttactgtcattctactcaaaagtgtgtattgattgcattttcaaacttatggcttaaaatgtagacaccacacaatctgagcatgtgaagaaaaaaagcataccagttttgttctttgttttcgtaagttcattaatttaatatttccagtgcactatactagatattttgtttacagagattttaaaaaaaagaagggtccctcctttcgaaagtatcagtccaggctgggtgcagtggctcacgcctgtaatcccagcactttgggaggccaaggtgggcggatcacttgaggtcaggagtttgagatcagcctggccaacatggtgaaaccccatctctacaaaaattagttgggcatggtggtgtgtgcctgtaatcccagctattcaggaggctgaggcacaagaatcacttgaacccgggaggcggaggttgcagtgagccgagatcactcccctgcactcctgt

SEQ ID NO: 120489 - DNA, 1044 bp, Homo sapiens
cctttattttacaagttcccatcccaggtttcttatactgaattccttatctctgcctcattcttgaagagggaaatggaagtggggttttggattctaccatgatagaagggaagacctacaacaaggctattcagcagcctttgttttagtgaaagccaatgagaagagatcacttcttccacttactaacaatgattgctcaactaataagtttagcttttttatttcaatgtaaaagttgctgaaaacactgaattggtaaaggaaatttctggatttacattttaacctgatgttgttcaataaatatttgaatatctaccttatgctaggcacagtaatagtctctgaggaatataacagtaaataagagctgaggctgttaatgggagagaagaacaatgtaaatgatcaaacaaaataccatgtggtaagacctgaaaggtcctacatgagttggtctccggtgtactctctaatctaacctcacctagtcctctttccactctgtctccaccccagtcactctggcctcttgttctttgagtacagacaaccacatttgcaataagacctttgcaccagtttctgttattgccctggaactttttccccacatacctacatgactgtctcctttccttcaggactctacccaagggtcttctcatcagaagctcttcttttgttaccattctaactgaaatagtacccctactgtcactgtttactccttaccctgctttgttcttagcaaattttgttattgtctgtcttctccctttctttgtaagctgtgttcaagcacggagtttgttttcttcgttgctgaatcattattggagtatatgcactccattgtttgttaaacaggtgaacacaagaattgccattatagggcaggtatagagtgctaaaggactgcatagtatggccacctaacccagacatggggtgtcttcaggaaagcctctgcaaaaaaaatgtatacacagagggcttaacggatgaaggagagttggaaaggtggggaaagtacaa

SEQ ID NO: 120490 - DNA, 1054 bp, Homo sapiens
gtatcagtccatgaaattgttttcagcttttagcctaataaagtccaacttaacttaattcctttgtaaagatgtgagaactagatagctttccaaccatactcaagtctaaccttccttaatttactttaatttactttacttaatttactttaggtgttatatacattgacaatattaggcatgtctttactaaaatgtaattgactatgctttccagaaacaaatactatagaaattatgtgactctccattaatgcctcttttggaatgtgcttcttaaaatgtgctcatttatattccttgccccccatcctgttcattatttttagaagttggtgcatcttccataaacaatcagcaactttgcatgatgcttgcttttgtcccctgttgtaagacttattttgaaaatctttctatatgggagttagaatgtaacaattggtggtcatggattggtctttgggcctcctggaaacaagtatagtgattaagttagttcctgcaagatgcttctgccataaataatgcctttcagtttatttcattgtagcttagtagtaatgcttgatagttattactatatagactgattaatcttataaacttacataatgttttggcagtctcaccctcgttctaaattttggtgataaaatggatgtggtctctgagggggaaaggatttgagagaaattacatagtggtaaactgttctaattaaaagctctttccctctctctctctctctctctgttgccatgcagtcagtggtcctctggctgcctaagatttcttaactcactggtaaccatttacacataatagctgtacttgaagttgctatggtttcattagtagttttgcctaacctttgtgaactggctcaggcctattagttaggactagtattatttttatttaaaaataagttatgtttgtctcttctccataaaattatttagaaaagttcaaagaataaccctcttattatccaatgtcaaaaaatataattatgtgcaaagtagtcttatatgaccgaaattagatt

SEQ ID NO: 120491 - DNA, 1018 bp, Homo sapiens
gctgaggcggggggatcatgaggtcaggagatcaagaccatcttggccaacacggtgaaacctcgtctccactaaaaatacaaagattagccgggcatggtggtgggcacctggagtcccagcaactcgggaggctgaggcaggagaatggcgtgaacctgggaggcagaggttgtagtgagctgagattgcgccactgcactccagcctggcagtagagcgagactccatttcaaaaacaaaaacaaaaaccaaaaaaaccaaaaaacttataaaagtcttctgaagataagaactttcttaggggttctagattgttatgtaacttttcactaatttctaggtatctggtgacccatctcatgggggcagatctgaacaacattgtgaaatgtcagaagcttacagatgaccatgttcagttccttatctaccaaattctccgaggtctaaaggtacagataatacaagtaataattttttaaaatgaattctccctttctcccctccttttagggcttaaacaaacaagtaaacaacttttctaatggaaaattcaaacacataaaatcacaggtaaaggtcatatagtacagtaaactgccatgttcactcagtgacaacagttaccgacatatggccaatcatgtttcttttgtatttcccaagccctggattattttaaagcaagtctagacattatataataccatccatagatacttcagtttgcatatctgaaagataaggactcttcattcttacatctaaacaataatttattgatgtaatctaatatctggtcagcgtaatgttgagattttcaaaaaatcctcaagaaagactaatttatttgttggaggggcagataaacagtgttttaaaattaaacccatctttgatatttagctgctttgagtccttattgagctccagagtgccaaccagaaaatagattaaaagctcaactgagtggagtcaatggctgtggaaattatagtaatggtaaatgtacaca

SEQ ID NO: 120492 - DNA, 1002 bp, Homo sapiens
ttatgctgatttctaatcttactattaacactagcagttcttactgattcatgaaaatgtgcagcaaatatgttatataatatgacaatagaaggttggaggtaactttgacttttttctcttttgcagtatatacattcagctgacataattcacagggtatgtattgtgactttgattacattattttggggaagtggggtgagagtggaagaatggcatttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaagactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagaggtgataactagattaaatacatttctaagaggagaaatggcagaaacccactcactcaaaataattcaaataaaaaataagtgaattaattgtttctaaatagcaagcagctctagaacttttgttccatttcatttttttaacttgaaaaaatgtctgtacattagaatgcaccatttcat

SEQ ID NO: 120493 - DNA, 2206 bp, Homo sapiens
tcttttctggagtttcatgtaaatggaatcatatagtgtgtatttttgtgtgtctggcctttgcttggtgtaatgattcggtattgttgtgtgtgtcagtggtttcttcctttttattggtaatagtattttgttttatgaacataacagaatttttaaatctatccacctgctgatggacatttgcttgagtttgaggctgtgtaaagcaactgtgaatgtttatgtgcaaacctttgtatggacgtaagttctcattgcacttgattaaatacctgggagtgacatttttgttttgctttttgtaatttcattttaagttcttgctgtatatttaccatacattctaagtatggaccaggaaatctctttatgaaagtgctattttgttctcctttttaataaggcaacagaggtttgtttgttgttgttgttttgtttttttttccctgcctgtttctaagtcttagcagtttgtctgttcctcttctgccctttagattctggattttggactggctcggcacacagatgatgaaatgacaggctacgtggccactaggtggtacagggctcctgagatcatgctgaactggatgcattacaaccagacaggtattactcgccttggttatttagggccttatttaattccatgttggatgcatttgggattctcagaaatagagatggtgggagtgggaagaaatgtcttttcttccctcagtgatccttttaaagcctgcaagtaaaaatatttcacttcctcagatggggaagtggggttttatacacagcttttaaaccttgtgatttagcaattgggtttttatttatttagattttgaatatattctctgagtacttatacctaaagacaattagtccataattttaacccctcaatgttacttggaagaatctaccattctactaataagaaacttgcccctttttaaacagcttatttctcttaagtgtgttttgacttaccccacctttgaacagccctttagtcaggtgaagatcttagtaagctatttatttctgtaaaaatgagtatgattgttgagcctcagatgtcttaaatagtaatttgaatatttcacccctagttacggtttcatttgttgccaagaattgtaacagtgacattgcatatacttttacttctttttaattttgccagttgatatttggtcagtgggatgcataatggccgagctgttgactggaagaacattgtttcctggtacagaccgtatcctttaaaaagttttggattcttgtttcttatctgtattccagtgtccatgggtgtatactccttttacttatctctagggaagactctcagtattttgcttttatagtctagataatgcattatgaggtctttcttcaaactgagtagcttgccttgccaagaaagaggcttcagtttacttttgtgagttggaaaaattcctcataagttgaaaaacccatcaagtctgtcttctttttgcaacagtcccttattaatcatcccacagcagttctgagacctgagcatactcatgagaaactccagatcccagtgacagttttagtcttcttgtataaacacttaatgagcacaagatgcccatttataaatgaagggcatcttgctgttatgtttatgtattaaaagggctatgtttggtacctgcagtgatatactgcttacttgttatgtttgttgtttgacaacaaatagtaaaagcaagaagtgaaaagcttaccatgtaatgtacttttgtttttccagcacaactttttcccagattgcagccaaaccctaatttactccaagacttactgtctagtttatggtttattatagcccctttattttagctcctttcctatctgcggtatgcttgtttcatggtttagtattaatgtcatgaaaaatgtggtctgttggaactctcatcagttctacttatggaagatgtttaggtgagaaagattgttaaaatatatgtctagaattagttttggggattttttctttttttaatagaattgagttaactagccttcaggtggttttggttaggcaatattagacatgctacctctgatctattatgcctagagatctaaaagccattttagtcccttacctaaataaactaattgagtttataaaccagaatgtcaattcacttgcttacag

SEQ ID NO: 120494 - DNA, 1046 bp, Homo sapiens
atttctcaggtaaagctgtttctttctctctgaatattaggattgataacagagttcagtctccctgtatttagcttaccttattactccctacctctggattttaaattagtttaatacctggtgtttctcctttgtcctttgtttcattcaccttatatctgtttctcagaaatttggtatatatatattacagtccaaggtaagagaattagggaaaattcatacttccccctttcctcaggtacatatctcagagtcccatccttgctttgtcctctagagtagctgctgtcctgatgctattctctgttccctgctccccttcctcttcttgtgtctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcctgtctcacagacacctgtctattccctgacccttttaaatgctaactttctgcctgtaggaaatcttccctttgtgcttaggtctttttcttctgtgagctttagataaacaacctagtgtttaaactttttaataagggattcattttttaatacatgagaattcatttcaaaattttggttttagttatttattttattctacttggct

SEQ ID NO: 120495 - DNA, 1042 bp, Homo sapiens
tgaccgctacatcatcaccagtctgttctttcctggttgtatgtttcactgagtcccaagttccagttttaccaataggagccatgtatgttgttttttcaagtttgacccattttccttctgaaattaactcctctgaaataatatagtgtttccattctgagacaattcagttggttcttggctctcccttttcaaactagtctttacagccctcaggagagaagttcacctccaaagtgtaggggtgacaaagggaagaggacaaaagaactactggaggcagcagtgtcagcatacgccggtgtcacgactcaagacatcggcacctcccgaggtgatgaaaggatgtgccatggctcatcttttcaagtcaactagtatttatcaagctgctctgtggaaggtgctggggacaggatggtacctgtccttaaaaccagaatgatcagactcagtggaaagagagttacaagagttacttgaacaactgtctctgattataaaataagatggagtgataaatacactagaatagagttatagataagctattgaaaaaaatccaagaagacttcatggcagagttcttgtttgaataggacttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacggtggctcacgcctgtaatcccagccctttgggaggccgaggcaggcggatc

SEQ ID NO: 120496 - DNA, 1105 bp, Homo sapiens
aaagcttcattttagagattacttttgatgcatatattgtaaagccacttgtttgagatttgaagtagtcaagatttttcccatatatgatttactttatcttgtggtggctacccagttaaatatattcctgaagagtgttaatgtgaggaaactaaattttttgaattgagtcattttagatgagcaagaattttttttactgatttctattgtaatataattaatctgattattttagagcaagacagtatccatcccacccccattcctactctgtcccatgaacatatgctataagattttttacttgtcaacatcttgaactgagaagccagtattaaaatcttaacctttataacacaatgatttttgccatttgcagatgacaaaattccctgttattcttaatttagaaataatgtgagtggacttgtttctagtttgtttttgcttgctaaagaacacaagttgtttgggtttagggtggggtttggcgcaccttttctgaaagggccaggtagttaatattttaggcttgggaaccatatggtaactgtgcttgttgtaattggaaacacctatagactgtacataaatgaatgggcatggctgtgttctaataaaactttatatataaaacaggcagagcctggggtttggtgactccagcctagaattttcttccatttaagctgatttcatgtctgaaagaaagtaaaagacaggatgtcaaattactgcattaagttattcctataacgtaggcacctgtggcttatagagactgttgtttttaagtgctgctatgttgcctttatatgtataaccataagcaaaaatttctttcatcctgctctaccttttcctcaaatattttgactacctgtcatgtaccagatgttaggctggggataaatggtgaagaggcagagtggcccctgtcctcgtagagctgtagaccagtacagggggcagacagtaagcaaataaagtaattctaggctgtgataagcactatgatgttatcaagcatggtgctgagagagaattggggggtggggtgttatgtatatagagtgttgaggggaggcctcccttagga

SEQ ID NO: 120497 - DNA, 1032 bp, Homo sapiens
tactgacactgtgatggcagatgaagagggcagtgtaaactgagtgaagctcttgtgttttcacctgctgtctttggcagctaagaaccagctaaagttgcctcactttactgatacatgctgttgacagatgcataaaatgaatataaagtggatatgtgtttggtagcattttgaatctttgtacaggaggagcatgccctacgtgaagtgatcatcctgcaggagccttgacctagagggattcaccgtgttggctaggtttggggtgtttcatttttgttctcggtgtgttctgtttgtttgtttttgttttgtttgtcattgtttgtttttcatttttattttgtcccaacattttcctttatggtccaccattagatattgatcagttgaagctcattttaagactcgttggaaccccaggggctgagcttttgaagaaaatctcctcagagtctgtgagttgatgctttgtaattatctgccctgttgggagcctctgccacttgccttctaccaatctgtactttgacctgggtgtgtttgtaagcacacatgccctttgtgtgctgacttcccggatgagtgaggtataagacagtgtgagtgtgtgtgtgcgtgcacgcatgtgtgcctgcttgcatgcacaagtgtgttttattctctatctgggtacacactaagatcacgggagcctccattagacaatagtatcccagtaaagcaatgagatttgagattctaattcattccaagagattaatgtaaactttgtgtctctgtcctcaagacctgactttcttctttctcagaagtttcacgtatgctctagagctcttttcactgtttctagtgtttgttctcagagcatgagcttcaccatgtatttagtttaacttaatcactaaaagaataaaatgtacattgtctgcacactgttgccccttcccagaagttattttttattgttttagaatagatactcacatatcctatgtaaaatgtttgttcccaacagagggacctttc

SEQ ID NO: 120498 - DNA, 1411 bp, Homo sapiens
atctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccatgaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgctactatcgtgacctttatcagaagggtagttaactgaagtccattagcatgctttccaattcatccatttttttaatgaccaaaagaggattctttatttaaaaacaaaactgaaatatccaatactaatatgtactatatttaaaagaaaatacacaaataatatagaataaatacaaacactttggtacagttaggtaccttctttattaattattaactacttagtctaactcttgttttattatcagagatgattggggcacttctttctttgtaagatacccttaatattttggggaaccaggttggcatcacagagggcccttcccagcagctttgtttctacttcagctatattcaggtcgtcttttgatttatctttattaaagggatgactgttctctgaatgagatagttctctcttacctgttttcccttcctctttttatttacatgttcaagtagaaagggattacagccatttatgtattcaattcctaaaactttcttttcaaatcagaaagattctcaattgcttttcaaagcagacctttcctcctgactccacatgcaataattaagaagcggaaggctgggtgtggtggcgtgcacctgcaacctcagcactttggaaggctgagatgggaggatcagttgagcccaggagtttgagaccatcctgggcaacacagcaatactgcagctctacaaaaaaatttaaaaattagggcatgatagcacatgcctgtagtcccagctacttgggaagctgaggcaggagggttgcttgagtcaggagttagaggccatagtgagctg

SEQ ID NO: 120499 - DNA, 1638 bp, Homo sapiens
gtgtaaacataaatatacatacatacttttactgttggactgtattaaaacaggagttttaaagaggtggttaagatagacagcagactttgcttctgaaggtgatagtgggatagcagataatgtttcttgaactgtcacttggaaccaagtactgtgttaagaaagtactaggtttgttatctctaatcttcactccaaccctgtgaggtaggactgttatattaagtttatattaacttttttgttaccaccgttactttgttagcaaggtttaatattgatatcctttgatgtactaagagcacctactgaagtcagcactgtcaaaagactgctggtccaagacttgctttgggaataccaacccctctaccaatttagctgtttgagaaggctgtctcagggctacttcttacatatcttggcctcagtttttaaacttctcatcctgtgatcagaaagctaatgaaagagaatttgattgatgagcattctcgttcacttgaaatgcaactgtgagagatagcaggaataaagaaggtgatgatcataactagggaagttaggatggcagtaagggagaagttctatcaaagacagttagaaacactgaagttagtggactttgtcagttaacactcgttccttagcaggaccaagattctttctttgagagcagtaacattattgaacaaagtcattctgaaaacccttgttttttcaggcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaaggagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccgtcctctcctgtttgtggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactaca

SEQ ID NO: 120500 - DNA, 1076 bp, Homo sapiens
cttgaagaggacagtggacagtgctgtttaatggtggacacagaaggatcagaccaggacctccctacaatagggaagggagctatgctatggtaacgagtataatctgccttctcacttttcttaagattgtattgtgtggtgtgttttaaaatctcactgcatttctttgcatctgtttgggtcatctgtcttcttaagggtcttggcagctatgcttcaggtttagttttatctttttgagggctgacagccatgctgacctctttagaagctggggtgaaggctaggtgattttacctttttaagtacttcatccatagtgattatggagaggaattttagtgtcgctgtgataattcttataatagcagagatactcacgctctttgaagttttgggcagttgtggatgagttcgtgtcagccttggagacagagagtatgtcatatctcagctgggtcgctctcctgccctaggatgaatccacagtctcatcaggggtgggtacgattctactgagactggcttaggtttgcatctgccctggcatgctctcattggctttgtgtgatttatttgagctgtattatctagttcaagggtctgtgagaagctctctttgagccttaagtactacaggatgttgggaaaagatgttgtgttctttctttccttttttttttgagacagagtctcgctctgtcgtccaggttggagtgcagtggtgcgatctcggctcattgcaagctccacctcccggctttaagtgattcttctgcctcagcctcctgagtagctgggaatacaagtgtgtgccaccacacctggctaattttttgtatctttagtaaagacggggtttcaccgtgttagccaggatggtctcgatctcctgacctcgtgacctgcccgcctcggcctcccaaagtgctgggattacaggcatgagccactgcacccagcccgtcgtgttctttcttgtcgtcattctgttctgaagttgtttcattttataagccttaagttttgaacagggcagtactcactgacaccctcttaacagactcagaaag

SEQ ID NO: 120501 - DNA, 1489 bp, Homo sapiens
gttttgtcagccactgactttgtttcactgctattcccaaaacatgaattaaaacttaaattaccccttgatgttagtgtatgtatttatctgtcaagattttttttttttaagagatggcatctcactctgtcacccaggttagagtacagtggcacagtcacggttcatgataacctcgaactcttgtgtttaagtgatccttcctcttccctatcccaagtagctgagacaacaggcacataatgccatgcccagctaataagatctttgaggaatttgttcttgcccctgaccttattggttataagaacatggtcctttttaccctaagggtaacagagacttgtcgtataatctgtgttcaattataaaatcaacagctgataaggtttctttttctaagaagagaagaccatcagaagaatatatatatatataatccaggcattcacctagtactgtaaagtgtaaacttatgaacttgaattgacacatgaatatttactttgtttctgtatccccttgaagcccatatttctccagtggattactctggaattcaagctgtaggacgggtgttttacagcctccaatatacacagcagtagatctctataggaagctgtcctcttcactactcacccccacaccctccacatttaaggagtaatttgcaaagtctcaaaagcctttttcaccacagtgataactggttatatggcagtatttattctcccaagtgccaccatgctgaaacacaaaaatactcatttgaaatatagagttagacaaattaccattttgtaaccccttatgaaataattgcttttgggaaggaaacccagtgaatgcagaaagccataagtgaaaagaatggatatttacttggtaccaaaatatcccgcagattacttgctttggtcaaaggggaaacatcttaacccagtgatcaattttagctcattagtagtgggacagatggccttaatgcactgtcacgtgcacagcatcacctgtatttttgctgaaaatgtttaacctgattcttaccaaaatttttgacctaacttccggtttttgggaagtacaggggatagtggaaagcagggtatagacacatgacagcaaaagaagcaaaatcagacacatcccgagaaacggtcattctcaggacaatcagagggtctctttagatcaaaatcaggaaagaacagggcttagaagtaagaagattattctagactaagagagactaaagaaaaccagtcagttgcagtgcatggcccctaattgaatcctggtttcaacaaactagttctaaaagacaacgttggaataattggagaaatcttaacatgaactggattttagatgatatttagaaattatttgtcagagataataacagtattatgattatataggaagatgtcttcgtgttgaaatatttggggagggtaaagtgtcatgtctataattttatttt

SEQ ID NO: 120502 - DNA, 1667 bp, Homo sapiens
caattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccgtagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgat

SEQ ID NO: 120503 - DNA, 1034 bp, Homo sapiens
ttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcat

SEQ ID NO: 120504 - DNA, 1042 bp, Homo sapiens
caggagcacagaatgtggagttttcacacccagccacggcccaggaaggcctgctcaaaagagtcactgtgtcccaggggacttcatggggaattgctgcagacaaagtgagccctgagctgagtgtttcaggcttcaagaatcaggaacattttagagctgggtgggccctgagagaacacctagtccaaccctcattttacacatgaagaaactgaggcccagaaggggaaggggcctggctgaggtcacacccctgggtggtggtggagctaggacaagctccatctctgcctcagcctagcatgcattctctgtcctccccccaggacctgaagccaggcaacctggctgtgaatgaggactgtgaactgaaggtgagtgggctgcaggctcagcccagaggcgggataggccctcccccagggaagcccctggaagccgctcccagagcctcctcccctcagcaagttccttttctatttatcccctgtgccatagattctggattttgggctggcgcgacatgcagacgccgagatgactggctacgtggtgacccgctggtaccgagcccccgaggtgatcctcagctggatgcactacaaccagacaggtcagtggtcaatgcctgagagggcggtcctggggccatctggtcactcggtgctgactgactgctgggccccagacagtccaggtgacactctccctccctctgcagtggacatctggtctgtgggctgtatcatggcagagatgctgacagggaaaactctgttcaaggggaaagattgtatcctttgctggaaaagccaaactccatctagggattccttccttcaacagacactttatttaaataactgtcttttttttcttaatgtgagagtgatacatactccctgtagaataatttgtaaatgcagataaggctggacgcagtggttcatgcctgtaatcccagcactttgggaggctgaggtggaaggatcctttgagcccaggagtttgagaccagatgtggcaacatagggagacc

SEQ ID NO: 120505 - DNA, 1036 bp, Homo sapiens
ccagcccctggtgtgaggctcttggctctgcccctgcagctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgacttcgctctccatgctgtctctgaaggggggtggactttctcgccacagcacctctttacgcaccttaaaccatgctgcctttctcagagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtcc

SEQ ID NO: 120506 - DNA, 1384 bp, Homo sapiens
agccttggctggggtcctccttgtctcctgagtatcttgtgtgaggtgcaggggatacagtctaattgcagaagctcctcattcttcggggacctggatggggtgggtgagcgaggggtcagggggtgccgaggggaaatctgggggggcgggggttgttggagatattttggaggtgtgtatgtgggaagggctgtgtaggttgagaaactcccgccaaaaaactcgtctagactgtaagctccttgtgggcgaaactcttttcatttccctcatcagcagtcccttccccctctagagtttctccccggtgtctggaggcgtgggtgggacaaaacacgtctgtgtagagtcttgcatggtcgagagatgcttgagcagccgaggaggtggcaggtggggaaggagaagatggagcggctttcatgaaagtgggcgccgcaccgcctgtctgcgctgtttggggtcggtgtggaggcagatgttctcacctcttctagggcctcggtgcctttggaggggtgggtgatgaagcaggtctgttggccctgtctgcccccagggacttggcatttgtaaggaatccagtagccaagggcctctggaacccggacagaattgctgcgatgattctgtttcctttggctccaaatggggtgtgtgccagcccgcctggcactgctcctcagccaaattggttttttgtttgtttcagtcacactttgggattggaaggcctttcaagtaaagatgttaataataccttattaacaagtagcacctagagagctagattgtgttaccctcattttactgatggagtatggaggcatagagagcttaagggactttctctaggtcacagagggccaagattagaacctagattgccccagagcctcgttttgtaccagaccatagcacctctgtggtgttcttaattcccactgagaggaattgagcatcggaagacctgggttcaaattgtagcgttatcacttactagctttacgttgagtgacatctttctgagcttctgtgtagatgataatagctacaccatctcctaaggtagttgtgagaaatattaaaagtaagagggctttgtagtttggaaaaagtgcttttattatcaccgtctctactttatatagatggtagaccctgcaaccaaggcgatgaattgtttttctctttgaaatcttctctttgttcatatccttccaagtctgcccacaccatggggccctgtatccccaaaggtctctcctggtggtgacagccttggtaactgcctaccgcagctccttatgagcttgtcatccagagaatgatgggggaaactaggactttctcttggctgtacaaggatagactagatatg

SEQ ID NO: 120507 - DNA, 1988 bp, Homo sapiens
tatcctggatcaggggttcccaacccccaggccgcagactgtggcctgttaagaaccaggccatacagcaagaggtgagtggcgggcaagcgagcattaccacctgagctctgcctcctgtcagatcagcggctgctttggattctcataggagcgcgaaccctactgtgaactgcgcatgtgagggatctaggttgcatgctccttatgagaatctgactaatgcctgatgatctgaggtggaacagtgttcaccacccaccctcatctgtggaaaaattgtcttccacgaaaccagtccctggtgccaaaaaggctggggactgctgtcctggatggtgtcttttgtagggaataccctgcatactgtagtttgaagcccttagaccatgtatcatagatatttcagatgccttcaccccttcacctctaggcagggtcaaggagtagggtttctgatcgtggtaagaggtattgggagaagactctagtgacttttgatcctctgatggggcccattgttcacgtacagagcttgacagtggatgcttttcttgttttcttttctaaaccgttaactacatgtgttttccatagttagctgtcgcccagctttatgtacatcattagaacattagatctttccccatgttacactgtaataatctgtttacttttctgtcttttgagttagacagggctccttgagggcagggatcatgtgtgtttgatttcttctttcattcaactaatacttattgagtggttacttaggagctaagcactgctccaggaactggggatgcagcagtgaacaagacaaacaaaaattcttcccctcatggagcttatattctagtggaaggaaggaaacaataaacatagtagtaggtaaattatgtagcatggtataagatgatgaatgttaaagggaaaaataaagcagaatgaaaggtagattgctggtggaggaaaaggatttgcaattttagataaagtggtcagagaaggtctcactgagaagtgttgttcacttgaagaaatgaaagactcaaaggaagtgaaggagcaagccatgtggatgcctgaggggcaagttgttcagacagagggaaaagccagtcctcttggtggatgcttgatcatatgggaggatgaatgggtgcataagggcatccaactcatagtctcctggccttctctccttaggcctgtcccctcagttcccaggtgccatgaggaagcctcgtcggaagtcccggcagaatgccgagggccggcgttccccgtccccctacagtctcaagtgctcacccacccgggagaccctgacatatgcccaggcccagcggattgtcgaggtagacattgatggacgcctgcatcgtatcagcatctatgacccactcaaaatcattactgaagatgagctaactgcccaggatatcaccgaatgcaatagtaacaaggaaaacagtgaacagcctcagttccctggcaagtccaagaaaccctcatccaagggcaaaaagaaggaatcctgctccaagcatgcatctggtacttccttccacctcccacagcccagcttccgtatggtggactcaggcatccagccagaagcacccccgctgcctgctgcctactaccgctacattgagaagccacctgaagacctggatgcagaggtagagtatgacatggatgaggaggaccttgcctggctggacatggtgaatgaaaaacggcgagtagatgggcacagtttggtgtctgcagatacctttgagctgctggtagaccggcttgagaaagagtcatacttggagagtcgcagcagtggggcccaacagtcactcatcgatgaagacgctttctgctgtgtgtgcctggatgatgaatgtcacaatagcaatgttattctcttctgtgacatctgcaacctggctgtacaccaggagtgctatggcgtcccatacatccctgag

SEQ ID NO: 120508 - DNA, 1169 bp, Homo sapiens
gctcaaggcggggtgagtggctccctcaagggagtgcccaagaaaagcaagatgagtttgaagcagaagatcaagaaggagccagaggaagcaggccaagacacaccctccactctccccatgcttgctgtcccacagataccctcttacaggtaagcatgcccagaagggctccttagggactcatggtttcttcttgggttggtgttggccctgtgccaggccttcgctaaacacagttggacactatatcctcctccccgaatttaaactcttccttttgaccccaggctcacctggcctggtttgtggttttgattttgccctcagagtaatgtatttcctttagttcaaagtgaaataaaacacttaagttacttagaaactcaggtgataggatatctaagacagtatttttcaataggggcactaagtgacattttggacaggataattcttcgttattagaagtgtcctgtacatttctagatgtttagtatccctggtctttgtaaatgccagtcgcatcccctcccccattgcctggtctttgtgacaaactcaaaccctcctcatgcatgttttcaaaaacccttggggagggtagaactaattacccagtgaagaaccactgtttcagaggatcggcatggccatctgctgtccagcaagttctgtcctgggtatgaggggggtggtggtgtggagagaacatgctattcctcctcttgaagctttagatttagggataagaggatcattcagttcagctgtgtagctaagctctgtggaccccccccccctccgcccccgccattgagtctgtagagagcccatggtacctgttttaaaacatcagagaggtacctggaaccattggagggatgggagcttggcagagaagcaagagatagggaagatttcctagcagagactcatctcaggggtggtgttcattaaacagtatacactgttagagcaggaaggagtcttggagactgttcatctgatgtagtccttgcaccttctcccacacccccagatgaagaaactgcggccaagggaggtaaagttgttcactcctttattcattcaatgatatatttattgagcacttaatacatgccatgtcctgttctaagggatggaaccaggtggaaagtgacaga

SEQ ID NO: 120509 - DNA, 1050 bp, Homo sapiens
tttaggctgttgaggtttataccatgaaaaaccagacgtcaaacaagtctaaggggttgcattgggctcagcctggttgtgggctaccccctggtttgatgggactctcagccgcagaaggcaggaaatagtggccacattaaccatagcttaccccagttcctgttccctttcgctgcttttataagaggaggctgggggtattgaggcataggcttgtttttcagtccgtacgtggaacaaggaagtccaggaccataggaaacgggactctgggagatggttcttttggaggattaggactgcaaggcaagaggtggaaaagcaaatgaaataactcatgctgaatctgagctgcttaactttactgtccttttcaagcctttctctgaggtgaggtatttggccattttattctgtcttcctgtataaggttcagaaatgaaccaggtctggataggatgcacaggctgtaatctgggctgcccactgaccttgtctttcacttccgtgtgcctctactcaaggttgaacaagatctgtagtggtctctcctttcagaggaaaaaccagtttatgcagcggcttcacaattattggctgttgaagcggcaggcacggaatggtgtccctcttatccggcgcttgcactcccatctgcagtcccaaagaaacgctgagcaggtaggtgcagtggtgatttgaggctggtagagggaggtggagagtgaaggaaaaggaatgatggttggggtggggctggcaccccttcttgatccctccatggagcctttgcctacctgtctgggtggcctatcccaggaacaacccccagcactacagagatcttcaagcagctccttctggatggatgaggcttgactttgtagagaattctaggggagagtggagagcatgcgtagctttccatatatgtggggaaaatcctctagatgtagcagaaagccagaagtaggctgaatgagagccagggtggccacattgtgttaattaggaaaaggtgccctttcctcaagacattatactgcc

SEQ ID NO: 120510 - DNA, 1030 bp, Homo sapiens
aagggcccttatccatctctagtctctcttgacaccacccccaaagaatcaaactagctgttgccagctgtgtgatgcataggttatgtgagtctttatctgaagaggcaaggtggttgggctcctgaaaaaggcagagaaggctacctgataatcgaggtttgaaattagaagcagatccaaggacttgtgagccagccagggtaggagaagtcttagtatctccctgtgtagccaaatgacagtagctgagtgagctgtgtgctatggtttccttaaacaaaaagcagaaggatgggaaggaaattgcagtgtctgctccttgccctagccagcaatatttccccccaaacttttatcttgatcagatcttctctatcacccaagacccatttctcacagggaaaggaatagccatcctctccactcgtcactgagccctcctgaggtggctgcctcaccctgtagcatgtgttgggaagggggatttctgcactcagactcactgtgtgtgtccttggcaggcatgaccaacggctttggaaaacacaccgaaagcgggtctgactctgaatgtagtttgggtctcagtggtggactggcatttgaagcttgcaggtaagaacacattcccaaagctttgtcagcagctctgctacccctccttttactctccattcagctacagattgaacctcttcctgcttacctttttctctcttcccccactcctgctatttcctgaggcctcttatctgtaactctgggagttcctaggaaacagggtgacccttgactctcagatctgatctgagagaggaagagtagtgctgatgcttacagggtttgtggggctgaatttggactctagaggataagaaaagctaaatctcctgttgttcagtgaaattaacatttgagccaaagtcccctgctgcccctacacacatttagacaacccagccattacagagttggttttgctctttgccttttggggcgtcatagcctctttatagaggtgtggtgt

SEQ ID NO: 120511 - DNA, 1033 bp, Homo sapiens
agttgccctagcttcctattgcagcctccagagatataggggaagtagatgggaaaaaattatcaggcacaggaaagagaaagatttcagaatcttacacgatgcttctagcctggccctgggttgaagttcctgactcccttcaaagataaggtacctggaagcccactttgttggggtcagggtaggattggacccatcaaactatccttttcttgctcttgactaaaagtgaaaggtgtgttgttggccccttcttctatgaagggcattcttttcagctatgagccacaagagcaagcaaggccaggctctggttagcctgctaattcaggtggcgtgtttgcctttctgcagaactccagtgcaatgcccttgatttatctggggccccttggaggaagtatgtattaatatttcagggtttaaaataggagatccaaaggcttcaactgcaagggttgtttttctttttccccccatactgtggtaataagtatataagggaagaccttatttattagaccagaatcatataatcccagaattagaaataaccttgaaagaactggtcactaacccatcccccacactccctttttcacttaccccttggtttatcttttctgatgattttctgagcaggttggtgctacatgtgctttctatagatcactcattcaaatattgataactgaacacctactgtatgccaggtactgttctaagcactaaggtgcctgttctcatgaagattatcttctaaggtgtctgttctcatggatatggatgttaaaccagtaaataagataactgtaggttgggttgtctgcttaggctggggtaacttggagaaagggctgaaatgcaggccatgattgagtcagttgtgcttttttctacaaatcaggaacatacagacctatttttggtgttgcatcctattttattgagctcatccttctcagagctcatcattctatagtacagtattagcagtttgtaatactttaagtaagacattaaaatttac

SEQ ID NO: 120512 - DNA, 1363 bp, Homo sapiens
cagtgtccaaaaaataaagttttattgggacatagccatgctcattcatttatagattgtgtgtgtggctgctttcatgctataacaacagcagtgttgagtaattgcaacagaggccgtgttgcccacagaagctaaaatatttactatttggccctttacagaactagtttgctgacccctgatccagtctaacttctaaggaaaggagagggaaaaggaagggtggaggggatgttgtgactcattcctgggttgccccagtcaagtggaggccacaggcaggccttttgggcaccattccaagtcccctttgggtgctgtctcctcccctcccccacccccaggcagaagcctcctgctgccctttgaagaccgcggagacctggagcccttggagctggtgtgggccaagtgccgaggctacccctcctaccctgccttggtgagtctgccccagacgccaccctcctatctcccctgccttgccttgggggctaatctgattggattaagccagcagagtgtggtgggagtcagagtgtctttagctgtagaggggaggggggttttgccccagcctgagtgggtcaaactagcaaggctcccagcttggagcactaaaaataggctaaaagtatgcagatcaaggccagggttcttagagttttaatagcatttatttatttccttatgcataaaagtaacagggcccattttagagaatctttaaagctactgataatgcttagacgttttattaaatatttgtcatgctaagtccttgaaatactgaggaaagtatgattattacattttgtaagaagaaaactgatgatttgtggtcattcagctaataaatgacagggttggaatttgagcccagggcttaaaatgtgtgatgtcaaagcctgtgttctgagccactgagttcaaaatcatccacagtcctgcagggataacttggggtgtatatccacttactcttttacaaaaaatgtataaatatgcatatatatgagaccatattgcttttagcctccctttcacttaacagcatatcatgaacatgcacatcttatgccattaaacattcttcatcaacatcacttttaatgattgcatcgtcttcagttgtatgcatgtaccatattttaaccattccctagttggtcacttacattgttttgaatttttcactatgataaacagttggcaataaacatcattgtagttttacccttgtgcacatccatgattatttccttacagtgaattcttaggagtcccttcttggggcaaagtctatgcagaattctgatacaagttgccaagttgctggaagttcattttggtttatact

SEQ ID NO: 120513 - DNA, 1122 bp, Homo sapiens
tcagcagttggtcctgcagcaggggcactgctcaccctggcctccctcactgagtgcccatcttctattctgcctccagatcatcgatcccaagatgccccgggagggcctcctgcacaatggcgttcccatccctgtccccccgctggacgtgctgaagctgggagagcagaaacaggcagaggctggagagaagctcttccttgtcctcttctttgacaacaagcgcacctggttagtgggtgctgctgtgagggggctgaggggcacgccaggggtctgtgccagtggtgctgtgctagtgaggtgtacagaggggccatggatgttaccagttaccctggtctccacttgccagcaacaggcctgcacttggcatgttaatagtaactgaggggtgttgcagatcagattccctgggaaacactctgaggtcgagacttgcatcaggaggctattgaggagagctgtggggcgggagcgatgcagcactgggcagaagttgaactacagcccacttgctgcctcagctcatccactgggcacatctggagctgggtggctcaacaagataagagatgtcaggaattgggcctgtgcctttttgccctgtgccaactagttattcaatgccactgccctgagggaggggtgtggcctgggcctgaggcttccatggtggagagtgattcctagagagggactcagatgagagcctgtgagcttccagcacttccagtagcttctgggaagcatgtttccgtcctgaggggggttctggccagtgcagtgtccgctacaggagacttgctcatttatggtttacaacacttaaggtttctcttagcaccaacaagagagtgctttcaccttagcttctatagagtgaggagggagaactagctaataaaaacagtgataatagtagctgccattgagtgcttactccatgtccttatgcagattgctttatatatctgatctcttttaatcctcatttaagtcttcattaatcccctcataatccattttgcagatgaggaagttgaggctcagaaagtccagaccctgtagccagaactaagatacaaaacaagatcttgctccaaaggctgtatcctt

SEQ ID NO: 120514 - DNA, 1546 bp, Homo sapiens
ctgctgtgtgccaaaaactcccacccaaggtccctcaggggatatttcactgaagaaccagttagaagtagaaacagctgtggggcttgggcccagcttaggagattgcccagatggcaagaggtcctgggctccttcttgaggggctgcctggcccgctccatcctactcccactaactacacctcagggcgggtgaggttccgacactgatcccagagatgccgtggatacgccagggtcccagggggaatctccccaagctcacactctctcccgcttatcgcctattctcacacctcttctcggtcccatcttctgcacccattgcccagtcttgctttctctttcccatattccttttctttttctcttgtgccaaactgacagaaaccgtcaccacactggtctttttctttaatgtctcattccccttgaggccagctgctatgccaggtggtgtctctgccaggctcctcaggcccagacagaggccagcccacaacctatgaccccctcccccaggacaccacctcccacccacagaccttccctttagctgttgacacaacttcccagctctgcaagtgtgccccctggatcaaggcgggtcccctcttgtttttttctttgctgccacgaggtggtccaagccttcagggtgggctcctatcaggctgggtgtgcgagtgtccatctgtccacatggatgtcgagggtggtttgtgtggagctgtgctcgtcagctgggtctgccctcttcccccttttctccttcttctctcctcatggactttttctgcaattgcagtcttaagcttcactctccaccacctggatggcatggcgcctgccaccaaacatcttcctggcctgcgctctgccctgccctgcctagcctctgctactcccacttcccaactccagggaatgcattacttttatttcaaaccctctgcctccttccttctttctcttcaaccccctccccaccttcaccttctcaaaaatggaaggaaaaaaaaactgtgaatggggaatgctgactgacaaaccaacacaactttcagaggcttcagtgtctgttctctggacatttcttttcacctcctgagcaccaaagtcgcagggccagttgcaggccgctgattgccatgttgatttttaacctgatattctttttaattgttttaaatttttcataggggagttttggacaaaacagtcactggggagatcactgccatttttacacacttgactttttaaaaatacaaccaaccaaccaccacaacttcttatacatttgggacatgagccagagtttaaaagggaaccaacaaaacactataacttaaaaggatggggttttggattttgtataataataaaaacaatacagcatatggctagggaaggacatggtgtatataattgtaaaatactgttctaaattattcaggcctatagtttccattactggagtcctccattgtgtggccacacagtgtcgttgatttaaaggagccagtgcttcccctctcccc

SEQ ID NO: 120515 - DNA, 1071 bp, Homo sapiens
cattttatataaattctctcatttcattccccacccctccaatccccgcccagcaatcctggggttgggtggatactttacattttatggatgaccagaggctcacacacatagtaagtgcaacttaagcatcccaattctagactgttatacatttaaataataaagtatgattatttgtcaaatatggaatggctagggtagacgagaagactctgtggggtgtttgcttctgaattatctgagtctaaagacctgtacttccacccttgccctctactttgtcctgctgctttgagctggacctcgcagaacagattctgagaggctaggggcagtggagggatgtaacaaggggagctcatcccagggacaaggagtgccccgcctggctgcatggagttgtgggaggggcagttggcgggaggggtactgccagcaacactaatgacctgttttcatttccacttccagatcaggcgccaccccagctttaagaggtttttttacgagttctcggactcctccctcagcaagctggtagccaccctgcgcagccaggtggctcactcctctaagctggacaggaaccgcgccaggagactctaccagtttgacgttagcttagctaacaaatttgctggcagcaacagccatgccatgtgcatcctcatgggcctaagagaccactacaattgcacccagttcccatacagggaggaccagccggtgagagagggcggggaagacaatggcaatgtagcatgagtgacagcaggctcacagctggcctccagtgggatctacttatcctcctctcccctcccctgctcagttcagaatttttgggtctatctcaaatgtcacctcctcactgaggccttctgagacaattctaaaccatgacaacctttttcttttctgaaacctcactgattttactccataattaacatcttgtttatttggctctagtcttcaattacatgtacatttccatgctttttgatagaatggcatattggactggctacgatcttagcttgccttgttattattttgtgggctctg

SEQ ID NO: 120516 - DNA, 1048 bp, Homo sapiens
ggggaatttgcacaagacaacagctttgagaaattgttgacactactcacgttagtgggcagggtgaatgggcccactggtcagcaccaggagccaactttggtgtgcccaggaggcctctgctgagggagctgtttggccgggcgaggtggctcatgcctgtaatcccagcactttgggaggccgaggcaggcggatcacctgaggtcgggagttcaagaccaacctggccaacacggtgaaaccccatctctactaaaaatacaaaaattagccgggtgtggtggcgggcacctgttattccagctactcaggaggctgaggcaggagaatcgcttgaacccaggaggtagaggttgcagtgagctgagatagcgccactgcactccagcctgggcaatagaccgaggctccgtcataaaaaacaaaaacaaacaaaacaaacaaacaaacaaatcaaaacaaacaaacaaaaaaactaagggagctgtgtgttttggttgcagcccgatggagaatccaaggtgcccaaggaggcccctggcggagaagaaagccaggtctctggacaggccgcaggcccccgggaaaggctcggagtcgtgggactgccattggctctccctgcccactgccccctccaggaaggcgcttcactggacgaccagtgattgggccagacattcagacagcccagctccatctgcagaggctcactgcaccaccgctgcagcccccactcccgaggagaccggagattttctccccagcgagcagaggccttcgcaagacaccaagaaggggtggctgaagaccatgctgaacttcttcgtgaggacgggccctgaggagcccagagaaaaggccagcaggaggccaagggggaaggagggtatctcccagcatccggagcccctggaagcagcaggggagccagccctcaggaagaaagcccaccacgacaagaagcccagccgcaagaagcaaggtcacaagaaacacgcggccgaggtgactaaggcagctcaagaccaggaggccagaggcc

SEQ ID NO: 120517 - DNA, 1156 bp, Homo sapiens
tctctactaaaaatacaaaaataagccaggcatggtggtgggcacctgtaatcccagctacacgggaggctgaggccggagaatcacttgaatccgggaggcagaggttgcagtgagccgagatcgcgccattgtactccagcctgggcaacagagtgagactccgtctcaaaaaaaaaaaaaaaaaaaaatctgtaacagagacatctagtaactttggtaaggacaataatacacgcatttttatatttattattcccccttcaaatagatgtgtagagatgaggttagaattaggccatgtgtttctgtgacttttttcctctctttggtgtctgatttatcttattgaatctttttctgttgattcataaaatgtcatgtctttccttctgtagccctgagcttcctgattgttgtgtcttcctctggccttcaatctgatcttcctgcccctctttggctaagtggagtgaaatattgaggggaattgttagaataccacatgatttttagttggaagatccagagtcttagatatatgaggcttagagatataaaggagcttattacaaatttatcaaatgcaatcctctcagataaagaatctgagagatgagattgcagagtgaggacttctggctcctagcccagtgttcttcccaccaaattaaatgcttcaaaagtagaaaaggtccagagaaattataagtagatggagaaaaatggagagactttcatatgactacaaaagcaatattatcttatctggaaaaatggagattgaaggaggatatgatgtaaccatataaatcataaaaagtgggagtactaataataaggaactctttgaagcttgaaataagtagtgaaaggacaaataagagcaagagatagctatcttgtaaagccccagaaatgttatgaactcagttttttttttttttcttttgagacagagtttcgctcttgttgcccaggctggagtgcaatggcgtgatctcggctcactgcaacctctgcctcctgggttcaagcgattctcctgcctcagcctcccgagtagctgggattacaggcgcccgctaccatgcccggctaattttttgtatttttagttgggacgggatttcaccatgttggtcaggctggtctc

SEQ ID NO: 120518 - DNA, 1051 bp, Homo sapiens
cccacaacagtcaccagagtgtaatattccccttcctaaaattttaaaacaattttgaagaatctgaaaatgaatagttttggcacatattagtagcaggttccttaaataaaacacgggaaatataaaagtattatttagcaatagaagtgaaaacaagtaaaaagtgattgcctctgaaccaacaccagggaaggtatagggaatagcaggggagactgctgggcctccacataaattcttctctactgtttttcttaaccatatacatagtttactttagaaaatttaaataacgttcaagtgtgggcatcctgccttcatcctctccctcccccaaccctcacatgtacatggaagagatccaatataagtctctagtttttttgtttgcttgctttttacttgctgtaggcaagaggtttttttttgcctgtgaacatctaaaatttgggggttttttgtttgtttacttgttttaaagaagacagggtttatttttctctcaaggcttttgctctcaagttgttttggtttctttgtatgttcttttagacctctcacttgactatgcctctcagccagcaaatcttcagttccctcacataatgccccttgctgaagacatcaaaggttcttgcttccaaagtgggaataaacggaaccatgaaccttttattgctccagaaagatttggaaacagtagtgtgggctttggcagtaattcccattcccaagcaccagagaaagtgacgcttcttgtagatggcacacgttttgttgtgaatccacagattttcactgctcatccggataccatgctgggaaggtaactgatgataattttcttccaaattcattctgttctctataaataaaaatacctgctgtttatcttgcattagatataacagtaaaaagtattgtataggttgggcgcggtggctcacgtctgtaatcccagcactttgggaggtcgaggcaggcagatcacctgaggtcaggagtttgagaccagcctggccaacatggtgaaaccctatctctacta

SEQ ID NO: 120519 - DNA, 2025 bp, Homo sapiens
gagatgttgaaaagtaaagctcagaaatattgatgaatggcatattagataggtcagtattgacagatgaggggacaggaataaaaaggagcctagatgctgtctttctgagctgtcagtatagaaaagcaggttcttgggcagtggggagggcatgaaaggccaccatctcaacacagatattttccaagggccacctctgcagttgctatttactgcatttactgccaaagaaactcactacagatgaactttgtggacttgatccttcattcttctttgtacacaaatgcttaaagcaattgcctttttttcctgtctgaagggagcttcctaagacttgaggtgtcttgtaggcattgggttccagtgctgtgtttttaatttatactatgagagagtgggatggagtcttccagaatgaggtggagaagggagaaatctcatctgtgaagaatcatgatggagaagataacattattgcctggatatctttcaggatgtttggaccaggaagagagtacaacttcactcggcccaatgagaagggagagtatgagattgctgaaggcatcagtgcaactgtatttcgcacagtgctggtgtgtggtagccttttttgttacattctcttcctcaggggcatgtgtgatcaatagccttgagagttccatcaactatgttattgactttagggtctctggtttccagttgtttcctttctccctttgttttctattcctgtaacttttaagtccttgcttgtttgtatgtgagctctatcagttaccaagttctggttaaacaagtcaagatagccaggagctgttttgccatctaatgaatcatccaatttggtgataattccagtagctcattgctttaacaaaaccaggaatgcacagggatgaagaagtaatttttcatcttgttctctgcctacattttttcttcctaatctatttacaggattattacaaaaccggtatcatcaattgtcctgatggcatctctatcccagatcttagagatacttgtgattatctctgcattaattttgacttcaacactatccgatgtcaagatctgagtaagtacaggagcaggtgccagctgcacttaagcagctgaactttcagttttcttggaagtcaccgattttttttttttttttttttttttttttttgagacagagtctcgctctgtcgccgaggctggagtgcagtggcacgatctcggcttaccgcaacctccgcctcctgggttcaagggattttccctgcctcagcctcccaagtagctgggattacacatacctgccaccacacctggctaatttttgtatttttagtagagatagggttttgccatgttggccgagctggttttgaactcctgacctcaggtgatccgcccgccctcagcctcccaatgtgctgggattacaggcgtgagccaccaagcccagctgatattttctattactaaacagaaggagtttcaagtttaggttgaaaatcttctgcagaggcagagatgtgatactaactaacccttttcctctcttagttcaaagcactgtgaggaactggagtagacaaaggaaaacagatagtagtttctaaatggagcctgaccagtgggagaccaagctgactgcttccctcttgggactttggtgtctcgactctaacaaacaaggatactgattgtccaacatgaggaacagttcactaataaagtcaaacagcacaaattggccaggttctcctgatcatgatattgcctttttttttttttttttttttttaatttgagatggggtcttgctactatgttgctcaggctggtctcaaacttctggcctcaagcagtcctcccacctcagcctcctgagtagctgggactacaggtacatgccaccacgcctggcttattattattgttttgttttggagacaagagtctcgttctgtcgcccaggctggagtgcagtggcacaatctcagctcactgcagcctc

SEQ ID NO: 120520 - DNA, 1048 bp, Homo sapiens
tctagggacaagacctactaatctgaccaggaaggaaatgaacatgtaggtgactggggctgggaaagcatgggacagggactggtcacttcgcacatattttccatgctgtgattttgggagaaaactgatgtggttaggaaggagaaagtatggacaccagagtgagcacaatttgttagtcatgagaatggcctttttccattgcaggttaccctacctgtaaagaaaaaattaagagaaggcctggcggccggtctgaagtcatctataattatgtacaacgccccttcatccagatgtcatgggaaaaggaagaagggaagagtcgccatgtggatttccagtgtgttcgaagcaaatccctcacgaatctggtagctgctggagatgatgtcttggaggaccaggagatattaatgcatcacccaccccaagtggatgaacttgaccggctaaatgccccactttctcagatggcttctaacgactttcaggattagggccagctgtgggtctactccttgttggagcccatctcacctgggatgcctgcagccagccctccctcgtgatttgtctcaccttgagtaggagacatgcttctcccctaaccttttcctttctgccataattaacatatgtccttttcagtaagtccatgcctctggcaggggatgaagaagtactcactggtaattagctaccatctttgcagcagccctggtaacttgaaaaatttgggtctggtgctgttcattgagtctttgtgtaactgcaaaagcaggaaaggaagtcaagactcctgttgcctcgtgcttagcaaagcagtccttatcctttatactctgttcttgggttttgtttttgtcttgttttataccaggcaaattgcttagtagcaaagggaccaaactgaaaaggtgacaatctctaacttctaaaagcagacaccaatcggatgctcattagaggttaatgaagatgccattcttggtggcctctgcacccaaattgcatctggaaagaactagggtctcattcagaa

SEQ ID NO: 120521 - DNA, 1053 bp, Homo sapiens
tgaagtatggcatatacttgacactgtcctgtgtaaccctttactttgctcaggctttcaagattgagtcttttttcccccaaattaggttaacatgcatttgaccccaacctgtggggtttgagtaagctggaaatctgtgacggtaggctttctagtgtcacgaggtggtggtgactgaaggaaaagctgggatcacaggttccttctgatggagaggaaggtttatttctatgcccctcccaccaccctccacctagagctcacccaagcctgctccagtcccaggggcaggccattctgcaaaagcaggacctcacagaaacaagggctgggttgaggtcacccccttcagagttggttcctggccagatgggtaagaggcatttgtaattttaaaaatgtgaaacttgggtttggtgttttcttctaagtgcctaaataagcaagccaggctgttgatattttagccagagaaatcggcaagccaagattaacccgaatctgaagtttagaatcttgagtttgcatctgcatcatatcatgctgttttgatgaggaaacatttgccactgaggagttggagggagggcaagacgacagtgttaagtcagatcatttaatggtttcccctaagccctggaaaaatatttgaaagaatggcagcaaaaaggttaagaaagcaagccagatttactgcacaatatgcagtacccagtactactttaaatcccaagagaacagtgtgatgtctaatatatacaggtctatgaaaatactgtggaataagcccaggaaggttagatgtgtttgcaaataagttgcccaaagggtccccctctaagtaaaacaaatattcagaccacaggctttaatgtaaactgtcaaaaagtgggatgtggaggatttttgttaagtgtcaatcgaagttaaaaagcaagggtttttggccaggcgtggtggctcacgcctgtaatcccagcactttgggaggccgaggccggcaaatcacctaaggtcaggagttcgagaccagcctggccaacatggtga

SEQ ID NO: 120522 - DNA, 3205 bp, Homo sapiens
gggagttgcactaacttcacgttttagttattcttatctttctttctagctatgaatgattgagttatttttttaaaatcataatttactttgggtacagtcagttggcttggttggtcagtgtttataagtttttcagagaaaataaatgctgcctgccagtgaagagtcttctcatgtcagaccaggggtcttttttggagaaagacttgattggtatgatccatttgattactaacttagtaatttttggcatgtgtattcttggcagagagagacctgctgcaatatctattgaaatcaaaagcattgatgatacctcaaacttcgatgagtttccagaatctgatattcttaagccaacaggtaacaccaccagcattgtctcctgctgccttataagcacattatttacccccaattttgggatgatgtttacaaatcagggtagtgaacatggagaggaatttcatttcttcaggttctttgtaagtacttttctaattctaatgctgggtagtggtgaaaccttggtgaatggaaaatgagtatcagctcccatgtttagactgctcaactgggtgagtaagtcacaaaaatctgttcttttgttatttactaagtgttaggtaatctgaaatgacaggaatgggaaaataaaacattaaaaaatttgtgaagaaatatgagatttaaagaacatgagcaagaaaatgtggaaaattcatagagtgaggccaggcgcggtggctcatgcctgaaaccccagcactttgggaggccgaggtgggcagatcacaaggtcaagagatcgagaccatcctggccaacatggtgaaactccatctctactaaaaatacaaaaatcagctgggtatggtggcacacgcctgtagtcccagctactggggaggctgaggcagaaggattgtttgaacccgggaggcaaggttgcagtgagctgagatgacgccactgcactccagcctggcgacagagcaagactctgtctcaaaaaaaaaaaaaaaaaaaattcatagagtgaaaaataagctttcccaaatagaaactggtgtgttcttcatagtcctgtcttcagcaccgtgagcagtccattggaggcaaggcagtgaatcaactctcacatctatttctttcccagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaacagtagtggaaatacgtggtgt

SEQ ID NO: 120523 - DNA, 1050 bp, Homo sapiens
aagttcccatctctgagaaagccaaggatctaattttgaggtattagagaacatccctccaccttctttctcagctttttaatatgaatgattccatttttttaaaaacttttgttatctcctgaatctgctttctgtttcctcctattcctctctttaaacaaataaaaaggctgtgcatggtggcttacgcctataattccagcactttgggaggctgaggcagggggatcacttgagcccaggagtttgagaccagcctggacaacacagcaaaaccccacctctaaaaagaaaaaattggctgggtgtggtggaacctgtggtcccagccacttgggaggctgagatgggaggatcccttgagcccaggaagttgaggctgcagtgagccatgattgtgctactgcactccagcctgggtgacagagtgagatgctgtctcaaaaaaaaaaaaaaaaaaagaaagtttttctttttctgaggagactgcttgagatgtgctgaaaggcctctgtcttttccaggttctgctgtgaatgggaacatagaattggagctcctggagttgaggaaataaaaagtaactctttttttgaaggcgttgactgggaacatatcaggtatatccatataaacactttcagaattatttcagaaagtctctagtttacttaataataatttggaaggaccatcattggcaagccaagtaagggaagagagcttcttagagatttagggtcttttcctgattttcattcatggtgaagattgggcattagattttttgtcagccgtgtgtcatggaatatattgaatctagcagttatttacaaagtgaagtgaactttgttttttgaggtggagggagcatctaggaagcgtattaccctttacctagaactcagcaacctcttaggtcccgccagcgggactgttcctgcccacagggtggaaggtatcactggaacatagagaagggagaaaggagtggaggaaagattggaggggtggaagtggagagggaaagggagagtgaaaattgtt

SEQ ID NO: 120524 - DNA, 1177 bp, Homo sapiens
tctcttataccttcatcttctccatctagaagctcttttagtcactagcatttattaaatatccgttgtatgcagagcacttcaactgggcattgcctcactttcctaatttgccgcccccttcctctgtcaaagccttcaaatcatgggaccctctggcctctctccctcttattgtattggtgtgtctctgtatttatgggacgcatctgtgggggtggtcatatgccagtgagcactagattaagtatatccttggtggttccgggtgagtctatctggctgctttggcttcaggaacatgggaacgatgcctgtggaggtgggcgtacaccgtctggagggaagatggggtgatagggtgtgtgcgtgtttgtcttcttgcctgtagttctcaaaaagaggcatggtggtcatttttaaaatctatgcttttttcttattcaagttatttggtactttacccatataagggtatttctggaatgatattgtttcatcctttcatttcttctttgggcatggtgattcccacacctgcaactctatttatgtcctcctttcttttcccagctctacctattagctgacttcctagtggtaccagaggcatgatttcactttgggtctgggagtttgggggaaaatgaaaaataggtttaggtattttctgggataagtggaaatcctgtctgtgtcatggagggatggccatacagagtaatccagtagtcattaaagacatacagaatcaggccgggcacagtggcttatgcctgtaatcccagcactttgggaggtcgaggtggtagtatctcttaaacccaggagttcaaaataagcctgatcaacatagcaagactctgtctttacaaaagaaaaataaaaaatcagctgggtgtggtggtgctcttctgtagtcccacctactgggaaggctgaggcaggaagatcacttgagcccaggaattcaaggctgcagtgaaccatgattgtgccactgcaccccagcctaggtaacagagtgagaccctgtctcaaaaaaaaaaaaaaaagaaaaaagaaaaaaaaagacatagaattttattaaggagagtaatctcggtcagattcaaagttctggagtgtaaaagctccgaagttccttttttattacaggctacccacctttctgttc

SEQ ID NO: 120525 - DNA, 1031 bp, Homo sapiens
gtactttggctgtagagctataatggatgctggaaggagcagaacgtaatgttctgttctacctccaagaatactcatccatctatcaccttgtttcttccccatagggccatgtgaaactttctgactttggtctttgcacaggactgaaaaaagcacataggacagaattttataggaatctgaaccacagcctccccagtgatttcagtaagtggtaacaattacgttagccttttcgttctaactgggcctagaagagctgtttcccttgtaaccaaattagaacagataggagattctcacactttgagtatgtagagaataaaaataccttcccaggtttgcctgtgatttgtgttgtctggtgaggcaagatgaatgagtgggtaccaagtgtgtgaaggcagaggttgaaaggggtctttagaggtctactgggaaggtcactggggatgagtatgggacaagcaagcagaagtagtagaggaaaaactcctgggaacagttctgggctagatttgtcctgggctagatttgtccttcatgacagaaagaagtttatctttatgacagtcacttccatttgagcactatgaaatcgttgacaactatgtagtaaaatttcagttcatcctagaaaagcatatgtcaaatcatgtatcataaattcagatgtccctgatcatataagttactactacttggaaaattgatggtaattttgagaaattgtgactgttttaggtccacgttaggacctcaattctagttgagactgaattccctgtaattctgattaagtcctgtactgtatcctctgccacttgatccacatgggagtgccttttacaactctgtgtgagtcttttaagttaatgctttacagcctctgatttgggtttactgtaaacgtactaggatatgtatcatctggagcttttgatgtatgagtagaagaaaagcaagactttagggtctcatgtgacttgaaagagcctactaaaaaaagtagtaaacattttggtctg

SEQ ID NO: 120526 - DNA, 3864 bp, Homo sapiens
ttgtattaaaccaaacaacagccatggactaaatttgccaacagccatggactaaatttgccaatttgtgaaccttggtacatgttttacttcagaacatgttgtaaaaagtcaagacctgtagcatatgttaagaccaaaaccactattcagggattggactgagtcttaataaatttagatctgaatcaacccaatttagaccttgtgacacttaaaaaagaggggaggggccaggcatggtggcacacacctataatcctagctacttaggaggctgaggcaggaggatcactttagaccaggagtttgaggcttcagtgagctatgatcacgccactgcactctagccggagtgacagagcgagaccccatcttgttttaaaaaaagtgtgtgtgggggggatttgataatatgcagtgatgtttgattactgttctgcatttaaagtaaataaggtaaatttgataataaagcattgctttaacaaaataattccggttctctgaaactttctacaacttggtcctttataggtatttcagtaaaagtataaaattggaaatgtcattaatttgaatctacaacttttcataggtgttcttgtatttcaattcagtaaggattgattgagcacatagcagtgaactaaatgctgtggtatcatagcattctagaatttgtcagtgagctcactgttgttgcagatactagtgcagacccgaggaagaacttggaagagagtctcactttggggacttatttttatcataaaagattattagacaaaactctatgcaaaagagtagtaattttaactaatcagagattcagtttatagcagtgttaaagttgctatttgcattaaagccattcattttgccattttttaaagcctttcatcactcaagttttcatcactgaataccttgaagtcaaatgttgtcaattttgagttagtaggtttgcctaagcagaaattggatcttttatatcatcacgattaaatactcaaaacagtatttaagcacagtatttaaattgtttaagcaaatatacaatctaataaagcagagcaagctttgtcattaatcaaatgcatatacctccaggttggccacattcgtgcggagcgtgacattctagtggaggcagacagtttgtgggttgtgaaaatgttctatagttttcaggataagctaaacctctacctaatcatggagttcctgcctggaggtaattacttgacgatgaaaggtcattttttctttttgttctgtggtttctttctctcacatcacgattaaccctcctttctacttttaaatgtgctcacaaagttgctttctatatccttttttaggtctataaaggaagtcagtaacctgtcttgtgctggggtgcctttctacaatcttagtaccataaaagtaacctgttaattcatttacatgatttcagatggacatttctttcttttcttcttctttttaaaatatataggaataaattagggtgctctgcctgctctcctgtcaatgggaatcatatatgatcaataacccaagtgacaacattgaagctataacatcctttgctccaaatttttgtttctttttgtataacatattaataaggagtgaattttttgttacccatattagtagccagaaaaaatttctcatttctgaaattttaagttttatgtaactcagcatgagcatctcctaagacagctccaaagtaaacccagaacagaacatgccatctgttctgaggaaagcagtctgtttgtcagtgagcagatgaactctgagcaaactctggtgggaaaaaaaaagagagagaacttttttcttttttgttcctataattgtggcataatattttgattttgtgacaacccttagatttagggtcatcaatactttttaataaagaaacacatttaataaaaaataaacagttgattaatgttagaaaagagtctggtagaatgaggagaaacttttttaacatttagatgctagttcttaaataagagtaagagccaacttggttaccagctcctaacgtgtcctcaagcctcaacctgtaccatcttccgtagcttctcatgtctcctggaccctgccctttgcacttggtggagctggcctgcagagccatagagcatctggcctgagctctccaatcatctgggcaaacttgcacaggcgaggccccattgactgctctcctgagccacagaactaaggccgtatagctaccttactggggtagcagcccaagtgcactgtctccatgtgtctggtgggtctccagattgaagggctgccaggagtgattaggaaatcatattttttaagtattggactgaaaaagagcactttaataaatggtttaatttttgcctgagggaaaaatagctacttttctccaataatacaaaacataatgttctaaatgaaatgaaactgaaaaagcagcatgatgctctgttaaaatcagaggtttctttctcttttccttgttttctaacataagtgactttatgtgaggtctaaactgaatctttactgtttctcttagttttaaactccttatacatattttctttgcatttctcactgttgagttaggacctgaatctttttctgccattttatgttgctggtattagaaatgatgaaattttgactttgcagaaaactaacgaggttaccttttaactgctagaatactgatactgtgttttaaaagttacataaagggtactagtgtccatttaaatacctataataacgcactagagaaaaaaaagcactgaccttgagaggtgttcattgtactcttccaggaggcagttattgcacattctagtgtatagcattttcagttcatttttagcttttgttgactaatgctttgctacccaagtccttcctttttatttgtttgtgttctgtgaatagaagttggaaagcttgttttcagcctgcccgagtgtttacatttttatttggcatttcagcctctctataacaatacatagattgtatgtggaagtgccatttagttacagatgcagaaaagcttgcagatacttgttcaggcaaagtgaaaagtaaagtagcattttaccccgagtccaaaaaattatcctaagcaaatacagttgttttttaaagtgtgggagaaattttctttttctctcaaaagtaaaatagaaatcacagcttagtggtcaaccttagctagcttaggtgtgaaaatcccatttcttcccatgttggccatgtgggtctatctctggcacacagaagaggtctgtttagccgccttattttggcagatagggaagacatatctgaaaattggtactcactcgtatgttgtgtgtgtgtgtgtgtgtgtgtgtgtgtgtgtgtgtggtggctttgtatcttcttgtttccaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaaggtattgggggggcattggcatgaactatgcacgtttactgatctgagcagcctctgctttaacacctgcacccctgtggtcatcccagtgggcgagctgtgacctgccttgtcatgattttccttttttttttaaacaggtaagtttgctgtcacttcctttctctgaaaggctatggttctgtaatttggttgaacatttctcttaaaaataaaggaaacttgaaaataagagcaaaattgatgtag

SEQ ID NO: 120527 - DNA, 1211 bp, Homo sapiens
ttaaaattgtaatactttttcagttaattattgcatcctataacacatgaaagcattaggttggtagtacgagtttttgacttggcatttcttttataactttttaggtacggcttgttcagaagaaagatacgggacatgtgtatgcaatgaaaatactccgtaaagcagatatgcttgaaaaagagcaggtaaagcacagttgtagcagtgcttttagcttattaatttttgtctcctaaaacttttctttttgtttaattgaaatatatatttttattacagttttctttagctctgtcatgtatgactatatatataatactacctttttccccctacaaagaagcagttcatatttaaaatcacaaataatgcctgtaggttatatgcaatcttttaaaaattgaaaatctgttccaaaagcagctcttacttgtgtcttccaattgatcacaagatgtccttattgtgagagccttttttttttgaggtcgtacgtggtgtggtagtgtgtttcttaccaaatgctgagaaatagaaattgtatatatatctcataactaaggactaggaattagaatttggaatttataatctaaaatgtgtctttatatgcttcattctgtttacctaaaccaaagttgagtcttctaggtagctcatcggtacctgaaaaagaccagccttctaatttctgaatgaatttgaaaaatacaatgcaaatgacagaacaatgcaaattctcctttaatgataaaggatactttctaaaaccaaaacctggtttgcaaatcaatttataaagtgccttatgcaaaataaataaggttttaaatattggaaagtatattttaaaaagcaagaatagactttctataaatctagtttaatgtagctggttgcttaagaaaagattgcagtgggtgatgaccgcaaatgtcctgtaaaagatttgatgttataggaacatggagaccctgtgacaaggagaactcctaatttagggccaaagaggggggatggagattggccccacatccaatcctttctacctcttgagaggagatataatcactggtcttccctgtcttcatttaaatgccaccccaaaatttggaatttttattttctctcaaattttcatgtgttaccgagaagctttagactcccaggaatttcagttgggagtatcaaatacctgggcggta

SEQ ID NO: 120528 - DNA, 1503 bp, Homo sapiens
aacaagggactgtgcaaggaactgaaatggtagtggaaatgccttcaaaaataggactggcttgcagaacccaggacggtggtgaaaaatacccaatacttgtagaaataacagaaagttagagtatacagtgtttaagccagagggaaagataagaacacatttttaatttatattaaacaggataaaggaaaatattgttgattatttatccctcccttcaccaaaaatgttaggatagtggattgctgaagtaggttagtcagagttcccagaggaggcacccatctgttcagtgtggcttggatgttgtgtctaaatgccaggaaagggagaagtgacctcttaaggatccttctggggtgatttcatatgtgaaaagattatccttagtccacttggacctgttttctagctgggtaagtcacaaacatgacttgttacagagtttcagaatttcagttccttcccgtctcctcccttttttatttaaatattagaaacgactccggagatcagcacatgctcggaaggaaacagagtttcttcgtttgaagagaacaagacttggattggaagattttgagtccttaaaagtaataggcagaggagcatttggtgaggtaaaaatcacagctacttgtcaagtagaaaaatattgcaaaacttcaaagcttctaacataccattaagtcatgattgttgatataacaaatatatggaattaaatgagtcaggcatgccagccccacatcctaattgctttgtctgtctgctttctctttttcttctctccgcagtcccagatctctgttctctgttttgccagagatggtgttggtgtttaaatattgacttagggggagagttgaaaggtagaaggaaatcaacatttattatttacaggctgcttttttcccataatcaggacagtaacccattttatagatggtgaaattaagactctaaaggtatatataatgtctcttgttatcacacagccattgagtactgggaccaaaagttgggctctacttcctgaactcaaagagcttgcttttcccagtactgcactgcctctcgagaaggaaactaatagtgtatctccaccctttatttctccccaccagattgatacagctctaaaaagatgaccctaggagggaggatttacagaaaggagttatataggtagtggtggagagttgaaagcatttgcgactttgtccccgcaattcttggaaatgatcctgcttgggcacaagagcaatctgttggggagagcttgaaagagcccatgcaaggtcattcctgttaatgaaaaatgcccaaactggatgacctactgacgcaataattgcaagtataaaaggagcagtatattattaaaacctggtaccccggggccaggcacggtggctcactcctgtaatctcagcactttgggaggccaaggcgggcggatcacaaggtcaggagttcgagaccagcctgacaacatgg

SEQ ID NO: 120529 - DNA, 1026 bp, Homo sapiens
gctcacacctgtaatcgcaacactttggaaggtcaggctggagtttgagaccagcctgggcaatataatgagacctcatttctacaaaaaatttaaaaattagccaggtatggtggcacgcgcctgtagtcctagctacttgggaggctgaggtgggattgcttgagcctgtgaggtggagatttcagtgagctgagattgcgccactgcattctagcctgggtgacagaacaaaactctgtctcctctcctcgcaacctgcccccctccccccgccaaaaaaaagtaggcctaacaaaggatggaaatctttttacttgtcttagtaacttaattttttttgttttaatgagacattttgagatttacctgtttgtgtcatttttaaaaatctactacagtattaagttacagaattttcagaaagttatcattcagatgtgatttcatgtcttttgtttttgtttgttttagacaaaagaagttagaaaaggtgatggaagaagaaggcctaaaagatgaggaggtaattaatattggcaatgttttccttaaaacccagcgtggcaggttgtatcttgtccagtgagttgttagccttggtacacatgagaagggttttggctcaataacagaggaacttgaggggtagtgtgcttccggatttgggtgttaattcagagggacagattaattattaagtacctaggagaggaaggcttctctagatgcagttatagtaaactagatttagaattccaagagaaagcagggatgaaatcaaattaaattttaaaagagcaagttgtagcatttttatagaattcactgaaaagtctccgtaggagtagggcaaatttttgaaatatttatttattttactttttctgggatacatacgtgtgctgaacatgcaggtttattacataggtatatatgtgccatagtggtttgctgcacctatcaacctgtcatctaggttttaagctccgcatgcatgaggtatttgtcctaatgctctccctc

SEQ ID NO: 120530 - DNA, 1580 bp, Homo sapiens
gatatatttgtgtgacttacaggtacaggtaaagttgcttctggttttctggttgttgcatggtatttcctatgcagccacagctctttattttcttacttaagtgcctccaacttcccataacacaaattaaggcatgatgaacatcctctctgtgctgaacatcctgtgtatgtcactttagaagcctgtgtgacggtttctttagtctttatacctaggggtgggatttctgggtcataggacagtaatttatatttattttcactaagtattctctttctctggcttttgttacatattacctgtttgtcctccagaaaacttgcaccaatttacattcctaccaatagggtaggagagtgcacactgggtggattctaactccaaatctaacacctcttcttttctttgtttctagcagccatggcaatgacaggctcaacaccttgctcatccatgagtaaccacacaaaggaaagggtgacaatgaccaaagtgacactggagaatttttatagcaaccttatcgctcaacatgaagaacgagaaatgaggtaaagaattttgtttgaaaaaattgtgtcatggttgtggcattcctttctcgtattgtaaaacacttataatgctgaaaggagacaagaatagtagcagccttattatagactatcataatggaatgacagtgaaagggcttttcaaagtccctgccattaacccacttatgcctacaagtcaataacacaaacttctattgaaatccaagaaaaaaaatgatacttgggaggttgagttgggaggattgctttagcccaggaatttgaggccagcctgagcaacactgagactctgtatcttaaaaaaaaaaaaaaaaaaaaaattaggcccaatccaaggagttgattgttaaggcagagtggtataatggaatagcagcccttttggagtcagacttgggtttagagtcctgccagtttcattgaatagctgtatgaagctctaataagttccttagtctttctgtgaattggttccctcatcaggaaaatggggataatactacttgccttgcaggattgtgttggggattagatataacatatgtgagtatgtaccatagtgtttcacacatagtagtcacttagttaatggtggtagtatcagctattgttattactgatctggtgtatactgtccacttagtaactcataatttatttattggtttttttttttttttgagatcgaatctcactctgttgcccaggctggagtgcaatggcatgatctcagctcactgcagcctctgcctcctgggttcaagcggttctcgtgcctcagcctcctcagtagctgggactacaggtgtgagccaccacgcctggctaatttttgtatttttagcagagacggggtttcaccatgttggccaggctggtcttgaactcctgacctcaggcattccacctgcctcggcctcccatagtgctgggattacaggcatgagccactgcttggctgtaactcataattaaaaaaaaatttttcccaatattttactatgaaagtattcagaa

SEQ ID NO: 120531 - DNA, 2352 bp, Homo sapiens
ggcttttccttcagtgtggaatctaggcggccacagtctggtgccagctgggtcacaaacagctccgtgacctgtttgtaaacgcgatgctcttagttccagactaaccgctcacaagggtgaagcacttaattaattcatctcttaatcttgttaggggccaacggctcctattagtgtttgagcgtgacggcgacggtgctgtttatgaagccctagcctatttggaggtgaggaagaggagtctgtgggtaacctggaggtcgacagaccgggaggaacgctcgagggagcaccaggcctgttacaacgagcgcgcgccgacgcacgtctccacccacccggcgcaaccgccagagcgcgctcccagcaaccgcggctctcgctgcgtttgtagccatacgtcacggcctcttctgcttctcattgggggagcccgtccaatcatgtgattccagtatggcgtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcggtaagagaccagcgaaagagggaatgaggtggaaatggaatttaacagtaccaaggagccaggcccaatggcggcgccagattgagacaaagaggcgccgccgccattttgtgacgttcagcacggggcggtggcgggggctcccggcccatcggagggtttcctagtcttggagtggaagtctttatattcctcattggggcatgagccaggatgggggttacctgggagttgggaaccacaaaggggagccgatagccgagttgtattccaggtcacggcctttttatttttatggcgccttttttttttttggcccctcatttaattgggaagcttctcagaatgtttttgtaaagtcactaaccaagaccggacctttcagttcatattaaatggcccccgtagtcaccttactttcatgtagtttcagattttgcagcctgaatctaatcacctttttctaagaccgaaagatcttccttgaacttaagattcgttctttcatcgcttcccattaaaatggaggcttaagacaggtgccagcagtgtttttaaaaattttcaccagtggtttggtcttagaacttactcctgggcacagggtgtggtcacggcaaataggatgtgtctggactggatattttaattagacaagcccagagtaagaagaacgtggtgtttatggaaagcacttcagctgaattattgagtagatggtttttatgtaattgaaactggtctacaagtttatcagattcatcgtcgaagtgactcagtaataaagctttatcaaatacaagtccgccaaggaagaacaaaaaaataagtccccaaagtgcagtaaattttttagtagcaaatatctctttgtaattttttattaaagtgaaattatctttaagtggtatttagtatattcagtgttgtgtaatcatcacttacacgtagttccaaaacatttccgtcacctccccccgcaggagactactacccattgagcacttactcccagattccctgtcccccttcctctagtccctagcaaccactaatcttcctgtctctctgaacttagctattttagatatttagtatttatggaatcgtgtacttttatgtctggcttctttaacttagcgtaatgttttcaagattttccaacgttggaggatttgtcagtacatcattctgaataatactcattttatgtctataccacattttgcttatccgtttctgttgatggacatttgggttaacatctttgggctactgtgaataagtgctactatgagtttacattttttaaaaaactgtaaagttggtctcgttgcttgataaatttttaccgcgtaagactctggtctatctaatgacatttgatactagccttgttcctatagttccaaatgaccaaaataggcatttatttatttatttatttgtggtttttttttggcgatggaatctcgctctgtcgccgaggctggagtgcagtggcgcgatctcggctcactgccacctccgcctcgcgggttcaagcgattgttctgcctcagcctcccgagtagctgggactacaggtgtgcgccaccatgcccggctaatttttgtatttttagttgtgacggggtttcaccatattggccaggctgggtcgaactcctgacctcgtgattcgcccgcctcggcttcccaaaagttctgggattgcaggtgtgagccgccgcgccc

SEQ ID NO: 120532 - DNA, 3449 bp, Homo sapiens
atcctatttgtttaatttgaaattaattgaaattttaatttgaaactgggaaacaagcttattttatttttcaagacagagtcttgctctgtcccccaggctggagtgcaatggtgtgatcttggctcgttgtaacctctgcctactgggttcaagtgattctcctgcctcagccgcctgagtagctgggattacaggcatgtaccaccacacctggctattttttgtatttttagtagagcgagggtttcaccacgttggccaagatagtgtcgaactcttgaccttgtgatccgcctgcctcggcctcataaagtgttgggattacaggcgtgtaccaccgtgcctggccaaagctcattttatattagtaaaaataagggagctagaaatttgatgttaaattgcacagacacttaggtgtgttctttgcagaatagccaactgagagtacttttggctttaatacgcatgtcagaaagtcaggctgttttaagtttaatatctttgccccctcagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcaggtacttgagagaaagcttgttaagaggtattggtgtaatggagtagctagtaggagcaggtatttctcttaagtttgttggtgggttttaaactttggaagaatcggaggtttctgtgaaacatttgttgggtgtaatttggggtatgtgagttgtgctgagtgttggcttttgtctttaggtcactgttcatgttggtagtcagtaacttctatcttggatctgtcttctagttcatctttctagttgcatctttccaaatcttcccttatacttcagtttaggcctttttccatttcttggctccataatgacaaacattacattcaactctagctcttcacaaatttgtgttttctactattagcacaattgtaatatttatcaaacaggcagctgttttaatgttacaactggtaaagtagaaatcattctgagactaacttaagtcactgaccaataaagggggctaaaaaagaagtaatcccagtcatctgttcttcaatcccaaataggagaaaattcagtttttttataattgaaaatggcatcattcttggaccaggcagtattgtctgggtgctaactccacatctcctcagacctccaaaatagtttctataggactaaatttacctcttacaggtgagtggagtccttctaggagacaggagttcaaaatcttgccccttttgctattttgaaaaacaacagcacactgttgcccatcataataaagagtatttgttagctaatagatggttgtactgatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactagtaagtttttcctgcttatacagtttactgctggttaaaataaggagtaagcggcttaaagtaattcttttttctggatcaaaggctggctgtgcataattgaatggtaacgtacatatatattgcttgaaaaacttttaagggtgatagggaactcgtaatgtaactaggccttcaagtgaaacttatttgcatgtgcaagatgccaaactaaaaattttaatatctctaacagattagcttttctggcaaaaatttgttgaatcctatcacctttaaatggttttactaacagtttcaaaatttaaaattttggggttgaagtgtgggccaagctaaggtaattttggtaagcctaaacacactcttaaatgtgacgatcacaaatgcagttctaatgtagcacttaatggcatcaatatttacacctaccgcgttttcacaaaattacactatccacctggtacctaagtcttgtcatggacttacaggtttgcatgggttccaaatactggtttatggtactgtttttggaactacttgtgggactatattttggtgtggtgtttgggtagtgaagttagtttgacatgaagttttgcattggacagatctgctgtgaagcattctttgttaaagtgaatccatggttggaatacctgcttttcacttgagctttttgtttcttaatccttctgtgccttttttttcttttcttttttttctttttttttttttttttttttttttggacgatgggtgccagttcttcggcacattcactgggcccaacagtgagattgaaaagttgggaaatgcctcacgccataaatactaattgatgatgagcctaattttcctgtttctgcttttagatctccaagaaggagaagcttctctcgcagccggagcaggtaaatgactaccttttttggctacgttcttagaaatggcagtgtttctgctattcctaaacttttccaggtggcttagttaatgggaataaaccttggctttaatagtgaatcaagttgtaaggatgagtcagctttctttgagttttcaaaggctttttagaaagtatttaattttttaaaaaaggatctgtcacccaggctggagtgcagtggtgtgattatagctcactgtagcctttaactcctggccttggagtgatcctccctcttcagcctcctgagtagcttggactacaggcaagtactgccatacctggctaatttattttttgtggagatgggatctcactttgttgtccaatctgttctcaaactcttggcttcaagtgagcctcctgcctctgcctcccaaaatattggaattattggcatgagtcaccatgccagatcaagaaaatatttatgtataattttatcatacctcattggtcctaatgtttttttgcttgtttaggtccctttctagagataggagaagagagagatcgctgtctcgggagagaaatcacaagccgtcccgatcct

SEQ ID NO: 120533 - DNA, 1284 bp, Homo sapiens
agatgtaatgttttgttttctttttttttttttttttttagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatc

SEQ ID NO: 120534 - DNA, 1042 bp, Homo sapiens
ttaatttttagtagagaccgggtttcaccatgttggccaggctggtctcgaactcctgacctcaggtgatctgcctgcctcggcctcccaaagtgttgggattacaggcgtgagccgccgtgcccggcagactgatcattttgtgatatctccttagagcagattcctagacctggatccctgggtcatagcatgcacatttccaggcttttgacctgttctgccaaactgcccctgaattaagtcaaacccacttgtccccctgtccccactggcagtgtgggggcccctcacttctcatgtccttacagccaagggctctcagctctttccaactcaggccctgtgaggacattcctctggaatacctcttttaaaaaatacagagcattaatattaactagctgtatactagcagacgtgcaatatgtgtctgcaagttgaactgaaagggtgtgaaaccaagtggacgagctcctgacctgagaagaacagttgtctccttgctgccctcctggcttggctggggggtgcagctactgcccatcttccctccctggagccaggtggacggaggggcatgggtgggcagatggaaagggagatgaagggtcgcagggatggcaactgtgtggtgcgggcctgtggagggaatctttgattggacagctttgatcccttccgccacattccctttcctggcagaaatacggctggggtggggggtgggctgggagtgtgacaacgcccccatctcttccccttagatgtctgaagagccaacctgccactcctgcattccaggcatgtcaagttggcattccaaatgctaggggtggcagggaggcatgtgagcagctggagggggggcatcggaacccgcttcacaagcatgtgcaactgctacttcagtgtctctagagagcagagaaccctacacgatgtctgcaggacggggctgttcccgcctcacccctgtcttatcaaacccccttactgggctttccagctttccaaacactttcttttttttgagacgggg

SEQ ID NO: 120535 - DNA, 1037 bp, Homo sapiens
taataataactaccaaccaggaaaaaaaaaaatcacccctgactgtggagcgtgctgctgaagtaggagctttagtctacctgctgctctaggagagacctacacagccccctgagctcagaaaacaaaaagccagactcccagactagggttcaatagacaagtggctctgagaacaggatacactggaatcagcagaatccaaaagacaagcattgctttgacagcatcacagtaatttattttttccaaaatctttaaaattctatttgtagtttagtcaaaagtgcagagcgttttgtttgtccatagtttcctgtatttattttttcagtagataatacattcacatggtccacagtcaaaagatgcaaaaggctattcagtgaaaactctccctcctacccctaccctccagctacccattttcttcccagaggctgtggctggtggcttgtgtccccttcccacagatagtctaagaacatccaggtccttcagctgaaacccttgggcacagatgggttgcagaatctagaacttttcccattttagacaggtaataaagtgcatacagcctgtattccacaacaccagcgggctccgcccagggtgagcagtcagccagtttgccccagactgttccagttccatgtccagggaaccccttcaatcccaggcaaaccaagacagtaggtcctgctagctgtgggctgtaatgtattcacactaacagggacaattaaaaactgcaaatggcttcacatccttttagctctggttttgctaccaaataaatttgccacaaaccaaagaaaaaagttttggtttccagagccttttggatttgggaattgtggatgaggggctggggacctatacacaatatacatatatatttttaatctgcttgaatggaaacacagtgttgggcacattgtttttgcactcaatttatcttagtggctttccacatcagtacatagaaatcctgccctttcctttttactgctgcattggacttcaacacacgggtg

SEQ ID NO: 120536 - DNA, 1004 bp, Homo sapiens
ggggctcattctaacagtgctgtgtcctcctggagagtgccaactcattctccaagtaaaaaaagccagatttgtggctcacttcgtggggaaatgtgtccagcgcaccaacgcaggcgagggactgggggaggagggaagtgccctcctgcagcacgcgaggttccgggaccggctggcctgctggaactcggccaggctcagctggctcggcgctgggcagccaggagcctgggccccggggagggcggtcccgggcggcgcggtgggccgagcgcgggtcccgcctccttgaggcgggcccgggcggggcggttgtatatcagggccgcgctgagctgcgccagctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggtgaatgacgggcgtgggtcggtgcgcgctcggcttgcgcacacggtgtctctaagtgcgcgggtgacgagagtcgggatgtgccggagaccccggggcggagagcgggattacaagtacaggaatccctggtcacgctccccgcccctggaaacccagctggggcgagggagggcgtggacgggaccgttctgggagctcgcctttggctgcggttggctccaggccccaggcgcagtttgctcgcggcgtggggatgaagtccgtgtccctggaggggcccaggaagggcgaggaaagcggagtggagtaagttcgtctaggatcggtcccgggtggctctgggatccaatctgcgccgccctggcccaggtcccaggttcaggtcctttacgccactgtgtccaccacctggctgagcgctgaggt

SEQ ID NO: 120537 - DNA, 1037 bp, Homo sapiens
tgctcagggcctctatcagctgcctcgggggctcagggcttcccgacctagcccagattccctctccgaaagctacagggctgagcggagcaggggggcgagtcgccccctggggcgccgccgcctggcgcggaccacagcgcgtcctctccgtcccaaacccctgggggacacttgcgccctcttcgtgaggaaaagcatcttggagctgggttaggaacttggggcgcccaggcagcttcccctctccttgcctccctccacgtcgcgtttctgggaggacttgcgagcggttttgttttcgttgctcccgtctatttttattttccagggatctgactcatcccgtgctttgggcgtggagataaggtggaggggccggctcccggcgcgcgcgcgcgtgcgtgtctgcgcgggcgtgtgtgtgtgtgtgtgtgtgtgtgtgtgtgtgtgtgtctgtgtcagagacggcacaagagcgcgcggtttcccaacagcggcgggagtttcggaagcctggccggctcagcgtgacgtgttcgcggccccccggtcccctcccattctccccctccccaccccagggtgacgcgcagccggagtggaagcagttttggcgggcgagcagcgccttgcaggaaactgactcatcactactccctccagcggtccgaggctctgcccacgcacctcccactccgcgcgtgatttcctggaggccggcgccccctcccggccctggcgggaatagcacacaggctttcccgcggagtggggctggccggcgcgaaccgccgcggctactcctgggctcatccgagatcaacccctatgccattaccaccccttcaaaggagcactccttaggttcaacagtattcactgagctcttactggaaattaaaatatggctgaagtctaaggcaggaaggccaataaaggaggctatttttaattgtttctaaaacaagggtttgcgtttctgagttttctttgggctgaaagttattatgagcatgagagcagattttgatggg

SEQ ID NO: 120538 - DNA, 1054 bp, Homo sapiens
ttttttttttttgagatgcggtctcgctctgtcacccaggctggagtgcagtggcgtgatctcggctcactgcaagctccgcctcccgggttcacgccattctcctgcctcagcctcccgagtagctgggactacaggtgctgccatcatgcccggctaatttttttttgtatttttagtagagacggggtttcaccgtgttagccaggatggtctcaatctcctgacctcgtgctccgccctcctcggcctcccaaagtgctgggattacaggtgtgagacactgcacccaaccacccagctaatttttatttatttttatttttagtagagacagggtctcagctagttgcccaggctagtcttggacccttgggctcaaatgattctcccacctctgcctcccagagtattaggattacaggcataagccactgcccctggcctccccaagtgattgtgatgggcctctctggttaagaaacctcaaaattagagagggagtggggttcaatactacagcacaggactcagggcaaacaggcctgggttcagatcctggctgtgccacttatgaactgtgtgatgttaggcaagttacttaacttatctgagccttggttgcctcttctgtaaaaagggagctaatagatatccactttttaggaggattgatatttttaaactgcttagaacagcccccaaacataaaaatatataaataaatcccaactcatgcctagcagagggtggatagaggttatttgagggctctgtccactgtactgggtgacccctttatggggcagtggcctttggcctttttagctgtatgactcaggggcaagtctcatatctcttccatctcctgccctttaaacttggtgtgaagttaccaagagcctcctctcccaaccagctgggacgtgaaactgtgggctccactgatcacaagcagtggggtgaggtggggtggagcagatgtggcatgtgtcccgggcttcctgcctcatgaggactcagcagagctttcacccccagaaactgcaagttg

SEQ ID NO: 120539 - DNA, 1170 bp, Homo sapiens
gcctgcaaaacggtttccttggacacaggcaacacgaggcaggggctgccaggtgtctagacttcagatcacctgatgtgcctggcaggatgtggctcagcctgggagaaatcatcccttgcgctgccccgcccggcccctccttacccctaggccacccgcctgacgacatccttgggaaaggccctcagcctacagcacctgtcagctgctgtctgaaggaggtagttggcagggggaagtgataggggggaggctcagtaaaactgaaggcagagaggaataatcatacttctgttttcaatgcacttctctatacgaagtgctgctggcacgttacctacattaactcagttaattctcatgtctatcctctgagacagtcactattactatccccattttatagatgaggaaactagagctcagacaagttaagttgcttgcccagggtcacctagtaaaacctggactccagcccaggtgatctggctccagagccctcctgcttaaccaccaggatacagcctttcattcagctctgttctgtctgccttgctgcatggactctgtgatcaatttcttgagtatgtgtctgtagccatgctctttaaacttgtacatggccccatttatggatgaggaaactgagacctagagacattaagtggctttttaaagcttacgtagtaactggcagagctaggaccacaacccgggtgctttttgccccaaagtcccgggtacttttacttggcagagcagggttaccctacttggggatctgggtcgggggacttaggaggctggaggaactgtcagactgtttcttcttttgggaattgaccttctggccagggctgcgattaggaaactgctggactctggcaattcacacatatttggggggcattcacacccatgagggacacctctggggggaaaacaaattgattttagctgataatacctggtggcaaacaggaccctggtccttgctcttgcaatagacttgcctttgttgacattagcttgcccttcagttgcctgctctcccagtgaccttggtgtgccaggctggctgagctctgctggtgggggtcaggcctcctgtgggaaggaagcaggaagaccagctggaaggagtgagagagaccctctggtaggaag

SEQ ID NO: 120540 - DNA, 1549 bp, Homo sapiens
tcattttatttgattgtagtctgtttaaacaagcacacagagctagtagtggttcctctgctgggcagcttgacttagagcagacccatgggtgcgggtgcggtgatggataaaatcacatctgtgaagcatggtgggacactccataatacccctcaagagacagagtggacgttccccgagttcttcctgttctcagcagtcggccccattggccccagggaagggtgtcctggccccccactgtcttcctcagttgggcagctccgccgcgtcctcttcttcttggcctggctgacttctgctgtctctcctcagatttctaccactccaaacgccggctgatcttctccaagaggaagccctaatccgcccacaggaagcctgcagtcctggaagcgcgagggcctcaaaggcccgctctacatcttctgccttagtctcagtttgtgtgtcttaattattatttgtgttttaatttaaacacctcctcatgtacataccctggccgccccctgccccccagcctctggcattagaattatttaaacaaaaactaggcggttgaatgagaggttcctaagagtgctgggcatttttattttatgaaatactatttaaagcctcctcatcccgtgttctccttttcctctctcccggaggttgggtgggccggcttcatgccagctacttcctcctccccacttgtccgctgggtggtaccctctggaggggtgtggctccttcccatcgctgtcacaggcggttatgaaattcaccccctttcctggacactcagacctgaattctttttcatttgagaagtaaacagatggcactttgaaggggcctcaccgagtgggggcatcatcaaaaactttggagtcccctcacctcctctaaggttgggcagggtgaccctgaagtgagcacagcctagggctgagctggggacctggtaccctcctggctcttgatacccccctctgtcttgtgaaggcagggggaaggtggggtcctggagcagaccaccccgcctgccctcatggcccctctgacctgcactggggagcccgtctcagtgttgagccttttccctctttggctcccctgtaccttttgaggagccccagctaccctttttctccagctgggctctgcaattcccctctgctgctgtccctcccccttgtcctttcccttcagtaccctctcagctccaggtggctctgaggtgcctgtcccacccccacccccagctcaatggactggaaggggaagggacacacaagaagaagggcaccctagttctacctcaggcagctcaagcagcgaccgccccctcctctagctgtgggggtgagggtcccatgtggtggcacaggcccccttgagtggggttatctctgtgttaggggtatatgatgggggagtagatctttctaggagggagacactggcccctcaaatcgtccagcgaccttcctcatccaccccatccctccccagttcattgcactttgattagcagcggaacaaggagtcagac

SEQ ID NO: 120541 - DNA, 1008 bp, Homo sapiens
tccccccactgcctaatgtgggaacccaagcaaggcccttctaccttttgggcctcagtttccatgtctgtaccacaagagggttgaccagatggccccaggttttcctttaggtctgacatcctgagggtcattcatcccatgcccagttccccccatcctactcctaacagatgtgaccctacttgaggccgccttggcttttgggtcaccctgtctcatcccatcaccccaaacataccctagtccttcagcctggggctctggcatctgagcccgagctcctgcccctgctgtgggaaaggtggggaagaaggggatctccctcccgggcccacccagctgcccagcctttgcccactcggggagcagatcatgcatgccaatccctgttgccgcatggagctcctcagcccactgacctctccgtgcctggtgcaggccaggcccccgtcttccgcctgcctctgcttccccgtcatgcatggtggtggtgtttctacggtgtctggttctgtgcccgtctctgagacagtctctgtgtggaatttgccttaaactgaagtaaatttggttcttttagtaaagcacgaagtttttctttcttctctgaaaaatagcactgacgttgctgcttgacagggtccagttctcctctgtggcttccttcaattgtttgcttcagtgagatttacaatcaaaggccacgtgccacgctctgtgctaggcattgaggatgcagccatgaacaaagcacagaccctgtccctgcacagggcttacaacacacacacagataatatgggagagacccagcaaacacatcaacaaataggctagtaacatcatttcaggtggtagcaagagttctaaagacacatgagggagaaggagggtgatgttttcgatgaggtggtcagagagggcctctcagaggaggtcatggttgaggtgagcccccaggaagtaagacagggagccacgctgatatctggggaagggagctct

SEQ ID NO: 120542 - DNA, 1042 bp, Homo sapiens
attgaaaatgtctaaaaaataagggcactttcccacttacccacaaatgccattatcatacttgacacattgaacaatattctttttttttttttttttttgagatagagtctcgctctgttgcccaggctggagtgcagtgacacaatctcagctcacagcaacctccacctcctgggttcaagcgattctcctgcctcagcctctggagtagctaggattataggtgtccaccaccacgcctggctaatttttgtatttttaatagagacggggtttcaccttattggccaggctggtctcgaactcctgacctcaggtgatctgcccgccttggcctcccaaagtgctgggattataggcatgagccaccgcgcccggccacaatatttttaaataccattcactattcatttcatattcaaatttccccagttgtcccccaaatacccttgttcaaacaaggatccaagtagaagtgggtgctgttcttccagggccctgctctttactgggtgacaattgggtttcttcctctgtgggcaacactgggctctcttcccacggacccagcctgtctgctggcgtgtgcccctggagtggagtcccaggtagaattgggagccaaagaaacggatgtgtgcaaggctggggctgggcagaggcagggcacagcctggccttggtctcagcagccgtcttcccttgcagccatgacttcattggggagttcaccaccagttaccgggagctggcccgtgggcagagccaattcaacatctatgaggtgaggtgggcacccgaaatccagggtttgcactactaagtggcccagtcactgaggactgtagtgagccatgcactgggctgggggcttggtgtgttttcctgtgagaaaggggttattgtcccattctaccgttaaggagaccaagtcttggagaagtgcgagaacttgcccaaagttccaccattcagtaagtggcaaaatcaagacacaaacaacccagacttggctgattccaaatcaccgagttatagt

SEQ ID NO: 120543 - DNA, 2307 bp, Homo sapiens
gcctctcacaaagttctgagcaattcagagcactggtcggtgtgttctagactctaactacttgttaaaggtcacaggatatcaaaagtgtcctcaaagaaacaggaaaccttgctgggtttttgagggcagtcaggaacatggtccacagttagtgaggagcatcaggggtcaaggctggggaataggtgaggacaaggaagatgaagtcgccagaatagtgtagtgatggcctttgtacagggcagagagactgccctgaggggttgtctgggtctggacagaggccagaacaaagtcctggctgctttttcatccctaggatggggcagcagctctacactggacctgtggggttatttatactctttcctttcttcctttttcccaccaggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaattcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaattgctgctgtggtctgattctaaatattgtatgaggttccaatggtcattttaatcccagtcatcttaagtagtagtacagagattgaatgttcaagatttcacatcattttaggcttgtggatctccagtagacttctccctctttaagagcaattctaactttaaaagggcagaaccagagaaagaattaagtgacagaaattgacatttctgaataagaggtgtattcatctgttttcacattgctataaagacactacctgagactaggtaatttataaacaagagaggtttaattgactcacagttccacatggctagggagacctcaggaaacttacaataatggtggaaggcaaaggagaagcaagcaccttctttacaaggtggcaggagagagagcgagcacgggggaaaccaccatatttaaaccatcagatctcatgagatctccctcactatcgtgagaacagcatgcagggggaaaatgccccatgatcagtcacctcccaccagatccctccctcgacacagaggattacaattcgagatgagatttgggtggggacacagagccaaaccatgttggggggattacctgtaagtgaaccaggtgtatgtgctaagagacctgcaccatccctggaatttgcagagagcccacctgcacattattatgggaccagaggcagtatatgttgtggtg

SEQ ID NO: 120544 - DNA, 1051 bp, Homo sapiens
atccacaagcctaaaatgatgtgaaatcttgaacattcaatctctgtactactacttaagatgactgggattaaaatgaccattggaacctcatacaatatttagaatcagaccacagcagcaatttcaaccatcaatggcattttattgtggaagtttctatgtattacataggtattaacttccttcctctcctgctcctccccacaaaatccagaaagttatttttatacataaacaactgaacatataaaaatcttggacctaatttctctaaagtcttgggttaaaagaacttgagtggcgcttctcctttctgagagtactacttctcaaggaggattcatggtctgtcctttgctcactacagatttctcctcttctctgggaaaaaatggtcaatgcttctgcttccttttaataaactaatttcttgattattatacattattattattccccacttgacaccttcttagaaacttgattgttggatgtgtttttcatttggcaaaaattcaatgtggctttgcgtgggatgtctgaagtgtcagaaacagcactgttgatgttctggttttgagagggaaaatatatatagagatgcatacattccctagaagaacaaatgtaaaagactgaaatagggcgtgcacagagttaagagggctgacagacactacttggtttggaattctgtggctgtcagccatcaaggactgctgtgtaggccagaatataaatctccttaggaagaagtttggttaggcaaaaccactgagaaatgacagtggctgctacattgttcgacgtatatcagagcagacatgcacaagaagcagcattatggttcatgtgtagtaagtagtcacctattgataaacaggggcatttgtgcaaatgctctggcaacctaggcactgggggaagagaaaagaagcatcctattaaaatgtacttccatctctaactcacccaagatgccaggcctcctaagcttcatgacttgcaaagccaaaatgaatttagcattacatgtcattctatgtca

SEQ ID NO: 120545 - DNA, 1040 bp, Homo sapiens
agagaacagcagccagaggccttagaccagagtgtgcctggcaggaaacagcacaggggccagtgtagctggaacacctgagagagtggcaggagatagctcagagagtagcagagtgcccaatcgtggggggtgttgtaagctgtggtgaggattgtggattttgttctcagagtgatacagtgttgatggagggtttcaagcaggggagtgctgcgattaggcttgtttgaaaaggatccctgtggctaccatgtgaagaatagagggtggggaaagagggaggcaaggctggaagcaaggagaccagtgggaagcttttattcctattcaagctggagatggttgttgtttgaactagggtgatagcagctgtgttagttctggtcctctgggaagcaaacaccaagatagaggtttattgggtaacacctgtgaaagataaagggtcagggaaccaggtttggaagggaaggtcttcacacagcagcgcaggcctgagtaacacctgtgaaagcagaggggcggaggaggagcagctgccagtgagcagcgaggaacaccaggagaatgtggagtcgtggaagccaaaggaagacagcaactcaagcagaagggtgacatcgagtgtggatcaagtaaagtgagtgctgaggattgaccactgggtataaccacgtggaggtcactggcgaccttgacaagagcagtttcagcggagcggtgaggggcgaaagtctgaatggagcatgttcaagcaagaatggggagaagtagagacacttggtgttgacagctttttcaaggagtttttctgtgaagggatgtagagaaataggaggatacttggaaatagagttttgctttttaaaataggaaatatcaataacatgtttaaatgctgacaggaatgatccattagaaagagaaaaattggtctactagagggggaggttgtagttgctgagttctttaaaggtgagcgggattgggtacgtggtggtaggatagtcatggacagcttattcacacagtgtctt

SEQ ID NO: 120546 - DNA, 1057 bp, Homo sapiens
aaaagtttttaaaaggtattcattaaacatcttcctattttccatctacccagtccctacccccacccagaaacttctaaataaatatgaactcctgatattttaatgtctctttttttaaaaaattaaaaattaagtgtaagaatttttttcctaatttaggggttggttatattggtttcagataatcagatatagctatatatatatacatatgtatatatgtatagtattagaattttgagttctccatgcttgttattttgctgaaaagaagtacccagaacacctgcgtgttttactcaaaaaagataatgggtgtttatgttacttgcattgtggtgttttcctttgctgagcatgaaatccagtggttatcacaatttcatgacttacaagcttgaaaatcaagagtcctggagcagttccataatactcctgtctgccctgacctttttgtttactggagctgttgtcctctccctctgcagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtacagttaagccaacattagtttatgttttcttttttttttctccttttcgtctttttttctaaagccagcattagtttctgaagtctctgtcgtaaataggtgataaggcagccagagctctcttttccacttactaaggtctgtgttggttgattctggtgacaacgcctgccttcctcaaacacacatgtgtggaattgaccagaaaccaacctttactcctaggcttggtagagtttttcataacttacatgtactgctcactaagaacaaataatatttgtctgaattatagtgatgcaagtagtctgatcaataagaaggaaagactttataatattttgagaataataaaatcctgggttcttttatcgattcattcatttaacaaatactgagtacctgttt

SEQ ID NO: 120547 - DNA, 1016 bp, Homo sapiens
ttttttttgagacggagtctcacactgtcgcccaggctggagtgcagtggcgtgatctctgctcactgcaagctccgcctccccggttcacaccattctcctgcctcaggctcccgacctctgcatttttaaaaatgaataaaataataaaacataaaatgaataaaccatgagccacgagttacattcaattagttcggaatgataattttaggtcctttctataaatttgttcaacattgatctgattccacatctgaggtgaattcccacgtctgttcttagttttttgtgttttctccatttatctctgctttcaagaaacactatttagggtgggaggtagacaggaaaatagatgtaatgccaagccctagaggtgcataggacaaaaactgaggtcagagtcttaaagagttcacttattggacaaagcactggagactaggctttttaggcagaggaaattgtgtatgcaaaagcaaaaagatgtgaaatagtatgacagtgtagaatgtgaagaaggattgatgggaaatgaaactgaacaggtaggcagtgaccagatcataaagggccatggtaagtaatttggactttatcttttaaaaaagacaggaatctcattccatcacccaggttggagtacagtggtgctattacggttcactgcagcctcgaactcctgggctcaagctacccctcacctctgcttcccaagtagctgggactacaggcaggcaccaccacactcggccaatttttatttttattttttttgtagatacagggtcttgctatgttacccaggctggtcttggaagtcctgggctcaagcagtcctcccacctcagcctcccagtgttgggattacaggcatgaaccaccatgcttgacttaggactttatcttaaaatgattgttattaggtatttaatttgtctggctattggaacaaatgtgttacatcattttataattctctgaaataaaacattgtggggtagaaataatta

SEQ ID NO: 120548 - DNA, 1054 bp, Homo sapiens
caaagtgtaaaaaggtatacagagaagagtacctctccttcctgctcctgtcctctactccctcctcagaggctgcttcatatataccttaccttttcagcggtctccagtgcttatcattgtttgtttttaaaaattattatgggctggatgcggtggcttgcgcctgtaatcccagcattttgggaggccaaggtgggcagatcatgtgagcccaggaattcaagaccagcctgggcaacatggcaagaccccgtttcaactaaaaatacaaaaattagccatgtgtggtggcatgcgcctgtagttccagctcctcggaaggctgtagcaggagaatcccttgaacccaggaggcaggggttacagtgagctggacggcaccactgcactccagcctgggcgacagagtgagactctgtctcaaaataaataaataaataaaagtcattatgatgtctttcctttcttgtttcattgttggagctactggatgtaccagctatgctctttcagtatctgttttctccatatcccttcctctctcagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaaggtgagcagaagcctgagtctcccgctgattggctgcttgcttaaaggctaggtcaagctctaggaaatttctgacaagtaactctgtgttgttttgttttgtttcctgccttgccaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggtgagtgtgaaaagggccgggcacagtggctcatgcctgtgatcccagcactttgggaggccgaggcaggcagatcacttgagcctaggagttgc

SEQ ID NO: 120549 - DNA, 1080 bp, Homo sapiens
tgcggaagacatggttcattccttgtggttaaggttgctgtctagtaagaaaagaaagccagtttccatcttagaactgtttcgaaagaattaaaatgactttttcaggctttttgttaatttcttaatgcttctatctttctttaaatgtgctgtttgtttgcgtgctagagtgcccagttgaacaagctgagcaggcttccccctgcgtctccctgtgcctcagaagaagggtcatgctttttgtcccttcctccttctctcttctccccttcccccgcctggcctgctgttacttcagtcttttccaagatagaatgaatagattatttctttccttccaatatatattgttttagctgcaatttagaaacactccacccacatactcaaatcatggctgtagagtttatgcctgtgtgtgtacacattatagttcattgactctgtgcaactattcttcagggacctagtacttaagatactgtactcatatttttccctctttacccaccgcccacagttttcccacccttacttggctctctcttagtcatgggctggcttgaccagtttaattactttttttctgtttcatacttctacaggaggagacctctgaacagatcacaaatgttacgtgagctttttcctgttttcactcacctgccatttccaaaagatgcctctttaaacaagtgctcctttcttcacccagaacctgttgtggggagtaaggtaggaaattttgagaggacttggatctagaattttctttatttgggacctggactgatgtcataaccaaggccttccctgcatattggcttagagggttacagggtgaattgaggggacacccacacagtctagttctcccctcctgctgctagccaggagacttgcaggggcccaccttgtcatgaaggcaggtttccagaaaatctagttaccttgcaaatctgcctcctgcccttaacacctgaggcaaactacttttctatattaaaagaagtgaaatcttaaaatttgaaggacttgagggtgcaattagtctggctttcctaccttaaattagaa

SEQ ID NO: 120550 - DNA, 1065 bp, Homo sapiens
gtttgttgtccacctttcctcgatgtgcaggctggcacagctgtgaacggcagtgctgggtgtgtgcagagctcttcctagatctttcttacgtgtcatcctgtctgacgcccagggcagggatcgccagccccatgtttccatctggaaacagaggcctttgaagggaaaggggtccacccagagttacttcagccagatcacattaggctgaggttagaacttaggtttggggccccaggctcactgttatgttccccaaggtgcatctgttctctcaggcaccagctccaggggtccctgaacactgcccagcaacctccccagtcacctgagggtggctggaggggacaagctagttcagccctcagggagggcaggaagtgggtgaatttctcactttatctcctttaattctgcatatagacagcccgcctctcaccctaccataaatagctcttcctgacagaagtaaccaaccctaaatctggcttctgtctcctgtgtgcatgtacatgtaatgtttactacatctgcgtgtttcaccaggacataaatagtatttttacatgttttcagacttcatgtaaagagatcctactgtgtattttttagagattttatttcctcccccattcagtatgatatctgtgagattcaatccacactggtatatacgtagctctaattctgaccgccttttacagatgagacacgggatcggcaaggttacaggacttgcctcgaatcataggtcttgtaggtgaccgagacagaatttggactgtgtgatccagagccctctctgcttctggatcctgctgtcacccacctccttagcacctgcctcctactccacgtgcccacgcccatcctgctgccctgcttcctcttgtcctctccttggcaggcatgtgaaagaccgttttcacaaaggtgttaagaacttcccgggttcccccactgagggcacatgcatttgaggaagtgctggggaaagctcattggagtgggaagccagggctttgggtctggctctaccagctgtgtgaccccaacaaatcc

SEQ ID NO: 120551 - DNA, 1064 bp, Homo sapiens
attttcaggggcaaagagaacagatgcattgagcagtgtgtcttctgagagttggttaggtaaagaggccaggagaaaattaccaacacgtcggcactcttattatctgcatttggaaattccaaatttggcagtattcacatcttgatccctggcttctgtggtttgaaaactgcttgagactattagctaatttatggcatccaaagcggcatagaacacctccccatgggaaaaggagcactatcttcccagtgtgcatagctgctggaccctgcaggcctcctttctaaggctgtgccattggatatgctaagattttgagctcggaacatccctgcctgcttcctgggtgtggagcccccaggaactgctcctctccctctcctgctcatctctgcttaccttgttttttagtggattaatccctcacctcctgggcgatgtggttttcttgtggggctgtaacctgctggcccacttcatcaatgcctacctggtggatgacagcgtgagtgacaccccaggggggctgggaaacgaccagaatccaggttcccaggttggttggaacaaggacttgtccttctttccgtgtgctgctgatgcccagggtctgggacaaactcaaggattctgggattctcagcatcaggccgggagggtgagagaggacctctcattatccctggagtcatctttgtctaaggggagaacggcctcaagaggcgagattccagattagtacccagacctgggaggaattaatggaatgcttgtccctgggcgccttagaaacagaccccagcttatctaaggctgctccgaggcagtgacccaactagggctcaggaagtcagaagatagaccagctaatagtgatcacctcttgacctttgtgtcacgtcttttgctttttaaaacccttttgtgaacgttatggcctttgatctgacggcatcctagttgtgaagggaacagggcaggtataatgttcgtttaccaatacagaaatcgagacccagagatcacaaattctggagaggctctgggctctccagagt

SEQ ID NO: 120552 - DNA, 1019 bp, Homo sapiens
ctaggctggttccagtgcctcctcctgcagggccctgtattctttctctgccctctgggaaagtacttctctttgcttactaccccctcctactcttactcttgggcgggcctgtgggctcctctgctagagggttgtttaaccagagataagtgtgagggccgggtaagagaagggcctgccgcctctgcagcagtggcccaagttaggagatgcattcctaaactcctatctcccagaaaacaccagtagaggactgctagtgggctgctcccatgggtggttgggcttccccagtctccatgaactgtgtaaactcctcctcaccctgaacaagcgctctttgcctttctacttggttcttcatggtaatagtcctccccatccctgccaggactggctggatttgagcagaactggtgggctcagccccacaccaacgggtgggcttctggtaggtgactgcatgaccctgtatctctgtcttgccttcttcacagtggtgtgctgagctccattgggaagattttcaaagaggaagggctgctgggattcttcgtgtacgtgagtttatacaccccataactggccacgggcatggctctgctaacaggtgtgtcctcaacctctcagaccgcagctgctggcctgggacttcactacatggccctgccctagcctgagtgctgcagccagctctccagagctccatagcgtgtccaagctgcttagcccttttcaggccatggctcatgtaaaagtggaactgtgtgtctagtacatgggggagatgaactgaccagccccactgggcctcatccagttgtggtgggtgtggggctggtcttcatgagctaagtcactgcatagtccttggcctcactgctaaaacatgactgaaaatctgacttggactgagggtggagctctggaagctcacaggctgaccacagccagtggattctgtttgacattgcttttctgacaaattagttgttgccgttaacatttaagatatg

SEQ ID NO: 120553 - DNA, 2065 bp, Homo sapiens
actgcttccaggtcctggacagatgttaccttctgtgcctgtagtcagcagttacctgaaggacaagccgagcctggtctgggtgtgtgtgacccaggagtgggtgcccctgaactgggtgtgactcctctgccacctctgttttcttacagccaagtacatcgtgcaagtggatggtaagatagggctgttccgaggcctgagtccccggctgatgtccaacgccctctctactgtgactcggggtagcatgaagaaggtgagcccacacaaagccaggaacagtcgcccgaggtttcctcatactcccagccacccctgcagcagccagttaccctggtcttgcctcctccttcccagaccattgggggcttcactccagccccatgggggagctcccaccccacagttctgctttcccacagctgtgacaccagatagtggctttcttttccccccaagctccagacctggaggttacctgaggtgggcccagccaatagacactgcagaggaaatatttggagctggttcctgccgcccaagtccccgaagagttccatggaagaggcgtagctgaacttggttctttcccttctctgtttcaggttttccctccagatgagattgagcaggtttccaacaaggatgatatgaagacttccctgaagaaagttgtgaaggaggtgggtgttgagagttggagagggagaggtgcgtggaggggagcctgatgatttctcacccccaagttgggcgggtcattgacaagtcgaagagttgggtccttgtgtatgcatgggtgggatggtaagggaagaagccctggcctggatgtgccgggaaccccggaaagccttctcagccattgttgggcctagcctgggacccgacagcactcctgggtgggggactggggagtgggcaacaggtggagccatccttggcagaccgaccccatgtgcagtccctgggacaggtttctccctcctgagcacttgtagctcccctcgagggccagttccagagacaggccgagggtggcgagtccccaccccatgctctcttccagacctcctacgagatgatgatgcagtgtgtgtcccgcatgttggcccaccccctgcatggtaagccaccccccttcccccgagactgtatctaagctggcgtcgggggcgtggggtgaggggcgccccctcgtggactgtacatagacagccgtagacctgttgggaagtggtagtggggttgggggtattctactggaacccacctcactgaggagagattggaattctttccaaagggaggtggggctcttcccaggcagtagaaatggcatgctgtggtcatggggtgtaacagggaatccgaaaggccctcttcctctcctgctctctgaataggccacgttgttcagtggccactctgcacctggcacccggtggctggagcattatgaagtgtggcccaccacatcacctgtgtgtgttttcttttttttcctcagtcatctcaatgcgctgcatggtccagtttgtgggacgggaggccaagtacaggtgggtaactcttgggactggcagagtggccctgttaccctttcagagtcggccagggcaggccgtgctgggattggttgctgcaccttttctgccctagtgctgtgtgagttcagcctgctgcctggcttctgaggaatgtggcagtggcttcaatagtctgtccagggtcattttctcttcgtcatctcttatcaagggcagccctagatgagcctagatgcctttgcagaggggtgagtgggattgtagtcagcttggattaggatttctggccccagagctgattctgccacttaggactgagctggggtctccttttggactcccgaagtaatgctctaacgatttttccggccctcataggctgatagctctttttatcccctatgaagaagccatccaccccatgggcttggggctcatcccttccattgtgtaccagaccctcacctagatctgctgcgtgcagccctgggtaggtgccaggggcatatgtg

SEQ ID NO: 120554 - DNA, 1052 bp, Homo sapiens
agaaaccccgtctctactaaaaatacaaaaaatttgccgggtatggtggcgggtgcttgtattcccagctacttgggaggctggggtaggagaatcacttgaacccgggaggtggaggaggtggaggttgcggtgagctgagagcacgccattgcactccatcctgggcaacaagagtgaaactccatctcaaaaaaaaaaataaataaataaatatttcagatataagaagcatctgtacagcaagaactatcatagccctacagaaatgagggggtcgttttgtcacagggatgtagggtgattgaggtgagaacgcagctaaggatatgtttgaggagtagctggaatttgaggtaacagtttgctaagcctgggaatgggaggaatagacatggaggtgtctgcagtagatttggtaagaaatttgagtttggggtgcactttggaatagatgacttaatggctgacctgtctgaggtttgggtatgatgtattttcttattgccacatttggaattgaggttggaatgaagtttttcatctggagatgagaataactgagatttgttctgagatgggagtagggtttgcagtacatacaaatggaggtttctctactgggaatatttgggatttgaatgtaagaatgttggggtgtgggtgtgacttggattgtggttggacagtgtctgggaccaggcatttctgttgattgggagtttacgtgctgccaatggttagagacactgacgagctttctggtatgctttgatggggaaaacatgaacaagagccacattagaatttgtgggagaagagttaagcaaagggggcaagaggtgtgaggagaggtggtgaggctgaatcaccacgagactctgagcgtccctttgtctttgttaattctgaaggtgggtcatgagccgatgccccccacccttgggaccaatgtgctggggaggaaggtcctctatctgccgagcttcttcacctacggtgagtgtgcctcccaagcaggaaagcccacaccaacagaaaagaggcctcag

SEQ ID NO: 120555 - DNA, 3242 bp, Homo sapiens
cgtggccccgtcacgtgacggggagtgacctcgccgccgggcgccatgggagcttcggacccggaagtggcgccctgggctcgcggcggtgccgcggggatggcgggagccggagctggagccggagctcgcggcggagcggcggcgggggtcgaggctcgagctcgcgatccaccgcccgcgcaccgcgcacatcctcgccaccctcggcctgcggctcagccctcggcccgcaggatggatggcgggtcagggggcctggggtctggggacaacgccccgaccactgaggctcttttcgtggcactgggcgcgggcgtgacggcgctcagccatcccctgctctacgtgaagctgctcatccaggtgggggaccagaggcgccgtagggagatgggaggctgatgtgaaggtgacaggccaggatttggaggattggggcgggcagtcaatggcgacggatttggggagaggggtggggacggcgggtttggggggccgagtgggtgggatgggagggaagccgtgagggagttgggaacgcaggggtcacgggttttaggatacagaaaggagaccaaggggttagagtaataacagatacgggagagggtggaaggaacaagcgatttgggggagtgccaaggagggagcgatgggctggaaaaacatatttgggagataaaggagtggggacgatggacttgggatagggaagggagcgaatttggggcgagggaagaagcaatagaattgggggaggggcaagaagtttgggtgaagagatggggaggaaggttgggggcccaggcaaagtgtttagagaatgaggagcacataattggggtagaggggaacggaggctctggatttgatagagatggatttaaaacgtcttggggtggggacaaagtgggcgccagggccagaaatttaggagggaaagaaggacaccagactgggggtggacagaggagacggaggtcttgggttgcattgtgatttaatttggtgggagagtgcgaaggcaaagacttttgcaggggaatgctatcggtttaccggagatgggggctctggatttgatggcgacgacggatttggtaggaggaggggacagggtgacgcgtatggggggaggggaacagatagggccagcattgggggaggggagtggcagcgatttgtctagagaggggagctaggaggaggctttaagcggggaagggggatgacgcatttggaggaggaaatggaagtcatagttggggtcagagagaggaatcacagtgcttgtatctgggcagatgaggagaaggggcacgggagtattgaaattgggcagaagggacagtggagacataggtggcaggataggtagggactaccagaaattgagaccgaggtagggatgtctctggaacagagggatgcataggcacttggcagatttggtggtggccagcaatgcggtacagatgaagtgtgctgcttgaggagtgagctggaatgaagggcgtgtggaggtgtgagaattaggtgggtgtggctgggatgggtacagttttgatgggggtcattaggccagaattttccagttaagaagcttggggggaggaaggtaaaaattgaattggagacccatccaagatttgagttgaggcaggtgggtgtcagattttaccatctttataattgaaccgagagaatgcaaaatacaactggaatgagaaggccttgagaatgagagtaattgaaatctgggatccgaggaatggtaatagatttgtgggtgtgaccaggaatatgacaaggaatgaggagattcagtcaggggcatcaaggtgcctgactagaccctaattgtgacagatttgaaaattgttgatggcggaaggtgtagaccagactggcatttggttgtgatttgggaatgagggctgtcttacagggttaagattgtatttacagcagttgaacttgaagtttgggagataaattggtgctttggacctgagaagtgagggttctggaaactgatggaatgagactgagtgagggctaggattttagggcacaggtgggagagtctgtggagtgaaggatactggagcacaagggctcagtgtgagggaaatgaagaagtggcttcatcatttggatgatggcagatctggtttgaaagaacattgaaatgagggtggtttgggaagggaatgggggaatgaaggacaccaaagcgtgagaagaactagatggtgggcaggtaaggatggatgagccctgttgaaggaccagaggtgcctgtctgatttgaacccagctggtgttgagtgtaacatatattagggtaagatcttcaatgggtatagtttgggaatcagagtaataacttgcagaaaggcaaattactgggagtgggggtgtcaggagtggagtgacagatttggggattgtctagattaggtgcgtaagaatgcagtgccttagattagtgcatgtggctgtcaggtttgggagtcggagattttaagatgacagactgtccctgctggtatctgatatagggccacagcatttgccgtagttaggactgggttaacagatttgaggttgaaattgggtttaatgacttgggaacaaataattaaaacttgaaggcaggaggaatgggggtgagatacagccagtgtgcctatgataacccaatagaagttaagaaaatagattcaacagatttgggagccatggggatatgggataacgttacaaatttaagtatgaaattggggtcagtgggactcccaaatagtgttgactaaactggataaggacagcaaaagagcagttgtggcgatttggagtggaggaataaaggaataccacctgtatttaagagaacacagatcaagacaaaacttaattcagaacaaccttggagcttttaacccagaagggaaaaggtctagaagggaagtactcactgcctgggtcagctgactcacccctttcctcctttgctccactgggtcaaaatttttttcttttaaagacagtccccatcatagaggagtttttaaatttacaatcattaatctgttaggcatctcagaatcagatccataggagatagcctgaactttgaaaagcacttgcttgataaaggcaaaaggggacagggttgatcccaaaaagcactggaagcatacctaatccagtttacaaggtagcgctttctaact

SEQ ID NO: 120556 - DNA, 1033 bp, Homo sapiens
ttttatgtatatatattatatatatttatatatttttatgtatatattatatatatttatatatattttatgtatatatattatatatatttatatattatgtatatatattatatatattttatatattttatgtatatatattatatatatttatatatattttatgtatatatattatatatttatatattttatatatgtatattttatatatatttatatattatatatatttatatattttatatatatacacacacatagagatatatgtacatatgcatagagataatacacatatattttgtaatgtgtatatatacaccatatatattatctattcaaaagtaaataaagttgaacattttaaaataatgctttgcggcgctgcggcagtccagatcaaaaatggcggcagttggtgtgttctcggtttctcggctgctgggtcggtcccgcccacagctggggcggcctatgtcgagtggcgcccatggagaagagggctcagctcgcatgtggaagaccctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccattactctgcacatggaccagaaaaagtatatgggaccttaagctcaccttctttacttgtatcaaatgatgactggtatactggtctcccatccctttgcttgtggcgggagatggcttaaataaataacttaaacttaaaaaaataaaataaaataatgctttgtctttaactcagaagtttcgcttctacgaatttatccttagtaaatgatcatggcaaagatttagcttaaagg

SEQ ID NO: 120557 - DNA, 1013 bp, Homo sapiens
gttaataacattaaaaagactgcattgacacacttaaactcccaggacgctcagttctttagggatggactacatggctggtatcatcacttacagaagtattttgaactcgatggagcttatgttaagaaaaaagtttatgttttttatttgtatcttttaatcccattttttcacaaactttatgaagtcccctcatacatgcacagtcatagaaatatacataatcataggtaaccactcccctcactctggacatgtaagctggtcctaatctttctctactgtgtccaatgctgcagtgaatatcctctatagaaatgctaagggcaggttttagtcacgggactggggagcacacacgggaatgccagtgcctgggagcagaggggcagtgagaagacagtgtcatccaccagggaaacccgaagaacgtggagaccgagggcaccacaaccttccgggattgtacaacgtggcctgcagctggccctcactgagtggcacgtgagatgtgacaagcaggtgctgtttgctgggtagattaactgcatgagtgccatcttccctctataaaaatcgctcacattctgtgacggatcgacagcctgcactgttgcctctgagagtgagctgtgcccacagcccccacgggcgctcctgtgcaccgctgggacataaaagcccacaccctggccacaagtgccagggcaaagtttggcctgacacgaaggcagacatttatggactggatatgcgggagaggtagcccagcaaaaagactgcccagtggagaccttctacactggacagtgacttaccaagcccatcagactgtctctcacggggctgcctgaaaaccagaggaccacaaagtgggccacaggcaagggctacataggagaaggtagtgggcagaggccaggaggtggaagccaggaggtagcagaagacatcaggcagaaaggatccataattggccttggcctgagcctccaaggactccagaaaga

SEQ ID NO: 120558 - DNA, 1124 bp, Homo sapiens
ggcggcggcgggatctcctgggtggggagctggcggctcgcgggccggcactgagtccccgtgcttccccctttcctaggcaaggagaaggagcccctggagtcgcagtaccaggtgggcccgctactgggcagcggcggcttcggctcggtctactcaggcatccgcgtctccgacaacttgccggtgagtgggcgccccgcggtggggagggcgcgccgggcggggggcgcacgggcgtgctttagcccggacgagggaacctgacggagaccctgggcttccaggtggccatcaaacacgtggagaaggaccggatttccgactggggagagctggtgagtgccctgcaggagcgacccccaggatgagtgggtggggtgaggggcgcccccgactcccgccctaacgcggccccctcgcccctgcagcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatggtgagccaggcccgggagggagctgcccaggtgactcggcccggcccggcccagtccggaggcctcggccagtctcccgcgccagccttttgtaaaggtcattgggccgcctggctcgatgctagccggggtgggacgcaggagagcctcccagcgtagtaaagccggggattttcagccagctgaacctgtaatgtttctggcatgattttattcttcaagtggaattcagttagttccaggctttcccgatgaataagaggttgtgggcaaccggcggtagcccagatttttctaaagtctgacccagtttccccgccagtaaa

SEQ ID NO: 120559 - DNA, 1015 bp, Homo sapiens
ggatgttgtgcaagcatccttgcttggatcctgtcggccatgagaatctcacccgggctcctgggcagtggtgaatgcaatttaaggatagtctatgagatacctttcttggttgtgcagacatgcatcccttcatccttcgcaggcggtcctgcctcacagggcctcaagttttgggtctgcggccagctgtgtttgtttcttggagcagttcataaagaatttcagtttatggtttgggctagcagagaggtgggtaatgctttgggttggagagatgccgtaaggtgcgcctccactctccttagcccagagggaaaaatggagttcacctagctcctgagagaagggattttttttttttttaaaagaaagagttatatataccacccagcttctttgtgcttgtttttgctaaaagtgtgttttctcttctattcccttggctcacagggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcaggtaactgatggaaacccctggccatggggttattggtcttaatggggctattagtcttcatgggacagtctttgaaattctggagagcttcactctccagtagattctgtcacccttggcttagaattgtaggtgagtgatttacacttgagctggcctcataaatcacatggtttgcacttgagctttccttgggaggtcagaggaaggcatgtgtgagcatattaagaagaaaagacaatctggcttctccaaaaacttttttaaaggtaccaacagaaacctgataattcctggctgttttgccagggagtaaaaagttaaaagctcttttagcatcttctttaaggcagcagctccaaatattttggtaccagtgacctca

SEQ ID NO: 120560 - DNA, 1036 bp, Homo sapiens
ggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcct

SEQ ID NO: 120561 - DNA, 1098 bp, Homo sapiens
ccagtgatacattcatttctcaatgatgtggtcacatctagcaagttaggccagagcacgggccagaccccatgtcccttaacttccagcctattgcctgtccacacaccatcattgctcttagctctctgatttatatctagtgacttgggggatttgtctaaggctacctctgccatcttgtcacgtgtctgtatgattttcttcctgcaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatctcactggtgtctgtttttgcctctcactgtcccctctcctctgcacttccttagtttctagttcttcct

SEQ ID NO: 120562 - DNA, 1048 bp, Homo sapiens
tactgcaaggccgtgtccttggcacttagctgctcggggctgttttgggcttttcactgtgcttatgggtagcaggtggtggtggtggtcttacatggatggaaggagacatcaggcagtgctggttgcggtttgctttagagcatttgtggagagttaacctaacaaggctgttttctatttacagatgaactgaggaagtgtagctggccaggggttcccagggaggttcgacctataacctggagactcctgtcggtgagttctacccactgtgtagagaaatgtgagcctcacacagcccttcttgcctgatgaggttagtctggacacattggtcttaactccatagacttctctagtcctactggatatgacagaactatgggactatagtcctatttctgtgcataaagaaatacattcttgagagtttattcacacacatgtagtggtacacagacttgtaccaatagtcatggtgtcatgttcttaacagcgaggaagaagaatagagtgagatagggtgatcccagcacttgctttgagtaagctccaacgttccctgtgcttcactcctgtttcagccggaataaccaaaagttgaaacccactttgatctgtgaagagttgataaattggcctcccttggaagctttactagtcctgctttcaccaagtacagagcactgtgccagccgctatgatagaaacacttgggtttcctgagcctgtaaaattcattcattcatctagtgaggatttattgagagcctgctgtttgccaggcatagtgccagatgctttgagcagatgcaaaaatgaataaaccacagtccccactctccaggcactcactgcagaatgcattacataaatgttttcaagaagaagggtctgtctcctgactgctcgcccccacctctactcttgcaaccatgcaatcattgcctctgccacttctaataagtttgaatactattcagagtagatttggtgagaacggaaggggaacagaaaatataagaatgagagtgggatctagacc

SEQ ID NO: 120563 - DNA, 1105 bp, Homo sapiens
aagttctgtctgagtgttgtagctgtatgtcacagattccattcagctgcttcctaagctggtaattctgaaagttacactggaaaagaatgtaactggcaccaacttacttggcacactgctgagatgtgctgtagaggttgctatatccctgcatttctcagaagtatggccctggacacacacagccctccgaggccatgacttgggtccagctccctcccactgacctacattcactgctgtactgtgccagctctgggagctgaggagtgctcaccagtggcacaagctccagcacagtgcagggccaagggagtaaataatcctgggaaagctggccttgcttcatctgctcacatgtggatctcattgaatgaggagagggcaaaaaatgggtggccagaaccaaaaagggatttacccttggcagttttccttcttggtagtttccaaaccactgcatagattaaaataaaaattaaggatttatccaaccattgtctttccccatctgaccagcagtcttgtctatagggctatctcccagcaaacactgagaggaggaagttgaccctgcagcggaagcgggaggaatattttggcttcattgaacagtattatgactctcgaaacgaggaacatcaccaggatacctacagacaggtacagtcaccacctgctgcctctttgcttaccagtcatatactttaggtatgtctcatggtagtgctctcagggtacaggctttccaagtcttcaggctgtggtatattggttaggagttaaatttatcctcaaaactgtttcccctcttttcattcagcaactctgattttagccattttaaatagacagacttttttggcactagtcagtgcactgcttctcaaactttaatgtacatacaaatcacctaggatcttgataagatctcacctagagattatgagaaaatgcagattctgatttagcaggtctcaggtaaagcctgaagttctgatgtgctcccttgcaatgctgctgctgctggtccaccaaccacactgtgagtagtaagcgttatcgagcatggagaggaaagacaagcttacctagccgtggt

SEQ ID NO: 120564 - DNA, 2052 bp, Homo sapiens
tttagtagagacagggtttcaccgtgttagccaggatggtctcgatctcctgacctcatgatccgcccggcttggcctcccaaagtgctgggattacaggcgtgagccaccgcacccagccagatgattcccatttctttaaaaaaaaattgtcaaaagaacaaactgggccaggcacggtggctcacacctgcaatcccagcactttggcaggccaaggcgggtgggtcacctgaggtcaagagttcgagatcagcctggtcaacatggtgaaaccccgtctctactaaaaatgcaaaaattagccaggcctggtggcaggtgcctgtaatcccagctacttgggaggctgaggcaggagaatcgcttgaaccctggaggcagaggttgcagtgagctgagatagtgccattgcactccagcctgggggacaagagcgagacttcatctcaaaaaaacaaaaacaaaaaaaaactggcatttgtgtttttggacatgccttctctttttcagattcacattgacattccaaggacgaatcctctcattccgttgttccagcaaccacttgtacaggaggtgagggaattacttaatgttctttggcgcttctccccgcatagttctgtggcacctgtttacaggtttgcggctaatcataatagtaccttatgttcatatatgcagctttggttccttcagagcatggtttcatacattttcatttgatctttgttacaaatctgtgagcggaataacactttgaaaggctaaggaacttgctcagaattttgaggctacctggtggcagaatgaagaacccacatcttagaattcctattcctgtatttgctctactttatcaagctggaagtagtgattttttaaattgtggtaaaatatacataatataaaatttactgtgttaaccattttttagtgtacagttcagtggcattaagtacagtcacgttattgtatgaccatcatcaccatccacttccagaacatttttcatcttcccaaactggaactctgtatccattaaatattaactctcttctgcagcctccattctatttgtctctaagaatttgactactccaggcagctcaaataagtggaatcatacaatatttgtccttctgtgactggcttatttcacttagcataatatctttaaggttcatccctgttgttgcatgtgtgaatttccttttttaaggctgagtaatattccgttgtacatatgtaacacatattgttgagctgttcatctatcagtggacacatgggttgctttcaccttttggctattgtgagtaatgctgctgctagtatgggtatgtgaatatctgtttgagtctctgttttaaattcttttgggtatatatttagaagtgggagtagtagttatattttgagacctaacaagttaatgaagtacatggaaggtgtcagtggggctattatgttttgactcaagcagtaactgtaaacttcttaagattagggatttcctttgcaactttacagtagccaggacactaagtactagtgctcttttaacggaactttcagttctcatagtagagagggatggtggttaaaatgctgaaaataatttctatttgactttgggttatatttataattttgtttaaatatagatgtctccactggtggggtccctcatgtcttacccatagcataaagaagattttgaaggtaacatcattattttaactataagattcagctcacaggaagctaaaaacccattcatgatccctttatcctcccatacagttttccatggctcagcactgcttattcctcattttaacttggagatgttcagagacttttcttttacctgtgcatgcttactctgaatttggagatgaggaaagtagtcagtttaaaaggcttctcagccaggcgtgatgactcactcctataatcccagcactttgggaggccaaggccagagggattgcttgagcccacgagtttgagaccagcctgagcctaggagtttgagaccagtct

SEQ ID NO: 120565 - DNA, 1012 bp, Homo sapiens
gctgctgtcaaaggttttttgctatggccctcctggtgtgactctccctactgtaggaagcctcaagtatctttctcatggaacaggccagcagttgccctcattatcctgggtaggtctctccaggcatccttaccccactgccccatctcactgaatcatagcataggggatctgccctagtggagccgtggggtccacatgccactgggacattatttggcttctctcatatctcttcccctacctattctctaccacctctatcacttttaaaaattagtacctgagcctgcttcatgctttatgttatgtttgttgtaaagtagttggaaacagtgagttccagtgattcccctgtgagttgatagagaagttgtctatagctctagccttgcccccaagcagcttctttatctgctgaagccagctgctcctgtaaaagtgggtcctctgcagataagccagctgtgtctgggtctagtggtgacagtgctgcaggtggggaggtcacccctggggagataaagtctctggaatcttatctctgagactgtggtataattctaaactctttcctccaagagcttttaggcttaggcaatattagtctagctctgaactactgaggtccaatataattgaccatgcagccatcatcaaaataaactgcttaacaggaacaacagaagtgattcatataaggaagtcatggagaagagcaggacttatgatgtttcctattttcaaaagaagagtggtgtctgatgatatttttaggtacaaaatgcaacaccaattatcaagtaaccttttctcttttcctttgcataaaacagcacagtaggattttcaccgtagattttacctggaagcatgacagcagtggaactctcggaaaggaagtcctccgcagacctctgacttgtgtccggttccctacatggcatttccacctgattatgtcatagatgatcacttaggattagctaggctgcacataacagggaac

SEQ ID NO: 120566 - DNA, 1147 bp, Homo sapiens
gttctgtaggattgatgttttgcagaacccatcttgagaaataccatcttgttggaattaagtcctagaagcactcacaggcttgactcatcttcctttacatgcataccttctcttttgagtggcaagactgtgggtctgccttatcagaacttgggaattccatctttaaaataaactgtgggggctttctgatcctagctgttctccctatatatgagtgtgagtgtgctagacagctcactgagctgaaatcaaagaaattttccaggccatcttcagggatctgagtataattcattgaacatgagacctgaagtatcattttctaaaactgaacgaacaaatgccaaggaagagaaagatatgttggacctgatgggactagcatgagaaatggcctgtccagtgttgtagtgagatcttcaagaacaaatatgttcttgaagggacatatttgcccacctgacacagacagtagaggggcaggcccttgtttcttaacatcaggttagcctggtcctcacttggccttaaagaccccattgaagacactcgaatctatctttctctctccatttttagataagacctctggactttcttcaccttttgttttacagaagaggatgtggagaactttgacgtgaccaacttgtctcaagacatgctgcgaagcattgaggctgacagcttttggtgcatgagcaagctgctggatggaatccaggtgagctgcttctgcccttgtgggaacaaacgtctaggtccagaggctcccagcagggctttggtttctttcttgctcttctgtatcaggcaggaccacccacccacccactatggctcctcctccttttcatccatctctatccttcttcattggctttacagctttcaaacagcaatggtgggtcgggcacggtggctcacgcctgtaatcccaacactttgggaggccaagactggaggatcgcttgagctcaggagttcaaaaccagcctaggcaacatagagagaccccttctctacaaaaaattttaaaattagccaggcgtggtggcgtgtgcctatagtaccaggtcctcagtgggctaaggtgggaggatcacttgagcctaggaggtcaaagctgtagtgagccatg

SEQ ID NO: 120567 - DNA, 1055 bp, Homo sapiens
taactcagtgggcaagtgttattcctttagattcaattgttgtggattaatttatgacttctgaatagcttgtcagtactgcagtcttgggcaggtgggatggggaggacgaattaaagcacctgaagaaagggcaagaagactataaagcagtcttagacatattctaaaccatttgatagttctttatggggccagttgcatggggagggacccatataaactcagtggtaagactgtggctggcttcagggacctgtgtgtaggagaagcctgccaggcttggctgcctgcaaggtcaggtcgtagcatagcctgaaaagaagtctgaatcaaaggcaagagaagaagttgtacttattgttatggtccccaaatcatagcacaagctgttttgcacaagattttaaaagatacgctaataacataacagcaaaggtaggtcagttccctgcctttccagttcttagtctcagatgttgtggataaaataataaaacagggttcctttcatttcattgatgggaacactgtagtaaattgtctaattaagtggctttaagcttgttaaagcaatgcatagagtttggtggaaaaacaagtagagatttattgcaaattagctagttctcaggtactataaagtatctaggcctttggggaaaacaacagaaccttctctccccttttcttctcttgtatttagttttcattaagttttctgccccaagggaaaaaagggaaaggatggttatatttactggtttgggggcttttttgtggggtgttttgttttgagacagagtactccttctgtcacccaggctggagtgcagtggtgtgatcacaccttcacctccctggttcaagtggttcttctgtctcagcctccgaagtagctgggattacagatatgcaccactatgcccagttactttttgtgttttcaatagaggtggggtttcgccatgttggccaggctggtctcgaactcctggcctcatgtgatccgcccgcctgggcttcccaaagtgctggaattacaggtgtgagcc

SEQ ID NO: 120568 - DNA, 1865 bp, Homo sapiens
ctaagtgaaaagaccctcaggtaggctggcacttcggggagatgggcttaaggaacaacaacaacaaaaaagtttgaggggctggagcagctagtgttggcactatggtatgagttaagactaaagagtagaagggctcaggacattcagggtcttataggccatggaaggaagtttgaatgattggacagttttaaggaaagaaggaaaatgacctgatttaaaatttttacatttctattccagttactattataaagcttatgggggctagagtgagaacagaaacagtaggaggccaggtggtttggactaaggctgtggctgcagagataggaatgaacagacttaggacatatttgaattatagcccatataatttaccagtgatttcaatgtggggatgagggacagagatgaatcaaagatggcttctgggttatgggttgagtagttggttggatagtattgtgaatactgagataagagtttgtggggaggaatagattaggtcagtgagtcgtggtggtctttgagggactgaggaggacaggcattctgaaagattttaaagagaagagaagagggcagttttagctaactttggtttaaagttcccagttaaggttgtgatatgggacattaaagaggtcgtttgtgcactaagaagaatatgcagggagccgggcgcggtggctcacacctgtaatcccagcactgtgggaggctgaggcaggcagatcacttgagatcaggagttcgagaccagcctgaccaacatggtgaaaccccgtctctactaaaaatacaaaaattagttgggtgtggtggtgcgtgcctgtaatcccagctacgtggaagctgaggcaggagaattgcttgaacccgggaggcagaggttgcagtgagctaagatcgtgccactgcactccagcctgggtgataaagcaagactctctcaaaaaaacaaaaaaaaattaacaaacaaaaaagaataagggaattctgtgatctggaactcagaagaatttcatttccttccttcacagggttgttatgaactagactggtccaacaggaaagtatgatagatgtgaactggggcttcttttcaaccttttccggaagctctcaagctgttcttgtggataagacagagaatatgtactccaatgcaaagacttttggttgaattataactggctgaaggtatatccagatggtgtgggttaatgtttactaggttttcctgaaaactttgcctttggctgcatcccattctgtgtcttgaacgaaggtatagaaggcatcatctcataaatttggtggaagagatattaagtatgtctgatctgatggcagattaaaaattcagaaaggtcttgacaaattggtttgataggctgaactagcaagatgaaatttaataggaatcaatctaaggtcctgcgcttgaatccaaggttttccatccagtcaagtatagagcagaagagacaggacttaggatagcatttcttggaggagggggagaccaagaaatttaatcattcctaagttcgaggatacactggcagtgtactagatctgctatgaaagctaatgcaatttatatgctccagtgataatatctagaactgggaaagtaacacttgcgtttgactgtgtaatagaaattaagtttatttttcttaatatgccatccaggaataaagataaaccagcagtcccttcacagactcattagaatggcaaaggctcaagcccatcccctgggagttaagttgaagtaactgggaatacagaaccaggaaaagagaaaactcagtgttcactttatatctgtgccattgaaaggggattgg

SEQ ID NO: 120569 - DNA, 1053 bp, Homo sapiens
cccatttcctcctgattatttcataaaagctgcttccagttctgaatagcttttaattacttactagttcttaaatactgttcccagaatcacttgggtggctttaaaaaaaaagaaaaaaagaaaagcacatttctgggctccaagccaaacctatagaagcagactctgggacacagtgaaagttcttcagttgacttggatggccaccaatgttgggttagttttagaggccctagtccatttggtggccgccttccctaactgccctctcccctgaaaaaagcagcaggtaggtaagatagcccaatggaataaaggtattattttgaaattgccaatttatcgatccctgaaccacaaagtcactaactagagggagagaacaggcatgtttgtggctaaaaggaaggatgcattgtagttcatcctgagtatgtatctgctatgtttttgcagcattgggctctaatggaagagctaaatcgcagcaagaaggactttgaagcaatcattcaagccaagaacaaagaattagagcagaccaaggtactggaaagaagatggaagtttagaatttggttagtgcatgcaactcagcattttcaacagtgcaagggttgctagggaaaataaagagagaaattatggctgctccttgcctctggggagataatctataaaattatagaggcctatagcaggttctgcctgtcagacaacatctatttccttcccttgttcagaagcaaaatgctgggaataaggcacttgcatcctgtattctagtcctttgtctatggtgggtactccttcagagtgtgtcactgatacagactgaggaatattgtagtcaagaaatagttcctcctgaactatgtaatttgaattacataaagtaaagtgaattacttaatgcagtttcttcccatgtcaaatcaggagaactcttgaattaggggttataaacttaaatgcccaccagggccagactggtaatcaaagtgagtgaagtggcctgaatgtaagaacacagtagggagctgtgcgggc

SEQ ID NO: 120570 - DNA, 2232 bp, Homo sapiens
ttttttttttgagacagagtctcactctgtcaacccaggctagagtgcagtgccacaatctcggctcactgcaacctccacttcctgggctcaagcagttcttgtgcctcagcctcccaagtagctgggtcccttacaggcacatgccaccatgcctgtctaagcttttgtatttttagtagacatggggttttgccatgttggctaggctagtctcgaactcctgacctcaggtgatctgcccacctcagcctcccaaagtgctgggattacaggtgtgagtcaccacacccagccgaccccttcttattctcccaaccctgaatgaagcctgggctacacaggctgcttctactataggggaacattctgaagagattttcttccaggaacttataactatttgatttcaaagtcacctctagagatgaccacctcttatttgtttttataatcttctttcccttcactgtccttttttggcatttcatctgttcttaaatgtttatttggtatgattaacattttgagctgcaatgaagcctttatctctttgttgttgaggagaaaacagggccaaattagattttggaagtatcagaataaagctgctcaataaaagctattctttctttactctgaatgggcactatgccgagaatatgcttatagtgcaaccttttaaacgagggggtaaacgtcattaaaatgtggtcactttgggaatttacggcccaagttgaatatatttcagggactctgaggctccttatggaaatgaaacctctaccatttgttagcctatcatatttttgcactggcttatttatttatttgacaaattctgctgtttgtgaccagttcaccttagaccacagatgttaaattcaagttgctaaatgacagtgctattcagactcctttaaaaagaaggccaggtgcagtggctcacacctgtaatcccagcactttggaaggccaaggcaagaggatcacctgaggttaggagctcgagaccagactggccaacatggtgaaacaccatctctactaaaactacaaaaattagccagacatggtggtgtgtgcatgtagtcccagctagtcggaaggctgaggcaggagaatcacttcaatttgggaggcggaggctacagtgagtcgagatcacgcaactgcacttcagcctgggtgacagagcaaggcatgaaaaaaaagaaaaagagaaagaaaaatgtaggccgggtgcaatggctcatgcctataatccgagcactttgggaggccaaggtgggcggatcacctgaggtcaagagttcaagatcagcctggtcaacgtggcaaaaccccatctttactaaaaatacaaaaattagccaagcatggtggcatgcacctgtaatcccagctactcgggaggctgaggcaggagaattgcttgaacccaggaggcagagcttgcagtgagctgatatcgcaccactgcactccagcatgggtgacagagcgagactccgtctcaaaaaaaaaaaaaaaaaaaaaaagaaaaacatatacacacagctttcttttctcaggtgatctttagggaagttgggtctgttagcctcttgaaaaatctctcctgggcagaactgtttcttttcctctgggtccgtttggacttcagatcgtaacttctcccataatttctagtcatctgattctctactttggagaagttctatgttgttttgacagggcttatggactctataagaggaagacaaggaacgggggttgaaataaatgatgagttagccaacctggagcatctgcagagacatataagacataaacaacttgaccctgtgttttgtttacagaatactgtcttatctactctactggtcacctcttaaaattcgtctcagaaatatgttttattttatttatttatttatttgtttatttttgagacagagtctcactgtgtcacccaggctggagtgcagtggcgcaatctcggctcactgcagcctcctcctcttgggttcatgtgatcctgcctcagcctccggagtagctgggactacaggcacccgccaccacacccagctaatttttttgtatttttagtagagatgggatttcatcatgttggccaggctggtctcgaactcctgacctcaggtgatctgcctgcctcggcctcccaaagtgctgggattacagtgagcctggccagatgct

SEQ ID NO: 120571 - DNA, 1054 bp, Homo sapiens
gatagtagggccaggaatctgatgctgacttgcaagcacctgtggtttgaaactggccctctgctggtcagccagaatggaggcagcaggcttgtcacagaggctgagcaggacgtgtgtctgagcctcttatgcccaaggaagacattctgacctgtgggagggcagagtagactttgaaagctggttctttggaactgaagttttaccactttactaacagctgtatgctactgggttttgtgcctaaatttaagcccccacagattttcacttccaagagctacttgatctgacagaatcccattgttcttccttttcacctcccatcactccataagcatttacaggaatactacactaggcatcaggagaaaaagttaaataagacattatctcagcccttacggcacaaacagtctggcggaggagatagaaaggcaagtagatagtgtgatgagttccttatcagggtgctatgaaacttcaaaggaagggacacacctgatttggcctggggaggtgcaggtatgggaaaaagcttcatcaaggaaatgacatttgaatgagccttaaaggttccctaggaggttagctttctaaggagaggcagtagcacaagcaaaacacagaggcatgagaagcagtgacctgtcctgccccagttcccagtgtggcccacacaagacataatattcacatgatgtcaaggcttagaaagtatctacggaggctttgtgaatttttttttcttccctctttccctttttgagaggagcagtgatctgggaatccagatttggccaagatcagctgagtcgggggacggggttggggggtggacctagggacacccatgggctttcttcgcccagtctaccacctaagttccttccctgcaatctaagcatggcaaatggcttcacaaaacatcagggaaagaaaaggctgggcacggtggctcatgcctgtaatcccagcactttgggaggccaagatgggcagatcacgaagtcaggagttcgagaccagcctggccaacatggtgaaagcc

SEQ ID NO: 120572 - DNA, 1093 bp, Homo sapiens
gctggtatgtgggaggggcagcaaggaggctagtgctggggagtggagtgagcgctggggagtgggtaggagaggaagcttgagcaagacgcagattttgtagggccttgtaggcctttgaaaggactttgactttaactcactgtgagaggaatgaggagtgggctttgagcagagagtgacatgatctgacttctgttttctcagttcgctatggctgctgtgtgaggaagagacagggtggcgaggctggaagcagggagtccacggaagggaaatacaggctcctcatttatttatttctcttctttttctccaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcat

SEQ ID NO: 120573 - DNA, 1003 bp, Homo sapiens
gggatggtcccttcaccttgggaatattggttaatatttattcggttttatagttcattttcagtgtacattgtcatgcatggccaatattgcatcaaaagtgtagaataactacaggtaccaaggctttatcccccagtggcttgtggagttgatccatgactttctgttatctgacaccagtggcccagggctctctcagtctgtgagcaccacattttccagtaaaacagctattattgaaaaccaacacttgtctagcatccttcctagacctcattctgaggaagaggctattcaagtgctggcactggaagatgtgtagaattgccaaatctcatcccattgatgatttacactttggaatccctgctgtgatcccagtggctgtgacccaagggcagctgactgactggatttatggttacagttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaaggtacgtgtgcttgtgtggtctgaggccactggccatctggttatttgaacacacagtgtctaatctaggtggagcagactatagtccactgccccttggtcccttgaggaaaattaggaatactctacagagagatgttggctatagactcttttcccttctgccattctcctactaagagtggggaaacttgttttaaataaaaaatggtaatttttccagaagttgctttctgttggttgtccttcagtaggtggcactcttgctgccttaaaccagttagaagtagtggtgagcattgagtgctgtgtgcccttaatagctgttaattatcctggggctcttttgtaagggagggcctctttgctgcggccgtcgagcctaattttcactttttttgcatgcataccgttttctcaattccttcagcggtt

SEQ ID NO: 120574 - DNA, 1102 bp, Homo sapiens
taaacggtatcagtgttctgaactatgacagatgtcctaattcaacctactggtggggaagctaaatcatagcccaggagggctccgttctctgttaagatatagagatcccattctcatccttaaacttctgaggcctgaacagcttgcactatttgtaagaggaaatgtctcaaggagtcatatactctgtaggtccttaggaaagtgatacttggctgacacatctttacatttactacagtaatcatttaattaatttctattaaatggaaagcctcagtccaggtgttgggtacagactgtgacatagttcctgctctccaggagtgaccctgtccaatggggacagcaagtggcaaacaataactggctctaaggcaatgtgatgagtgctgtgccaatgacactggtgttactggagcacagtggaagggataatcagttaggcctggagtgctggggaaagctttgttcttcttgaatgtcaacccttagcaggttttggttctggtagggaaatggatggatcacttaagattggcttcagaattataatgtattcttcaagttagaaatacctgaatagtgaccacctcgggtctattaaaaaatgttttacacactgccgtctgtgactttccttcagtacttctcacaagcagccaagttttgaatcaacaccctttctgagtggtgtcccttcttcttcaaaggaattatgccacattgctaagtcaatattttcatatttattttaaattttaatagataatatattcacatggttcataagtcaaaaaatataaaaagatagccagtgtaaactttcgtggtataaaaatgtaaatcaagtttcacttttgctttcactagttccaagtaattgttttggtattctgtctccaaatgctaacccctgaatgtgtgaataatcacttttattggtcttcttgtatatcgttccttccaaaagctctttttgcaattataagaaataaaaatgttagccttataatggaatcgttgaaaatggaatcaggcatcagtgtttggatattgatgttctaataataaccaccagcagcagaaataacaatca

SEQ ID NO: 120575 - DNA, 1862 bp, Homo sapiens
aagtgggctcctgccaagccacttatccttgcctagtaaggctgtttgactggataagggtaaggtagaagttacagcttgaagcggttccattttaaattatgttctctttatcaagtctactctaggtctgcttctcacttaatcagacaaattagcaaatgtccaatgagagattcatgaagtactctgggtgcttttaattaggctatgaggtcccttctcatttatccaatttctggttgccctagactttaacctccagaacagccagccactgggcccacagttatactgcagttatttatttatgcttcttttcttcattaggctaagacaaactttagactttaatcatctatttttcttaggatttagcacactgtttggcatgtgatggggctaaataaatgtctgttgaacctaattaattgtgctccactacttctctttttcaggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagaggtaagtgttaaagtgaggaggagatggaaaagccacttgtgtttttggatgcatggctttaagaagccatatcaacaaactagaaatctccagaggcagtatgagcaaagtggaattagttttttacgtggaaagtactggggatatccagaatggaaaacagaaggctgggggagatatggtgggatgtggatttcctgttgcattataggactgtctaagaccaacgggtagaagatgcttgaaaggcagagtttggctccataaaaactttaataaatagttacagctctccactagtggactaggataccttgtgaggcagtgtgctctctgctgaaagtgttcaggcaggccaagggagcacccactctctcactgtgtgagtaactggagtaggtgccttctaagaagatccttgtacttccccaggtttgtgccatccaggttctaaataggtgcttttttatgccacattgcttttctactgtgggtttagtctgcttactagggtaccagtttgttttcaccctgaagaccaaaggaaactctcattatcccttttcatggcacagacaatgtgagattttattttattcatttatttatgtcctatcttattccgtaaaggatctgtagtgggtacaataaaaacacctaaaaataacattgagatattaccattacagagttgaaactagagaaaatggaactcaaacatctagctttctgcatagttgctgtagttcagcttcagatgtggctctgaactctggaaaattgatattttatttgtctccctaatgttccagttcaggaaagaagtcccgtgaatctgcatgtgataaaagcctaataagtcttctgagtaagattctgacgagtgaggggctcatgggttctggggccggtctcgctgttgccttgtagttgtgggcgttgagaccagcagactggcaatgcggaacagggtagatacctgctgctggttgctggttgtgggctttcatctcagaagtacctgatggtttctatgtcttcattcgtgttaaaacaagagtccacatcctttcagtggggcagaagttgaactaacttcactaaactcaaaatctgaaatcaccctataggccgggcatggtggcttacgcctataatcccagcactttgggaggccgaggcgggtggatcacctgaggtcaggagttcaagaccagcctgaccaacatgacgaaaccccatctc

SEQ ID NO: 120576 - DNA, 1060 bp, Homo sapiens
ttgctgtgtgaccttggcccggtggttttactctctctgagtttgagtttcctcatctataaaatgaggagaaaatactcttttctcagggttgttgtgagagctaaatgaaatagtgggtgtgaagtacctgggtaaatgttagcctccccttgacactttttgtcttaattgagaatcacattgtgtgtgggcagaatgagccagggaaactctgaggaggaaatgggttggtgaaaaaggcaggcctcagagtagcctcacagattttattttttggcaggcatagggttgggaatatccataaggtgactggagctcaggtaatgtgaggatttctttatctagagaggaaattggtcaggggagtttgagagaagggattgctactgtgtggtaggtgccatcagaaaaccctagtcttgtttatttgtttctcctctctctaagtgaggtctagtcaggtaagccttcataccagaactttgatcccttggagagtagctgctggtatgggatggagaaacagatttactatgaggattagcaatgcccagaggtggctctgtgtgtagcagcgggtgccgttttttaaacacttgccatgtgccaggcacctgtttacattttttttttttaaccaatttaccggcaaggtagttgagagagttattgagcagcctgtgtagggtcacacagtgagacatttcagagctgagatgccacaggaatcttgttccttggagggctgtgagttgggcactgcagggtcttaaggtccctttcctatcctggaattcaccttgaggttctgattctctgggcagagcgtgtttgatgtcttggatggggaagagatgcggcgagctcggactcgggccaatccctatgagatgatccgaggagtcttctttctaaacaggtttgctgacatttccctcccctcccctgatgctccctgctctaccttttcaattgagcctagtacatctagtacttttctgtcttgctttattgcagggcagcaatgaagatggctaacatggattttgtatttgat

SEQ ID NO: 120577 - DNA, 1095 bp, Homo sapiens
gtagctgggtttacaggtgtgcgccaccacacctggctaattttttgtatttttagtagagacagggttttaccacgttggccaggctggtctcaaacccctgacctcaggctatctgcctctctggcctcccaaagtgctgggattacaggcttgagccaccgcgcctggctccatgaagatgtttttatgaggagtctgagctaggcctggtgatgtgataggcattgtgggtattttgagggtgggtgaggcaacactaaagggtgttaatcaccagaagatacatttcctgggtgctgtagctctggtgggagctctggattgtacttgccgaaaggcttattttactctccctgcattctccttcctgttgcccattgagctgtcttgttttccttcctctcctgtcctccacttgcctttgcagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtagggacattgaggagggtactaggaggtatgagggacagcccctctatggggacttcaggtcagaagcagttgttatccacatgccatattttctttcctaggtctcttaccctgggcttcacagttcatgtcagaatcttggttccctctggactatccctttttaccctgggcctgcagaatacaggtcaaacactccctcagcagattctcatcaaggccctattaattcctcctttcaggaacactctgcttttgtggtggcaggagataatgaaactgcctgatctctggctgagaactggcagggtttttaacaaatataaacccaatgcccatctctcgccctctgtgccaggtgcagaatgcactgggttgcagacagctcagcaacccacagcagtccctctgttctatgttgattgtaatttgacagcaaatcctaagtcctttctgaacagtc

SEQ ID NO: 120578 - DNA, 1600 bp, Homo sapiens
cgctgtccattgtccggacaggtgacacttcctcagctgtctcctcaccccaggacccacttagaggccctattggacaagaacatgtacaaggggttggtggggaagttaaaaaaatctgcttatattagaggacaggtagctaaatgagtaatttagggaagaaagggctgtggaatcctcaaagtcccctccaaagatggttctcccccttaaattgtctctgagttttaacagacccaggtgctggtttccttgactttgtcatatttactcccaagactacttcacccatctcttggaatagacccattggctgcttttggtgttttctctctaatctaggaggccacttcatctgtaaaacctttgacctgttcacaccgtttagtgtggggcttgtctacctgctgtactgctgctttgaacgagtttgtctcttcaagcctattaccagccgtcctgccaactcagagaggtgaagcctttctctctatattagccagattaattggctaaatgtcagaacagcaaatcatggtgcatctctctggcatgacctcttaagctacgtttaaaaccttgactttaaagaagtgatgagagccaacaggattcaggattcctggatcttttggtcttgtgatatgccagttcagcctctgcctccttcttccaagccttatgctccatgcttatgtgagggattctcagcttggccaaggagaaagtgaccaatagtagggacacttcaggggtcttgggctgggaaggggcaaggagccgctatccagaggcactactggggtcccagtgtgacactgcccacacacaaggtgagagaaaatgcaaccaatcagaattgcccggtggctttgttacaaacacatatttctgggccttctcctgggagagtttgattcattaggtctataatttaacagactccccaggtgattgtgacacagcccgtctgtcacagggaagttaggaactactgcgatagagagtagaaatagagctcaacagagaaggatttgaggggaactttagcaccacaaagggtctgtgttgttctttgtgcgtaggcctaaggttgaacagggaagccattaagctttgtgattccacaaggggttgggggaaaaggaatgtatggggaggaagcccttgctcggtggagtgacagagtatcttctgccaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagaggtaagccaacgggctggtttttgctggtaacactgaggtcctaaggaagaccagagagtgaaagactgaatggttggctcttggtatcactttgtcaaccctgacaaattggcaactgggtttggtctgctggtttcagggctccctgggactttggttagttaccctcagggacccccatcctgctgccatgccctatcccaagggtggcaggta

SEQ ID NO: 120579 - DNA, 1647 bp, Homo sapiens
tatttcagatcccagaccaggctcgtgtggctccttcttcctccgaccctaaatcgaagttctttgagctaatccaggtaagactggtatctgtggtggacataaaaagttagagatctgtctctagatgtggatggtatcactgaggccccagatgcatggtctccagagggcttgtgcagatgcccaccatgggctctaaggggcggagctaaggctgccacaggtgggaacctttggtatagggtgttgaattccccaagagcacagtcaggccaacggaagattctcatgttcagtgcttgggctcagcattcctgccacccaaagggtggttctggctgtgtcaccctggcaagttcagggtcctgtgggatttgcctacaaaggagacatagagtgtgggatgatcttaggcaagggagctgggcacagggtgaagggagctgccagggaagcccgcagcagggttggcctaaccccaggttctttgtcttatttctggtgagctggtcctcagagttcttttgccctgtttcttctaccactcaacctccagcttttacttgggcctcatttaaatctgtcccagatcatgggcaattgtgctggttttgtgggggtcagggagtagagactgaggttcaagatgccctcaaaagaatagtatgtgtacatttttctaaatggggtaaagagatcactaaactgttctcaaaccaactgctggagaatccttgctttgagttttattgaaggggcagcttttatattctggtgacattttcttataggtctggtaaattgatctgtacttggggactcagtgttctttccttttccagcctctcctaataggtcctacaggaacattccaagcagatggaaatagatcccatttagtgcacagttaggtagagaagggggtgcaggggagcatatttcagagagccaatgcttcctgtcccttgccttgtcgagcctgcccccagcccagataggcacccatactgtcccttcccccaacccggcagtgttttctctgactcgtggctgcagggcactgagattgacatcttcagctacaagcccacactgctcacctctaaaaccctggagaagatccgccctgtgtttgactaccgctgcatggtatctggcagtgagcagaagttcctcatcggcctgggggtaagtctgcagctggcttcctgcccagcttggaatggtggatttgccctttgcggaatctggacagctgcctgccacacttggtacatgttctcttggcattaagtagctgttgctttgaccctagtgaaggtatttcttgaaacttcgtttcctttcttcctctgagtttgccaagtgtcattcattcattctttcatttgtttcttcaattctgtgcattgctaaagggaacactgctacttttcttgtgatacagagcttcccaggctagcagagtggtcagcaggcttatctggcttgagcccaggcagccattcctttgcaacaccaccaccaccccatgccatcccatcccctgtcttgcaaagatactccctgtccctaccctgggccccctggagtctaaagtgaggtgagggaaagccttggcaagctctttatcttacttaactg

SEQ ID NO: 120580 - DNA, 1991 bp, Homo sapiens
ggctcttgcccaggtctgtccacatggattttaggccttccataacaagttactgctaaacagtcctaatagtcctattacccacagcgggtggggaaaccctaacaagaatgcagggctcttgtttgatgcccatgctcagctcttgggggccctgaacatgtctttggaactgctagtggggaacgttcccagaaatcgagcaaccaaaccacaagcaatgaaggcagggttccccctgggagctgtctttcaggacctagcagacaggacattttaaagtgcagaaagaaattcctttgaaactttcacatgccatctataaagtgcattctcaatactggatttaattttaactaagtaaatttatgttaaaaagaacaaaaacaatgtggataaagtgtaaatagatacctcagtctccagccgcatgaagctcccgagagcagggctaagcagtgccctttggcaataacctcagacctcagcctaccctggaaaagtgtgtcctccatctgtctcctcctgactctgttctcttcctcctttctctctcagggtcctggaactttcccactatctaacattacaaccctggcctccttctccctcagcactgggggtcccattccctcaaacaatccttctctttttcatgttcaaaattcctattccctcagcacccatttcttacctgaaaaaaaattaaaaggccaggtaatgtgctaacaatgctcaagtgggaacgggtattcatgaggtgggctggcactctcagaagcacgtgcatcctaaacaaggatgccttaacccctcagaatgaagttcacccactgccaggcaggatggggagatgctctggggcaagtcacctacctagcacccccaaacaaacttcatggcaagaatggtcttgtctctaacacccacttgcctagtgccctccactgagccctcctgtccctcactggacgggagcagcaggtactggccagaaagaagcatggagggtagggaccacatgctcacctgatgggattcatgtcgggccgactaggcttggaaacggctttcacaaatttctcggcaagctgaattctacaatccaaacagtctctctgagaggcaagccaaggatgcctccaccagcacccctacccccagggcattttcacagctccagtaggagaaccttctgaatctgcggcaagactgctctaagaggcagcacccatgtcccccaggaagcccgccctgcccttctccaccgacgtctttattcatgccccgcccctgtggattctgacctctaatttcactatgtcggttggttttcctgaagtgtgccttcagctgtgctcagtcacctccactagaacttcaagtatcatctttattgtatgtgtctgccctgtcaccccaaagcatggaaactacagtgcacccactcagatgagcaacttaaatgggaccactcaagcacaggatatttcttccaaggagtaccccctctacccgcaaggtcaccctcttgctcaaccttaacataaatacctcaacctgagcagctgtggcaaaatggagtgtgctggtatctctgataaccagggcccaagccctagcaaactctgaagtggcaactccaattctcaccctgactttgggaccagtcagtgggtgggagggggaaactctcaggatgtcaacaagcagagaaggcctagataaggggccacacctcgggaggccgctgtcctcccaagctgccctggcctacccccaccctccctaccctggggcccaggtcagaccgctggttaaagtgctgctcccgaacgtcggtgccattcagcacaaggacatcgaggatgtggatggcactgatcttcctctgggccttcccctagaaggataagtaggtacactgcccactctgccaggtgtcagccttcagcccccactacccaccatggcatgctggctccattctg

SEQ ID NO: 120581 - DNA, 1149 bp, Homo sapiens
ggatgagtgggggaaggagacaagaaaatggtctccaatttggcatcaaaacagagtaagttcaaagaaacaaaaccttgatttttttatagcaggttctcctggccagctcatgacagcaggtctccacccactcagggatggcccaataaaaagttgggcaaagcaagggcatggctaccctcagggcagtgcatggaactcagaaaagtgagtctacaggatgcaggagagaacagcagagcccacagctctgccactctgatatgtcctccatcagtcccacgtgccctaggcactgacctcatacctgcctcaggagcagcttccttcaggctgagtcctggcaggggaaagttcccaggcaggtgtcccagaaggaacatgagtgttctctgcagggccctgcctgagctcttcaggggatggagaggaggccacccactcctcatgccaggtgcaatgctccccagtcccttttcaagagggggaagaagccagcactgtgggccccaggtggccccatctcaggaatgacagggcattctgcaggggtggcacattctgaggctcttaggccctgtgcatctggatgaaggagaggacgtcctccttggacagcttgtcctggtcctggggcttctgggagtcatgcacacgaatgccatccccccactcccagaagagccggccatagtagcaaatgctggggaggagagggatgggaaagaggtcaggactgcacccagatggcacagggtcatgtgttcttaagggtgtggggcggaggggtctgtcaatgactttagttgaggttcttcccccggcaggcaaaaggtacccggtaggccctaactcccctgcctcccagaaccaacttttcccaacaaacagctgttgctgctaattgcatccaactggattcctacagtgactgatattcctgacttatctgtctgtgcttctctaatatacagtattagtagtgtggtgacagaaaatgtcagtggctaattacaggcacattagggctgctggggaagcctatgaccaacagtctgactaatggacaccgggtcctaatgagggacagctgggaccttgagtgccaaggggcagggctgtgggccctcagcaggttcccaccat

SEQ ID NO: 120582 - DNA, 1074 bp, Homo sapiens
ccatggtggcactgtgacaatccaggatcagtctgtgtgactaaaataacagaggcgtcagaccaattagtgtcactagacttgggcgaaagagggagggagagatagatggtttcactgaccctagcctgcctcccctccaaggagggctggttctgcctgcacgggactgtgcttgggggtgggggatgcagatgctgcaggcacctccctctctgttcccggctggtttctccaccagttagtcatcgccctggtgctggttgccccccaaagtccgccttcactttgctggacttcctcactttggccccaagagtcctttgtgtatggccttagttccctgggcaaccccatcccttgtttttcctacttaactggtttcatctcggccatccacgcccttcctctgttctgccttgctgtagcctcccacctgctcccctccttattccaaagctaggagttttagagttggggggtggaagggtaagggagatgtctgagtttgctgctcctgccacaactccccctctgatcagccccacccctacttctcactacaaaccctacctgatttactggccactgtcaccgtaagtctgtctggtcattaccatgactcttcctgcccactcacagcctccccagccttgcctgcctgtcgaagatggattaactccgcactcccctgggatcgccacatgaccacttcaagtccccaagccgcccttcgctgcacagactgcatttttttctgccataattacaagcaatggcactgactggagggcatgacagtgtgtggtggggggatggacaggtggcacaatgtctgctgctcaaccccagcagtgcccgagccctggaagtaactcccactatttggcttggaaagtgcttcccactgtctccttcccactcgagctgggggccttctcctctattctgaattgtaatccagagctttcccttgaacatctcttcttccttgattcctgagtgccgcctctgctgctgctgcctcttcctgcccccaccgtccaccctccgctagtcagaccatgacattta

SEQ ID NO: 120583 - DNA, 1062 bp, Homo sapiens
cagaaagtcattccatttgggggacccccattcttccattcgtgaaatggaggtcttatttgccatgtctcctagggaagtggtgagaatgagtgaagtcagagatgggaaatggagcattatggggctccgaggtactattcagtcagctgctgggagggtcacagagccccctgaacccttccacccactgacacccaggctcgccccagccagagaggtggccagctaaacacctggagactgagtcagacacagggagatggactttcaatgccaaaacccaggtttggacaacccagtccagtatgttattaaacatttctccacaactcaagtatttccccaagaacacttctctgaaactctaatcaaacaaatggaaaaaacagataccttaactattttgctaccttgatggtaggtaaagtttttgcttaagaaccaagtcagagaggaagaaaggtgtttttgagcatttttctcagtaatttttgattctcacagaaaaatgtatatttttacaacttggactactaagttattaagatgaagtatgtcaatgagaaaaacacctctgtgttgcccctagatgtctaatcacccggccccacacgtgtggagtgtttggaagccagtttcttcacagcatctccgccactctaggatacgcccgtggggcaggtgcatgccgtgttcagggttctggttgctcctgttgtgcgcccaactggggcatcgtgctggggagacaacagaccaaggggctgctcctctccacccccaacctgtgcttggcccagagggctgggacagctgtgagaccctgggcaacacccactactgtttacagtgtggctcaggccactgtcctgtgcagttcagagctgaaccacgtggaggcagaggacagcaaaacaaagacactccagggaagacaggcctgggtgccctgccctgccaaaacgaatggggggaacacctgtccaagaagactcccggaggccctgcttcccagtcccagtgttttgagagctagaagcctcggcagcccacctctct

SEQ ID NO: 120584 - DNA, 1037 bp, Homo sapiens
cgtgtggggccgggtgattagacatctaggggcaacacagaggtgtttttctcattgacatacttcatcttaataacttagtagtccaagttgtaaaaatatacatttttctgtgagaatcaaaaattactgagaaaaatgctcaaaaacacctttcttcctctctgacttggttcttaagcaaaaactttacctaccatcaaggtagcaaaatagttaaggtatctgttttttccatttgtttgattagagtttcagagaagtgttcttggggaaatacttgagttgtggagaaatgtttaataacatactggactgggttgtccaaacctgggttttggcattgaaagtccatctccctgtgtctgactcagtctccaggtgtttagctggccacctctctggctggggcgagcctgggtgtcagtgggtggaagggttcagggggctctgtgaccctcccagcagctgactgaatagtacctcggagccccataatgctccatttcccatctctgacttcactcattctcaccacttccctaggagacatggcaaataagacctccatttcacgaatggaagaatgggggtcccccaaatggaatgactttctgagaagtcagggtggggcacccctctccttatcagtctcagccagttctctgccccattcgcttctggagttagcccctgcagggttagtaatcaatgactgcaggtaagatccctgcctcccacaatggctggttagagggtagcaggcattctggggctgagtgtcaggagagttgcattccaagtctctgggccttctgtctctctccacggccaacacccatctcagccacttccatgtcagccacttttccttcttcccgagggaggcctggcaatgacacaccatccaccccctgccctgcagccccaccatggccacctccagccccataagcagggccctgtgggagagagcgaccacagagccttgagttaattgcctggttaattgtgtcgtttctctgctactgggcacc

SEQ ID NO: 120585 - DNA, 1056 bp, Homo sapiens
gcagtccatgttctcagctaaagttgaacaggtgatgatgccctgccttgtttcagctgtcctactgtaaacaagggtccttattgtgttctatttagtgccctgtttttgttttgttttgtttttttcattctcatgttttttattggtatttcgctgtgttttgcttttgagacagaatctcactctcgcccaggctggagtgtagtggtgcactcttggctctgcaacctccacctcccattcaagtgttcacccccaccttcccccgacacagcctctctagtagccaggattagaccaccaccacatccggctaatttttgtatttttggtaaagacgggggtcttgccatgtcggccaggctggtctcgaactcctgaccttaggtgatctgcccacctcggcctcccaaagtgctgggattagaggtgtgagccactgcctgattttgctgtttaaagtgcccccgatccccgacccccgaccccaagcatagggctgaagtgctgtctggcattcctaaatccaagaaggctgtgatgtgttgtagaagaaaacaggttttttagataaactgttcaggcatgatataactcatgatgtaacagcacgtatagtgctgttggttgtgagtccagtgttaatgaatcaacaatatatattgaataaggtcactttaaacagaatcacacatgaaacaaggttgcaaaaatgttgtgtccataggcttgcaggaacctcacctggtttggtatttgctaattcaatattagaggcaactttataggacatagctaccaggaacaacaagaaccaactgtattcaggctaaggtaggagtatgtaaatgaaggaatatgtaaataagtgggtgtgtcagtgttccactaaagctttatctgcaagaacagtccttagaccatttggccacagggcttagttgccaactcctggtctagagtaccaggtctatggtggttctgccagattcccttcctctgtggcttcaccatctcttgagatcttgtcaccttatcagtggaaccggggca

SEQ ID NO: 120586 - DNA, 1033 bp, Homo sapiens
gccagcttgtcgttatagggttttgtttagcaattgttgccatgggtattttttgttattattttgttttcagtttctatcagctttgacactattgtatctgttgttataaatttggggcaaatacttgggtggtttcctgctatcatgggtgcatagttcactgcaaaaaggcagccccttgcaaacacaagcgtttctctgtaaacaggagatgccctctccacctgtctatgtgtccttcctgctgagaccatcaattacgggtttcctttgccccagacatcgcagacaatagtgacctgcgtggtgtcagggaggatgcaagcaccccaggtaccccactgaggtcctttcatccccctggcacatacagagacccagcctggattcccatggaggctgtttgctgagccttagagcagcttgacttgcctccatgttggaaattctgcccatgagcagatggattactgtgggccagctgtctgtctgtctgtctttattaccccagggagctgtggttctgaacctcctattgggggttttagaactaagtgtttcaggaaagtcgaatgctgcattgacagacaggagaactggagtcgttcctggctagcccaagttctcactgcatgaccttgggcaggtcaagcctcctctttggctcttaattttgtctgctcaatgggtacagtggggagaacgagacagtcaccctaggttcctgtttttcatgaccttgttatttgtaagacataacgaggaagacataaagcttccttgttagctgtaagggagacatataaagtaagaactaacgattacctcaagatctctttaatctagttagagagacagactgacaacatgaaatagtgcatgccagacatcatataattaaatgccagctgtctggtactcactgttgatgcattaggagtgcagaaacaagagaatggggtgggtatttggggatggctttgtggaggctctgggtccaggaggacagatgagattgcgtcaggcaaag

SEQ ID NO: 120587 - DNA, 1989 bp, Homo sapiens
tgtcctttcccctgtttgtccttctccgttcccagtctttgtctctctacctctgcagatgcctccacgttgatttctcctcctgtcaggcccaatttggaacattaattagtgatgaattagcaatgcaaatcccagcagttgccgtcgcctggtacccacgggctcttggaagggaccttgcaaatctgatcttaatacctctcgcctcctctcctagggcaattacttctcacatcatttgtctgcggaggcggtgtccaacccccaccctcccagcctggctgaggacaacaagttcatctttgtcaattaattattgaacggtttatttcgcactgggaggcgataagagaagggaaaaccgcatgttgtgaaatcatcaccgtaattatacagacgctgctgcatcgcccagcatcacaacgccgcaggtgcctgtggggggtgggaagagaaggaaagggcagaagtcccaggagggagacctgactgtgtggtcttaggataccctttgggcctctctgaattgtgttggacagacacacccacatggagcttgcggagcccacctccacgtgaggaggggatctgcagaattaaggtcataggtacacaggtgcaggcccctgcttccttagctggggtgatcagactgtaggagggctgaagatgtccttatggtccttcccacctgagcttcagaggcccacagcaggccaaaaatacggtggcatggtagagggtctttgatactctagcagaaagcccttacgaagacctgcaaggcccagagcatctgtcccagccccagccctcacccctggccttttacctctcacgtcatctctgatgggtcccaatattgcttattccactccaatcacacagatctctttgctactcgctgtacctgctggatacacacctgccccagggcctttgaatgtgctgttccttctgcttgaagtgctctttcctgggagagctgagtggctctatcacttcctgcaggtcattctcaagcaccaggtttcagggagacccacgctgagcatttctttcaaaattctggtggggaccccaaaacaaaccatctctctctcttcctgttttatttttctccagaacacttcatcacatttcatatatgatgtattttacatatttgtttattctctgtctctttttctcttacagagcataagctccacaaggggctgggattttcgtccgtctcaccctccagcacccagcccctgcattccacctgtgtctgcagtgcttagaactgtgcctggcacaaaataagtgcagaggtcattgttattgaatgagtgaatgaatgaatgaatgaatgaatgactatttgtgtgggacaaagcctggatgtggaaaggacagaggtgagttctttttcctggaacaggccagcaagggccactgcaggaccaggaatttaggaagactcttggcacagatgggaggccctggccaggaaggaaaactgctggaaaaatcattttaaaagcaagtgttccagttgatttcgtgtctgtgcacgccttgaggctggcatgtttgatgctgcccctccatcggtcacatgcagaacagcccccaccccttctcaactccccagggagggcacaggaacatgagtagttgcagacactttgattaactccccagcaagagtccccacgcctgtgtctccttctctcccaaagctgtaatggggggcagtgagctgagggctgggggatgggtggagtgaagctggggcctgcaggggtggaggcgactgagaagaggagtgggaggagggaaagggcttctgcccctaccatggggagatagggaagatgagtaggtagataatgtggggcggggagggggttacttggtgatacatgtggggaggtattgtagtcaagaaggcacctctctctctaggacagaaggagatgcagaaagagagacctccag

SEQ ID NO: 120588 - DNA, 1035 bp, Homo sapiens
cacagccaagtgcactagtaccatgagaagggggatgctcggggaagggctccagcccttcccactttccatcccctctgaagccctgcacagccctcagcatgaattttgaacatgttcatgaaacatccctacccgtttaatgtctgctttgagcatttccacccctgggttgcatgtgtacgggtgcatagcaggtggtcccctttctctatctcttgctcctatttcatcatcttgggagctgtcatttatggagacagcacatactatttggtcaggtgttttacatatattgcattagcccctcattagcagccctgggagaaggcatcattgttcttattttataaatgaagaggctgaggctcagagaggttaagtaatttgctcagcatcacacagcatcacccagctagtgggtagcagagccaggaatgggccccagattgtgtgactccacagctgtgctgtttccatctctctaaagcagacctttcctctccccatggttccttatcacatctccctgttttcgagtcatcatagcatttaacactctgaaatcaccctgtccatttctgtttccttttttgctatccatctccccagcaatgctctttgagagccatctcttgtttgcttttcatgacagtatctccagtgcccagcacagtgcctggcccagaagcatttattgttcgacagattgagtgaaaggatcgtgtcatggtgtatcttgaaacagccctgcctgggttgccttccgaatcaggagatgctgctgcaggcagtgccttcctagggtatgtggagctggatggaggctgaggttcagtggggcagggaccctttggggttcagggtcagaaacatggttctggccattccaagggtgacctgagccaatgggaggctgactcatgttaaagaaactcagtggggggtgatgagcaaattgaaaagccaaggccaaggggcactaggtaatgtactactagtgaggactcatttcagaaggaaaactgtacctgg

SEQ ID NO: 120589 - DNA, 1047 bp, Homo sapiens
ctgcctgctggtggagaacagactacagcaggcaagggaggaagcagggaagacctatcaggaggctgctgtcacaagccaggcaggcctcgggagtgggggctaagactagggtggcatcgcagggggcagattcctgattggttctgaaggtcaagccgacagagcttgctggtgaattgggtgtggggtgtgggaggaggagaaaagtcatggatgactcccagatttctggctgatacttggttaacgggagacaacgtgttcccactaatacaagtgtagggggtgaggagtggctcccaacccttgggggtactggggggcagtgaaagttggctgctggaggtcagtggatggaggggccataaagcgaatgaggtcctccttacatttctgctccctggttctttaacctcagagctaattttcctgtggtctcctgggtagaagccaaggcctggcctggaggaaccaggtaactgcatatgcagagatggctttaggggttgctagaagttggggtgcagcacccctatctccccctgcagctgggtggggtgctttccaggagctggagctctacccagggacccacagtgacccgaggtcggagggggtcagagtctgccaggctgtgggagacccccagaaatgctgtccttccttccctccctttctgtgctgctatgggccaaggccccaccagctctcaagctgcaacattgatttgctttcattgttgttattgttattattatccacttaaacaacttcatagaaaaaaaagaagcccaatgaccatcaaacattaaccattcattctaaactccctgcccatacctgtcaatatatttttacatagcagtaaacagtggtctgttctgctttctcggctgcctttatctcctacacacgtctcctgctattgactgagccctcagacctgtcactttaatggccgcaggacaccccctgcatcgatgtgctggagttcgggtcaccatttctctgctgccgagcatttgggtaggagccaatttccct

SEQ ID NO: 120590 - DNA, 1027 bp, Homo sapiens
ttgtgagccaccatgcctgatcaaaaccagcaaatatttaatgagtacccactacgtgtctggaagggtggtgggtcttggctgcagaggtgaaatgacatctgtccccaaggagctcacagctgagctggtgaacacacagccttttctaatgccctcattttccagatggaggagctgaggttcacattgagtgacttgcccagggccctacagttaggcggtggtggagtcagggttcgaactcaagactgcccaatgcaaagtccagtgcctgtctacttccccaaatgtgaggtttctgaaggcattccctggcagatttttgttccccagcctgtgctgtggcagatgggttggcccaagggagcagcataaggaccccccaggcctgtttgctagaaagaaagacctgaccagaaaggcttaaacaaatgatgactttctcaagtctcaaggtaggttctcaaggctcctttcatcttcgtgctctgctcttctcatggtggtggttctcaaacttggctgcatgttagaataacctggaaggtttaaaaagtcctgatgctggctaggctcagtgactcacacctgtaatcccaacactttgggaggccaaggcgggtggatctcctgaggtcaggagtttgagaccagcctgggcaacatggtgaaaccccgtctctactaaaaataaaaaaattagccaggtgtggtggcggacacctgtaatcccagctactcgggaggctgaggcaggagaatcgcttgaatcagggaggccgaggttgtagtgagccgagatcacgccactgcactccagcctgagcaacgagagtgaaactccatctcaaaaaaaaaaagcccaggttgcacaacatacccattaaatcagaatgtctagggggtggaaaccagtcatctgcattaaaaaaaaaagtccctacgtgattccagtgtgcagcaaaggttgggaaccctgccttttgacattttgcctcaaggtcaccaaaaggctgatggggct

SEQ ID NO: 120591 - DNA, 1051 bp, Homo sapiens
agagccctggggagcaccaatgtttagggggcgggaggaggcctgagaggggacatgacccgagggtctgtgacagagtctgtgagaggaggaggaggaatgagaaagggccaccgggggactggggagctcggggcagctgcagcacagagtggggctcctcaaactttcccgtgcacaagtctcccctgggatcttgtggaaatgcggattcttgattcagcggggctggggctgggctgagattctgcgtgaatctggtggtgccgatgctgctagaccagggattgcgctgtgcaaaatgagggcttcaagtaagaagtctggactcgggttggagggccaggtgggcagcctgttgcctctgagggtccttgcccaatggcctcgcctctctgagcctcagtttccccatgtgaagcctggtttaggcacgcttaccttttgggattacagagaagcccaggagtgatagcactttgtaaactcgaaggtgaactatggggactccgtttcacgagagcagagagggtggcaggcagatggcagggagctccgggtgtgggtggcatgtggcaacaggaggtataggctgtgcttttgagaaatgtggcaggccagggaggctggaatagcagctccccttccccaagcccagccttttgcctgtgaaaggctggagctgcaggggtgggtgaccttggtggctgggtggtggcttgagcagactcgagggcactgcttggctggctttgaagattccaccccaggctcttcttggttcctttccaggcccagaaactcagccgagatacattaattatctggaggattggaagctgtgtagaaaagtggttctcagccctggcgcatgtcagaaccacctggagagctttttcaacaacagatgcccagccccaccccgggcctcctgaatcagaaaccctgcaggtggcatcaaggcatctgtggttgtaagagctgtttagatgattcttgggcacagctggtgtagacagtgtgtctgaaaaagccagaccaaaacagatgt

SEQ ID NO: 120592 - DNA, 1421 bp, Homo sapiens
ctcctggcccagtttgttgtcctctggggtggatcctgtaatctgctttctggcaagccagggggctgggctggccccagtggcctagttctggggcaaaggcagtagccaagtgatggaagaggaatatcttgcatgcggatagcgtcagggaacaccccgccttctgtcccggcttctgctcctctcatagcagtcggaccgcaggtcagtgggattcctctcccttacaaaaacacaacaaacccctgaattatttaatatgcagaagtgggaattgacattatccttaagacaggttgtttgcaacttactggtggaagtcaaaatatttcaccaaaggtgtcatcagaaactactatcctatgttaatttttgtaggaacatgaagacagatgttgaataatttgacaagagcaacacagcttacagaattatcactaagtcaggtttttttccctcctctggggagcacggagaaggaatttcaggaagtgagtgtcccagtgtcatctcccgggtgttgatctgggtgtgggcacttgaggtttttcactggagttcctaccccatgccttgaaactttggtttcctggggctaacagaggcttggggttctcttttgtcctcgagaagctccgtgcttctgttccttctttcttttcacttacagaaattgcacaagcgagggggagcactttgtgtccacaaatccaagctgctttgtttgctttgctggtgttacctccccatcccaagttgattttggccctttagccagtgtgaggggtccccagacccttggtgtcaggctggagagcccccgccttagggtcaagatcctcatgatgtcccatccgacattacaggatgggaatctgcttcatgggtgggcgggggctctaggtcaggggaggaggtcggttagagaggattttgttagcaggaaagcatccttgagggggtgggcaggggagagctgagagctacttggctaggcctggctgtgagctgctgggaccaaggtggcaaagcctcatttagagcctggtatattagctctgctttgctggaacatggagggacaggctgggggggaaggggggtggaatctgtagggagaatggagggagctaatcacagccgccaaggcccggcaaatgaatgatgcaggaaatcaatacctgggggcgggagtggaaatccgggcagtggtagcagccccagcttctcccagctgcccaggaggcatgggggagggcctgggaggagtgagacagaggcaggaatgtggaagacacccccaccccaaacaccactgcccccacgtccctgccactcccccctgcccccctccccactttcatctcatggctgggctcatgaaaggtgggctaggagatgacccacccggtgaagac

SEQ ID NO: 120593 - DNA, 1101 bp, Homo sapiens
tttccttgtcaaaaaggaagaaaaaaaccacacaaaacctgaagtcagcctggattggggaatatgagatccagtttcctcagttggctctcaaattctcctctttctcaatttaagtaaaaatgataaaaatgttgacagtgggtagcatatattgtttggccatcatgtgttaaggcgaaaaaaatgtgaggtgggaaatcagctcctcttcctccccccattactgtttaaattctcctggtaacactttaagcttcatggattgccacctaacaggtgcctccatcataccacatgactgtagttctgcagtaagaaagctggagactttgaaggctggcttttgtgatttgagtcccttttctcttttatcgttttgttttagttttattttttgagagattccgtatatttggagacatagaggcaggaaggaagattgtttctggtgaggacatcttgggaagaagtatggaagtagttttccctttgctatctcccatattgtaggaatggttaacagaaattaagagtaattttgggagtgcagagaaagattagaaagtggatcttaatgtagacttctgtggaagttgtcgtatctcaaggttatgacaaagaagtggattttcattttctcatttttctgcctttctcaaaaatttccctgtggaaggacattagtcaaaaataagttgtggcatataaaaagtcctaaaaatgtgaaaatatttctagtcttcccttcattttgatttgaaaataattggtttgcctgtgaagtgctttcatggactgtctaattcccacaagaatcttgcgaggtaggaaccattatctcattattagctggggaaactgaggctttgggtggataatttgccgcttcacacagggagtgtagggtggagctggtgagctctttagagtgcgtagtaccatcatgtttatggtatcagtctgctgccctggaaaaatcttgtgtcacaagcctcagattgtaactcattgtaagacatatgtcctaaagaaagtcgctgccagtggcagctaatgctcaggatgtatcaggtctctttcctggcaacacgtttatgt

SEQ ID NO: 120594 - DNA, 1296 bp, Homo sapiens
tgcaatgttttaacctttcctaaggacgtttgtagacaattgtgtagtttgtattttataccaaagcatagcaacattgccgccttgtttccatcgtatcacaactgactttggacatgtttcccttactgtatgggccacattcatattttgttcactgagtaaacttagaatatatttaacagatatttgaatgcctgtgatataatggtgggcaaggaggtgctggccccatactctggggcagggggcacagggaagtaaactgacagttgcaatacgttgtacaggtgctctaggggaggggcacctaccctagctggggtggaggtagaggaaagtagcctggagaaagtgacactttagcctagacccacaggaagggtagaagtagagtatggaaacaaatattcctttcaggcagtgggactaacatgggtgaaggccgggatgtgagtgagagcactactcatttgaggaacaggtttgttgggtctgttgatagattgtgaagggggatcacaatctagagataagggggtctgttggtagattgtgaagggtgatcacaatctagagataaggctggggaattgagaggaattggtgatccagggccctcatagcattgtaatgctgaggactttggacttttatcctgagtgcagtgaggagctactcaagaactttgatcagggagtgatgtatatctttaatgtgaaagactattggtggttcttgagaatggcttgggtgtgtgggtatgactctgtgtgtctgtatgaatgtgatatacgtgtttccgtggaacgttgccaagtccagatttgccctgtggtggcgtgaaccagtgtaatgcctggggagaatagagcgaagtacatagaagtgaaagccattcaggaggtatcttttgccttttcccttcatgaaaatgaaggtgaatatgttttaaaaattttatgcagctttgcactccttggaagctctaggtctaaagtcagctagccagggcgcacacccagccctttgctgaggagcctctcagcagaatgttttggctccggcagactaacggcagttcctttaggattgctgctctttcgagtgacttaggctgcaggacttgctgcccagcattgcccagtcaggacactaatcagtgtggctcggttgaataggagagctttaactgcattctcttgtgagaatgcagttgaagaatgccaagaggagtgtacaattcaaatgcgttagtgcttgtaacacgtggttccagttctctccctcttggct

SEQ ID NO: 120595 - DNA, 1049 bp, Homo sapiens
tataatccttaatggtatcaaaattaacattagttttcacaaattaacctttccttgctctaaaaatcagagaactaagaaggctttgaaaagaataaagtccttaaaaagaaaccaagaacagtatataaaagattatttatttagaacagaatacttagagggtgagaactaatatcatttggattttttattaggtcatagggaggttctgtccatgcaaagtgatgtagtattttgaattcttgcaataatcacagattaaaattgaggttaaatattgttgttttctttttcacccaggcctgggactggcaggctgcatggctttgtggctgaggctggaagcagagcctatcaaagtcccctctcttgcaaaaaaaaaagaaattcttttctgtttttgaagaaaggttaaggttgatatctcagcaaagctacttgaaggaagtgattggtcttgacccagcacttgtaatgcagtacttacaaaatcatccagattctggctttttggatttcgtgggactttgtgtcagagtggttttcaaaagagggccttcattccaactgtgtggatgacactgatgttactcaatttttctagggtttctgaggaacagcgatcctgctctgggctgggtccctgtgtaacaagattacattgctgagtgagatatttaaacataagacatttcctgtaagtgtcatatgcagaaaaggaggttaaggaactttatttacagtgtcttggctggatgctgtggctggcggctgtaaacccagcactttgcgaggccaaggcgtgaggatcacttgaggtcaggagtttgagaccagcctgaacaacatggtgaaactccgtctgtaccaaaaataaaaaaattaactgaggtggtggcatgctcctgtagtctcagctacttgggaggctgaggcagtagattcgcttgaatccaggaggcagagattgtagtgagctgagattgtgccactgtactccagtctgggcaacacagtgagactccatctcaaaaaaaaaaaaaaag

SEQ ID NO: 120596 - DNA, 1038 bp, Homo sapiens
ggctcgaaaaatgaaatgaaataaaataaaataaatggagaagtgtttttgtatattgacccacaaaaatacttgcatgtagaaacttttaattttttttattgatttgggaggacatgttcatgtagtctctgaggcctgagttccctgtttctgtggatcagtcactgttaactagctcaccctgttcccccaacctcacccatgctgtagcacttccaatatgtgcttaaaaccgtgcattttatttgtaaggctgatgatcttcttcagggaatattgagcaggatctattaaggaacagttgctttgacttaaatgaaaaagtctttgcaactgacagataaaatcttgagtgaaaatgtgtggagtactgcactcttgtatagtaggatctctttaggggatctcaaaaatcctgatctgtggaagtgtatgtccctacaaactgcattttcttacccttggttttaaactttctaggattatatattctaatatgatagttgaaagccaccaaatttacctaaatagttttcattctaaataaattagatttttacattgtgtgtgtttttggttggagttagggacaggaagagtagactgttggttttgtgtttaaagttgcggtgcagaaaagtcattggacagagatctgtgtaatttggaggtgagttggaagggaaaggacacagaaggtggtcaaaggggaagactggggcaagggggatgaggatggggacacacagaggaaagtagaatggtgggattataattgggaatgaagttgctttgtggccaccatcgtttagtcaaactgtgagaggtggtctcatctgtaaggctagagtaattaatgtgaaaaggtggtggttagggtgaatgagatgttctgtcttttcttgaagtgtggtatgtgagtcccctgggaccttacaggaaagtgctaatgatcacaggatgacagctgagatacagattccaaactaaagtttagtggaaatagcagcagctttcagcaaaattggtgttcca

SEQ ID NO: 120597 - DNA, 1027 bp, Homo sapiens
ttccattccttgggattgatttttcttctctcctctttcccccatgcctggtggggaattcaacagtcttgcccatcgtctgtttaacttgctcttcttagaaaaacaactcacacaagcccttcttttttaaaagattttacagtgaatacatatggggaagttacattagatcttaaagaatttaacagtagtatttcctggggaatgggaccttttcttatttgctgagaggctgatgaagggccccctttctcgtctatcccaaactcctccaaaactccgaagatgaagggcatactgatctcttatctccagaaaaccagctgaaccaagtggctaggcatgggttttggaatcaaagatctggattggaatcaaagacgtgagtttacctctgtgtctctttatctttaaaaaaatagtatcttagagttggctttgagatttaatgagctctgatgcctctcaagcccttgccacagagcctggtcatggtaattacatttattaaaggccagcttcccaacttgaaagaaggagcactgatggcagattagtaaatacagaactatcttacctcatatgggaaatttgcatttatagtgatctccagactgatgccaccttattaattggtgaagtttctgaccagcttttggcccctttggccattttccagagccagtcctttttccagcaagtgttaagcactctattgtgtgtcttgagctatgctaggcaagagataccttggtctggcttctgccctgagaaagctcacggtctagaaggggagatggatcaataaactgacaaaacagtgttcgagaagtgctctgggagatcactgagtattgtgagaactctaatgggcagcttacctagatgggaactgagggcggccaggagagcttctcatgagttaggtttgagctagatatgaaagacgagcagaagttaaccacatgaagatggtaaggaggggatttctgggcagagggaacagcatgtacagagaggcaca
